United States Patent 7,374,927 (METHODS OF ANALYSIS OF DEGRADED NUCLEIC ACID SAMPLES) - sequence listing, part 17

SEQ ID NO: 641855 - DNA, 25 bp, Homo sapien
gtttccaacacatgaccttggaggg

SEQ ID NO: 641856 - DNA, 25 bp, Homo sapien
gagggacacattcaagccatacata

SEQ ID NO: 641857 - DNA, 25 bp, Homo sapien
tgcaattccggtaacagcatatttg

SEQ ID NO: 641858 - DNA, 25 bp, Homo sapien
gcaattccggtaacagcatatttgt

SEQ ID NO: 641859 - DNA, 25 bp, Homo sapien
attccggtaacagcatatttgttca

SEQ ID NO: 641860 - DNA, 25 bp, Homo sapien
gaagaacagggagatactgcttagt

SEQ ID NO: 641861 - DNA, 25 bp, Homo sapien
cagggagatactgcttagtggatgc

SEQ ID NO: 641862 - DNA, 25 bp, Homo sapien
tactgcttagtggatgcagagttta

SEQ ID NO: 641863 - DNA, 25 bp, Homo sapien
cagagtttatgttgagggtgatgaa

SEQ ID NO: 641864 - DNA, 25 bp, Homo sapien
atggctgcacaacagtgagaatgta

SEQ ID NO: 641865 - DNA, 25 bp, Homo sapien
aacagtgagaatgtacttcatacta

SEQ ID NO: 641866 - DNA, 25 bp, Homo sapien
gagaatgtacttcatactatggaac

SEQ ID NO: 641867 - DNA, 25 bp, Homo sapien
acttcatactatggaactctgcact

SEQ ID NO: 641868 - DNA, 25 bp, Homo sapien
gtctattttgccataacaagaaagt

SEQ ID NO: 641869 - DNA, 25 bp, Homo sapien
agtaatttgggtgtattttagagat

SEQ ID NO: 641870 - DNA, 25 bp, Homo sapien
gaaaatactgtaagcacaagaggaa

SEQ ID NO: 641871 - DNA, 25 bp, Homo sapien
cttctcctcttcagatggactgcag

SEQ ID NO: 641872 - DNA, 25 bp, Homo sapien
tctcctcttcagatggactgcaggg

SEQ ID NO: 641873 - DNA, 25 bp, Homo sapien
acgagactccagtggcagccgctca

SEQ ID NO: 641874 - DNA, 25 bp, Homo sapien
agtggcagccgctcaactctgaaca

SEQ ID NO: 641875 - DNA, 25 bp, Homo sapien
aactctgaacacagccactgcatag

SEQ ID NO: 641876 - DNA, 25 bp, Homo sapien
acacagccactgcatagagggttca

SEQ ID NO: 641877 - DNA, 25 bp, Homo sapien
acagccactgcatagagggttcagt

SEQ ID NO: 641878 - DNA, 25 bp, Homo sapien
tccccaccaagcagtgagtggcttt

SEQ ID NO: 641879 - DNA, 25 bp, Homo sapien
caagcagtgagtggctttctgctgt

SEQ ID NO: 641880 - DNA, 25 bp, Homo sapien
gaggcctcacctcctgtgtttttaa

SEQ ID NO: 641881 - DNA, 25 bp, Homo sapien
tccagtttctgtctttccctgttgg

SEQ ID NO: 641882 - DNA, 25 bp, Homo sapien
actgtgccagccaactaaggcagct

SEQ ID NO: 641883 - DNA, 25 bp, Homo sapien
gccagccaactaaggcagctttagt

SEQ ID NO: 641884 - DNA, 25 bp, Homo sapien
actaaggcagctttagtgggatggt

SEQ ID NO: 641885 - DNA, 25 bp, Homo sapien
gggatggtgttgaagacagctacat

SEQ ID NO: 641886 - DNA, 25 bp, Homo sapien
gaagacagctacatctgacatcctg

SEQ ID NO: 641887 - DNA, 25 bp, Homo sapien
gacagctacatctgacatcctgaga

SEQ ID NO: 641888 - DNA, 25 bp, Homo sapien
gctacatctgacatcctgagactga

SEQ ID NO: 641889 - DNA, 25 bp, Homo sapien
atctgacatcctgagactgaccgtg

SEQ ID NO: 641890 - DNA, 25 bp, Homo sapien
gacatcctgagactgaccgtggagt

SEQ ID NO: 641891 - DNA, 25 bp, Homo sapien
gagactgaccgtggagtatatgaaa

SEQ ID NO: 641892 - DNA, 25 bp, Homo sapien
cccatctctacatcccataatttaa

SEQ ID NO: 641893 - DNA, 25 bp, Homo sapien
ttttctgcaaaggatcagctgggag

SEQ ID NO: 641894 - DNA, 25 bp, Homo sapien
gtttcaactttgtagtctcgtcgca

SEQ ID NO: 641895 - DNA, 25 bp, Homo sapien
ttgtagtctcgtcgcagctactcta

SEQ ID NO: 641896 - DNA, 25 bp, Homo sapien
tctactcgactctgccactggagtg

SEQ ID NO: 641897 - DNA, 25 bp, Homo sapien
caaaaacagtctgcaggctgtgtct

SEQ ID NO: 641898 - DNA, 25 bp, Homo sapien
ctttggtttgctggcctgcgggctc

SEQ ID NO: 641899 - DNA, 25 bp, Homo sapien
gcgggctcctagaaggctctgactt

SEQ ID NO: 641900 - DNA, 25 bp, Homo sapien
gctctgactttatccctctatgagg

SEQ ID NO: 641901 - DNA, 25 bp, Homo sapien
ccctctatgagggaaagcaggtttt

SEQ ID NO: 641902 - DNA, 25 bp, Homo sapien
tctcccaaatctttataccttatgt

SEQ ID NO: 641903 - DNA, 25 bp, Homo sapien
ataccttatgtctgtgtctcttttt

SEQ ID NO: 641904 - DNA, 25 bp, Homo sapien
taagtatgtatgtagcgataactca

SEQ ID NO: 641905 - DNA, 25 bp, Homo sapien
gtagcgataactcattttggtttta

SEQ ID NO: 641906 - DNA, 25 bp, Homo sapien
gttgaacatctttccacatacttat

SEQ ID NO: 641907 - DNA, 25 bp, Homo sapien
ctttccacatacttatttgccatct

SEQ ID NO: 641908 - DNA, 25 bp, Homo sapien
atttgccatctgtcgacatacttat

SEQ ID NO: 641909 - DNA, 25 bp, Homo sapien
tctgtcgacatacttatactctttg

SEQ ID NO: 641910 - DNA, 25 bp, Homo sapien
ttgacttttgagagttcctttgcat

SEQ ID NO: 641911 - DNA, 25 bp, Homo sapien
gagagttcctttgcatattgtagat

SEQ ID NO: 641912 - DNA, 25 bp, Homo sapien
gttcctttgcatattgtagatacta

SEQ ID NO: 641913 - DNA, 25 bp, Homo sapien
gtagatactagttttagtcagagat

SEQ ID NO: 641914 - DNA, 25 bp, Homo sapien
gtcagagatgtagtttgcaaatgtt

SEQ ID NO: 641915 - DNA, 25 bp, Homo sapien
gaaatgcatagctgcacttaatctg

SEQ ID NO: 641916 - DNA, 25 bp, Homo sapien
atagctgcacttaatctgaatgaca

SEQ ID NO: 641917 - DNA, 25 bp, Homo sapien
tgcacttaatctgaatgacacacac

SEQ ID NO: 641918 - DNA, 25 bp, Homo sapien
tgacacacacgttttgcgagcatta

SEQ ID NO: 641919 - DNA, 25 bp, Homo sapien
gcgagcattactgctttccacaaaa

SEQ ID NO: 641920 - DNA, 25 bp, Homo sapien
aaaactgctgaatggagttcgtcct

SEQ ID NO: 641921 - DNA, 25 bp, Homo sapien
tgctgaatggagttcgtcctgccaa

SEQ ID NO: 641922 - DNA, 25 bp, Homo sapien
gaatggagttcgtcctgccaagatc

SEQ ID NO: 641923 - DNA, 25 bp, Homo sapien
tggagttcgtcctgccaagatcaga

SEQ ID NO: 641924 - DNA, 25 bp, Homo sapien
gttcgtcctgccaagatcagagttt

SEQ ID NO: 641925 - DNA, 25 bp, Homo sapien
cgtcctgccaagatcagagtttaag

SEQ ID NO: 641926 - DNA, 25 bp, Homo sapien
acaggatcaacttacagctactata

SEQ ID NO: 641927 - DNA, 25 bp, Homo sapien
caggatcaacttacagctactataa

SEQ ID NO: 641928 - DNA, 25 bp, Homo sapien
aggatcaacttacagctactataag

SEQ ID NO: 641929 - DNA, 25 bp, Homo sapien
ggatcaacttacagctactataaga

SEQ ID NO: 641930 - DNA, 25 bp, Homo sapien
gatcaacttacagctactataagat

SEQ ID NO: 641931 - DNA, 25 bp, Homo sapien
tattaaaaaacaggatgaccaaatt

SEQ ID NO: 641932 - DNA, 25 bp, Homo sapien
attaaaaaacaggatgaccaaattg

SEQ ID NO: 641933 - DNA, 25 bp, Homo sapien
ttaaaaaacaggatgaccaaattga

SEQ ID NO: 641934 - DNA, 25 bp, Homo sapien
aaaagtgccttgttctgaagattga

SEQ ID NO: 641935 - DNA, 25 bp, Homo sapien
gtgcttaacacaaagaagtgctcat

SEQ ID NO: 641936 - DNA, 25 bp, Homo sapien
caaagaagtgctcattaagtttgct

SEQ ID NO: 641937 - DNA, 25 bp, Homo sapien
tatttttgttgttatgtgtctaaac

SEQ ID NO: 641938 - DNA, 25 bp, Homo sapien
atctgggcatactgtgttcaatgtc

SEQ ID NO: 641939 - DNA, 25 bp, Homo sapien
ctgtgttcaatgtccctggtctaaa

SEQ ID NO: 641940 - DNA, 25 bp, Homo sapien
gtccctggtctaaaagaagcattaa

SEQ ID NO: 641941 - DNA, 25 bp, Homo sapien
cataaaacgcagtgatttttggtct

SEQ ID NO: 641942 - DNA, 25 bp, Homo sapien
tgatttttggtcttgaacattctct

SEQ ID NO: 641943 - DNA, 25 bp, Homo sapien
ttggaatctaaaggcttttggaagc

SEQ ID NO: 641944 - DNA, 25 bp, Homo sapien
gcttttggaagcagttttgtatagt

SEQ ID NO: 641945 - DNA, 25 bp, Homo sapien
ggcaggagggtgagcattatataaa

SEQ ID NO: 641946 - DNA, 25 bp, Homo sapien
aagagatattttgcattttaggagc

SEQ ID NO: 641947 - DNA, 25 bp, Homo sapien
gcattaaaatacaatcacactcatt

SEQ ID NO: 641948 - DNA, 25 bp, Homo sapien
atacaatcacactcattgttgaaag

SEQ ID NO: 641949 - DNA, 25 bp, Homo sapien
catgctcctgacatcaactgaaggg

SEQ ID NO: 641950 - DNA, 25 bp, Homo sapien
aggggcatctctcacaagacctggg

SEQ ID NO: 641951 - DNA, 25 bp, Homo sapien
gtatggaatctaatgttactacagc

SEQ ID NO: 641952 - DNA, 25 bp, Homo sapien
ggaatctaatgttactacagcaagt

SEQ ID NO: 641953 - DNA, 25 bp, Homo sapien
gttactacagcaagtgaatccacct

SEQ ID NO: 641954 - DNA, 25 bp, Homo sapien
gaatccaccttgcatagagtgaaat

SEQ ID NO: 641955 - DNA, 25 bp, Homo sapien
tccaccttgcatagagtgaaatatt

SEQ ID NO: 641956 - DNA, 25 bp, Homo sapien
agaagtgaaaatggcgcgtgcctgc

SEQ ID NO: 641957 - DNA, 25 bp, Homo sapien
tgaaaatggcgcgtgcctgccttaa

SEQ ID NO: 641958 - DNA, 25 bp, Homo sapien
gaaaatggcgcgtgcctgccttaac

SEQ ID NO: 641959 - DNA, 25 bp, Homo sapien
aatggcgcgtgcctgccttaactga

SEQ ID NO: 641960 - DNA, 25 bp, Homo sapien
atggcgcgtgcctgccttaactgat

SEQ ID NO: 641961 - DNA, 25 bp, Homo sapien
tgcctaacagagaacaatccccttt

SEQ ID NO: 641962 - DNA, 25 bp, Homo sapien
gcctaacagagaacaatcccctttg

SEQ ID NO: 641963 - DNA, 25 bp, Homo sapien
taacagagaacaatcccctttgact

SEQ ID NO: 641964 - DNA, 25 bp, Homo sapien
tatctccattcactgactctttttg

SEQ ID NO: 641965 - DNA, 25 bp, Homo sapien
tctccattcactgactctttttgga

SEQ ID NO: 641966 - DNA, 25 bp, Homo sapien
cattcactgactctttttggactca

SEQ ID NO: 641967 - DNA, 25 bp, Homo sapien
attcaaatctgagttcaagaaattg

SEQ ID NO: 641968 - DNA, 25 bp, Homo sapien
agaaattgattgtattgcccttaaa

SEQ ID NO: 641969 - DNA, 25 bp, Homo sapien
attgtattgcccttaaaactatcta

SEQ ID NO: 641970 - DNA, 25 bp, Homo sapien
tgcccttaaaactatctactcaaac

SEQ ID NO: 641971 - DNA, 25 bp, Homo sapien
aaactatctactcaaacactgttct

SEQ ID NO: 641972 - DNA, 25 bp, Homo sapien
gtgaaagaaaatgtaacgtttgact

SEQ ID NO: 641973 - DNA, 25 bp, Homo sapien
cgtttgactaacgttgaaagactga

SEQ ID NO: 641974 - DNA, 25 bp, Homo sapien
gactaacgttgaaagactgagggta

SEQ ID NO: 641975 - DNA, 25 bp, Homo sapien
ttgtgcagaaaggagtgagccatgt

SEQ ID NO: 641976 - DNA, 25 bp, Homo sapien
agtgagccatgtgcaaaattctgta

SEQ ID NO: 641977 - DNA, 25 bp, Homo sapien
gccatgtgcaaaattctgtaagtaa

SEQ ID NO: 641978 - DNA, 25 bp, Homo sapien
ggaatatcctgtaaacaatcaaacc

SEQ ID NO: 641979 - DNA, 25 bp, Homo sapien
ggaaaggtacttagagctcttactt

SEQ ID NO: 641980 - DNA, 25 bp, Homo sapien
aaggtacttagagctcttactttct

SEQ ID NO: 641981 - DNA, 25 bp, Homo sapien
ggtacttagagctcttactttctaa

SEQ ID NO: 641982 - DNA, 25 bp, Homo sapien
tagagctcttactttctaagtacag

SEQ ID NO: 641983 - DNA, 25 bp, Homo sapien
gagctcttactttctaagtacagaa

SEQ ID NO: 641984 - DNA, 25 bp, Homo sapien
taagtacagaacaccctagacaatt

SEQ ID NO: 641985 - DNA, 25 bp, Homo sapien
gtacagaacaccctagacaattcaa

SEQ ID NO: 641986 - DNA, 25 bp, Homo sapien
gaacaccctagacaattcaaggcat

SEQ ID NO: 641987 - DNA, 25 bp, Homo sapien
caccctagacaattcaaggcatctt

SEQ ID NO: 641988 - DNA, 25 bp, Homo sapien
tcaaggcatcttaatctccatcaag

SEQ ID NO: 641989 - DNA, 25 bp, Homo sapien
gaagacttttactaatatggctttt

SEQ ID NO: 641990 - DNA, 25 bp, Homo sapien
tttttccaggcttcccaaactgtat

SEQ ID NO: 641991 - DNA, 25 bp, Homo sapien
ccaaactgtatttcaggttataata

SEQ ID NO: 641992 - DNA, 25 bp, Homo sapien
ttgttctgtttcttgcagagtacca

SEQ ID NO: 641993 - DNA, 25 bp, Homo sapien
gtttcttgcagagtaccaagttcga

SEQ ID NO: 641994 - DNA, 25 bp, Homo sapien
gatattggagaggtaaccctaagca

SEQ ID NO: 641995 - DNA, 25 bp, Homo sapien
gaggtaaccctaagcagggctggat

SEQ ID NO: 641996 - DNA, 25 bp, Homo sapien
taaccctaagcagggctggatggga

SEQ ID NO: 641997 - DNA, 25 bp, Homo sapien
ctggatgggaccttaatgggtttat

SEQ ID NO: 641998 - DNA, 25 bp, Homo sapien
ggaccttaatgggtttatttctcat

SEQ ID NO: 641999 - DNA, 25 bp, Homo sapien
atttctcatattatggaacacagaa

SEQ ID NO: 642000 - DNA, 25 bp, Homo sapien
tctaagctctccctggactccaagc

SEQ ID NO: 642001 - DNA, 25 bp, Homo sapien
agctctccctggactccaagctcta

SEQ ID NO: 642002 - DNA, 25 bp, Homo sapien
ccaagctctacaagcataagaatta

SEQ ID NO: 642003 - DNA, 25 bp, Homo sapien
gctctacaagcataagaattatagt

SEQ ID NO: 642004 - DNA, 25 bp, Homo sapien
gaattatagtagttgaactttggga

SEQ ID NO: 642005 - DNA, 25 bp, Homo sapien
aattagctgagcgtagtagcgctcg

SEQ ID NO: 642006 - DNA, 25 bp, Homo sapien
ttagctgagcgtagtagcgctcgcc

SEQ ID NO: 642007 - DNA, 25 bp, Homo sapien
tagctgagcgtagtagcgctcgcct

SEQ ID NO: 642008 - DNA, 25 bp, Homo sapien
agctgagcgtagtagcgctcgcctg

SEQ ID NO: 642009 - DNA, 25 bp, Homo sapien
ctgagcgtagtagcgctcgcctgta

SEQ ID NO: 642010 - DNA, 25 bp, Homo sapien
gagcgtagtagcgctcgcctgtagt

SEQ ID NO: 642011 - DNA, 25 bp, Homo sapien
tggatcattgacctttgctactcag

SEQ ID NO: 642012 - DNA, 25 bp, Homo sapien
attgacctttgctactcagttccag

SEQ ID NO: 642013 - DNA, 25 bp, Homo sapien
gttccagcccccacagaggtcaaaa

SEQ ID NO: 642014 - DNA, 25 bp, Homo sapien
gaggtcaaaatgatacaacatgtcc

SEQ ID NO: 642015 - DNA, 25 bp, Homo sapien
gatacaacatgtcctaaagtgccaa

SEQ ID NO: 642016 - DNA, 25 bp, Homo sapien
acatgtcctaaagtgccaagcatac

SEQ ID NO: 642017 - DNA, 25 bp, Homo sapien
gccaagcatacaaaagcagatattt

SEQ ID NO: 642018 - DNA, 25 bp, Homo sapien
gcagatatttagcatgaagcacata

SEQ ID NO: 642019 - DNA, 25 bp, Homo sapien
gaagcacatatttagcataaactat

SEQ ID NO: 642020 - DNA, 25 bp, Homo sapien
agcataaactatctggtgtgcccca

SEQ ID NO: 642021 - DNA, 25 bp, Homo sapien
ctggtgtgccccagatagtttctac

SEQ ID NO: 642022 - DNA, 25 bp, Homo sapien
tccgagaccgggactcccgcctgcg

SEQ ID NO: 642023 - DNA, 25 bp, Homo sapien
gcagcctcggcctgcctggatgagg

SEQ ID NO: 642024 - DNA, 25 bp, Homo sapien
gcctggatgaggctcgggccagccg

SEQ ID NO: 642025 - DNA, 25 bp, Homo sapien
tgaggctcgggccagccggctgctg

SEQ ID NO: 642026 - DNA, 25 bp, Homo sapien
gaggctcgggccagccggctgctgg

SEQ ID NO: 642027 - DNA, 25 bp, Homo sapien
ccagccggctgctggcggaggagga

SEQ ID NO: 642028 - DNA, 25 bp, Homo sapien
gccgagctggcccagcgggaggagg

SEQ ID NO: 642029 - DNA, 25 bp, Homo sapien
aggcgcggctggagcagagccggga

SEQ ID NO: 642030 - DNA, 25 bp, Homo sapien
cgcggctggagcagagccgggagct

SEQ ID NO: 642031 - DNA, 25 bp, Homo sapien
cgggagctggaggttctgcgggagc

SEQ ID NO: 642032 - DNA, 25 bp, Homo sapien
gctggaggttctgcgggagcagctg

SEQ ID NO: 642033 - DNA, 25 bp, Homo sapien
aattactactgtgaagtgaagtctg

SEQ ID NO: 642034 - DNA, 25 bp, Homo sapien
agtgaagtctgagcaactgggaaga

SEQ ID NO: 642035 - DNA, 25 bp, Homo sapien
tgaagtctgagcaactgggaagaaa

SEQ ID NO: 642036 - DNA, 25 bp, Homo sapien
gaagtctgagcaactgggaagaaat

SEQ ID NO: 642037 - DNA, 25 bp, Homo sapien
gtctgagcaactgggaagaaatgca

SEQ ID NO: 642038 - DNA, 25 bp, Homo sapien
caactgggaagaaatgcaaggtgaa

SEQ ID NO: 642039 - DNA, 25 bp, Homo sapien
actgggaagaaatgcaaggtgaaat

SEQ ID NO: 642040 - DNA, 25 bp, Homo sapien
aagcagtaggccaaattgtaacagt

SEQ ID NO: 642041 - DNA, 25 bp, Homo sapien
gcagtaggccaaattgtaacagtaa

SEQ ID NO: 642042 - DNA, 25 bp, Homo sapien
gtaggccaaattgtaacagtaagat

SEQ ID NO: 642043 - DNA, 25 bp, Homo sapien
ggccaaattgtaacagtaagatgta

SEQ ID NO: 642044 - DNA, 25 bp, Homo sapien
accggcctcggcgagggaggaggcg

SEQ ID NO: 642045 - DNA, 25 bp, Homo sapien
gggagctgcgaacacccagacccaa

SEQ ID NO: 642046 - DNA, 25 bp, Homo sapien
ggagctgcgaacacccagacccaaa

SEQ ID NO: 642047 - DNA, 25 bp, Homo sapien
agacccaaaccctgacatgctctgg

SEQ ID NO: 642048 - DNA, 25 bp, Homo sapien
aaaccctgacatgctctggggcgga

SEQ ID NO: 642049 - DNA, 25 bp, Homo sapien
accctgacatgctctggggcggaga

SEQ ID NO: 642050 - DNA, 25 bp, Homo sapien
gaggaagccaggagctgagcgcgcc

SEQ ID NO: 642051 - DNA, 25 bp, Homo sapien
gaagccaggagctgagcgcgccgcg

SEQ ID NO: 642052 - DNA, 25 bp, Homo sapien
gccggcaggaccatgctgctgaaag

SEQ ID NO: 642053 - DNA, 25 bp, Homo sapien
ccggcaggaccatgctgctgaaaga

SEQ ID NO: 642054 - DNA, 25 bp, Homo sapien
cggcaggaccatgctgctgaaagag

SEQ ID NO: 642055 - DNA, 25 bp, Homo sapien
taggttggtaggaaccatggcattt

SEQ ID NO: 642056 - DNA, 25 bp, Homo sapien
gaaccatggcatttatcatcccaaa

SEQ ID NO: 642057 - DNA, 25 bp, Homo sapien
tcccaaatgggatgctatcgtgaaa

SEQ ID NO: 642058 - DNA, 25 bp, Homo sapien
ttacatcagcacaatgtaatctggg

SEQ ID NO: 642059 - DNA, 25 bp, Homo sapien
ggcaaagcaggatgtattgtcaccc

SEQ ID NO: 642060 - DNA, 25 bp, Homo sapien
ggatgtattgtcaccctatttatag

SEQ ID NO: 642061 - DNA, 25 bp, Homo sapien
ataggttatgaattactccacaaat

SEQ ID NO: 642062 - DNA, 25 bp, Homo sapien
ctctacctcgcagggtttctgtaag

SEQ ID NO: 642063 - DNA, 25 bp, Homo sapien
cagggtttctgtaaggtaggattga

SEQ ID NO: 642064 - DNA, 25 bp, Homo sapien
tgtctgttacatcatgttacaaaga

SEQ ID NO: 642065 - DNA, 25 bp, Homo sapien
atgttacaaagagggaagctgtttc

SEQ ID NO: 642066 - DNA, 25 bp, Homo sapien
gcttaaaccaagtgctgggtctctt

SEQ ID NO: 642067 - DNA, 25 bp, Homo sapien
aataggttctgggtcggcagattta

SEQ ID NO: 642068 - DNA, 25 bp, Homo sapien
cagcagtttggctttagtctggact

SEQ ID NO: 642069 - DNA, 25 bp, Homo sapien
gctttagtctggactgtttcctgtg

SEQ ID NO: 642070 - DNA, 25 bp, Homo sapien
ttcctgtgttgctcattttgagcga

SEQ ID NO: 642071 - DNA, 25 bp, Homo sapien
tcattttgagcgatcagcccagtgt

SEQ ID NO: 642072 - DNA, 25 bp, Homo sapien
atcagcccagtgtttggttcacaca

SEQ ID NO: 642073 - DNA, 25 bp, Homo sapien
agtgtttggttcacacagctccgga

SEQ ID NO: 642074 - DNA, 25 bp, Homo sapien
aaaaacaagtcacggcacagctttg

SEQ ID NO: 642075 - DNA, 25 bp, Homo sapien
acagctttgacttgggactgcgcac

SEQ ID NO: 642076 - DNA, 25 bp, Homo sapien
ccatcggttcaacagccgggaaagt

SEQ ID NO: 642077 - DNA, 25 bp, Homo sapien
ttggaaacttcatcctcccatgcat

SEQ ID NO: 642078 - DNA, 25 bp, Homo sapien
tggaaacttcatcctcccatgcatg

SEQ ID NO: 642079 - DNA, 25 bp, Homo sapien
ggaaacttcatcctcccatgcatgt

SEQ ID NO: 642080 - DNA, 25 bp, Homo sapien
gaaacttcatcctcccatgcatgtt

SEQ ID NO: 642081 - DNA, 25 bp, Homo sapien
ctcccatgcatgttgaaagtgggac

SEQ ID NO: 642082 - DNA, 25 bp, Homo sapien
ccatgcatgttgaaagtgggacttt

SEQ ID NO: 642083 - DNA, 25 bp, Homo sapien
tgaacaaatatgctgttaccggaat

SEQ ID NO: 642084 - DNA, 25 bp, Homo sapien
gaacaaatatgctgttaccggaatt

SEQ ID NO: 642085 - DNA, 25 bp, Homo sapien
aacaaatatgctgttaccggaattg

SEQ ID NO: 642086 - DNA, 25 bp, Homo sapien
aaatatgctgttaccggaattgcat

SEQ ID NO: 642087 - DNA, 25 bp, Homo sapien
aatatgctgttaccggaattgcatt

SEQ ID NO: 642088 - DNA, 25 bp, Homo sapien
gtttggttccaaaacgcacgagcca

SEQ ID NO: 642089 - DNA, 25 bp, Homo sapien
aacgcacgagccaaattcagaagga

SEQ ID NO: 642090 - DNA, 25 bp, Homo sapien
agaaggaaccttttgcggcaggaga

SEQ ID NO: 642091 - DNA, 25 bp, Homo sapien
tgttgataaagctgacggcacgtcg

SEQ ID NO: 642092 - DNA, 25 bp, Homo sapien
actgcgaccactttaacagacctga

SEQ ID NO: 642093 - DNA, 25 bp, Homo sapien
ttaacagacctgaccaatcccacta

SEQ ID NO: 642094 - DNA, 25 bp, Homo sapien
tgaccaatcccactatcactgtagt

SEQ ID NO: 642095 - DNA, 25 bp, Homo sapien
actgtagtgacatccgtgacctcta

SEQ ID NO: 642096 - DNA, 25 bp, Homo sapien
tgacatccgtgacctctaacatgga

SEQ ID NO: 642097 - DNA, 25 bp, Homo sapien
tgacctctaacatggacagccacga

SEQ ID NO: 642098 - DNA, 25 bp, Homo sapien
catggacagccacgaatccggaagc

SEQ ID NO: 642099 - DNA, 25 bp, Homo sapien
gctcaaatgaacactgggcccatgt

SEQ ID NO: 642100 - DNA, 25 bp, Homo sapien
tgggcccatgtgtcagggccaagca

SEQ ID NO: 642101 - DNA, 25 bp, Homo sapien
agagagagacacacttggacaagac

SEQ ID NO: 642102 - DNA, 25 bp, Homo sapien
gaccaagaggcatttcattgtcacg

SEQ ID NO: 642103 - DNA, 25 bp, Homo sapien
ggagggattccaaaacacacagcag

SEQ ID NO: 642104 - DNA, 25 bp, Homo sapien
ggaagtacttctaaccctcagaggt

SEQ ID NO: 642105 - DNA, 25 bp, Homo sapien
gaggtcaaggagcttattccatgtt

SEQ ID NO: 642106 - DNA, 25 bp, Homo sapien
aggaatggcttattttctgatgacc

SEQ ID NO: 642107 - DNA, 25 bp, Homo sapien
gaccacatgtgggactatttcaact

SEQ ID NO: 642108 - DNA, 25 bp, Homo sapien
gggactatttcaactgccacgagaa

SEQ ID NO: 642109 - DNA, 25 bp, Homo sapien
aactgccacgagaaatcccagaagg

SEQ ID NO: 642110 - DNA, 25 bp, Homo sapien
taagtctttggtccacataaccaca

SEQ ID NO: 642111 - DNA, 25 bp, Homo sapien
acatcccacaccagagcagtacatt

SEQ ID NO: 642112 - DNA, 25 bp, Homo sapien
acatttgacatattcgacgcaccta

SEQ ID NO: 642113 - DNA, 25 bp, Homo sapien
gacgcacctaacttgacacatcatt

SEQ ID NO: 642114 - DNA, 25 bp, Homo sapien
tcaaagtccacagcttactctaggg

SEQ ID NO: 642115 - DNA, 25 bp, Homo sapien
ttactctagggctcgttcttggcat

SEQ ID NO: 642116 - DNA, 25 bp, Homo sapien
gttcttggcattgtgcattctgtgg

SEQ ID NO: 642117 - DNA, 25 bp, Homo sapien
atgacatgcgtccaccattgtagta

SEQ ID NO: 642118 - DNA, 25 bp, Homo sapien
cattgtagtatcatcaggagtggtg

SEQ ID NO: 642119 - DNA, 25 bp, Homo sapien
aggagtggtgtcatggccctataca

SEQ ID NO: 642120 - DNA, 25 bp, Homo sapien
gccctatacatccttcatgtcttag

SEQ ID NO: 642121 - DNA, 25 bp, Homo sapien
aagcaagcagaaagagaacttcaag

SEQ ID NO: 642122 - DNA, 25 bp, Homo sapien
agcaagcagaaagagaacttcaaga

SEQ ID NO: 642123 - DNA, 25 bp, Homo sapien
gaacttcaagaaacacaggatcaac

SEQ ID NO: 642124 - DNA, 25 bp, Homo sapien
cacaggatcaacttacagctactat

SEQ ID NO: 642125 - DNA, 25 bp, Homo sapien
ggcgacgcacaaaagcttgaagtag

SEQ ID NO: 642126 - DNA, 25 bp, Homo sapien
gcgacgcacaaaagcttgaagtaga

SEQ ID NO: 642127 - DNA, 25 bp, Homo sapien
gacgcacaaaagcttgaagtagaaa

SEQ ID NO: 642128 - DNA, 25 bp, Homo sapien
ggatgaccaaattgagcgacttgag

SEQ ID NO: 642129 - DNA, 25 bp, Homo sapien
gagcgacttgagaaaatcctgcagc

SEQ ID NO: 642130 - DNA, 25 bp, Homo sapien
gaaaatcctgcagcgttcaagtttg

SEQ ID NO: 642131 - DNA, 25 bp, Homo sapien
agtaccttagcacatggttgctgaa

SEQ ID NO: 642132 - DNA, 25 bp, Homo sapien
ttctttcctgctttcactgggcgct

SEQ ID NO: 642133 - DNA, 25 bp, Homo sapien
tctttcctgctttcactgggcgctc

SEQ ID NO: 642134 - DNA, 25 bp, Homo sapien
ctttcctgctttcactgggcgctcc

SEQ ID NO: 642135 - DNA, 25 bp, Homo sapien
tttcctgctttcactgggcgctccc

SEQ ID NO: 642136 - DNA, 25 bp, Homo sapien
ttcctgctttcactgggcgctccct

SEQ ID NO: 642137 - DNA, 25 bp, Homo sapien
tcctgctttcactgggcgctccctt

SEQ ID NO: 642138 - DNA, 25 bp, Homo sapien
cctgctttcactgggcgctcccttt

SEQ ID NO: 642139 - DNA, 25 bp, Homo sapien
tttcactgggcgctccctttctctg

SEQ ID NO: 642140 - DNA, 25 bp, Homo sapien
ttcactgggcgctccctttctctgt

SEQ ID NO: 642141 - DNA, 25 bp, Homo sapien
tcactgggcgctccctttctctgtc

SEQ ID NO: 642142 - DNA, 25 bp, Homo sapien
cactgggcgctccctttctctgtcc

SEQ ID NO: 642143 - DNA, 25 bp, Homo sapien
gcttcctatagtactgtcaagagtg

SEQ ID NO: 642144 - DNA, 25 bp, Homo sapien
aagagagctctttagcaaacacatt

SEQ ID NO: 642145 - DNA, 25 bp, Homo sapien
gcaaacacattatttatccatcctt

SEQ ID NO: 642146 - DNA, 25 bp, Homo sapien
ttaaaaagcttgtcacctccagggt

SEQ ID NO: 642147 - DNA, 25 bp, Homo sapien
acctccagggtgcttgttcagaagt

SEQ ID NO: 642148 - DNA, 25 bp, Homo sapien
acttaaatcatatcctagcatgtgg

SEQ ID NO: 642149 - DNA, 25 bp, Homo sapien
tagcatgtggaaaagctccctgagt

SEQ ID NO: 642150 - DNA, 25 bp, Homo sapien
tgtggaaaagctccctgagttcccc

SEQ ID NO: 642151 - DNA, 25 bp, Homo sapien
tgctgatttctcaggaccgctgata

SEQ ID NO: 642152 - DNA, 25 bp, Homo sapien
ggaccgctgataacagcttttcatg

SEQ ID NO: 642153 - DNA, 25 bp, Homo sapien
acagcttttcatgtccaacttggga

SEQ ID NO: 642154 - DNA, 25 bp, Homo sapien
aaaaccttgagttcgtgtctggcgt

SEQ ID NO: 642155 - DNA, 25 bp, Homo sapien
gagttcgtgtctggcgtagacccta

SEQ ID NO: 642156 - DNA, 25 bp, Homo sapien
gtctggcgtagaccctatatctaat

SEQ ID NO: 642157 - DNA, 25 bp, Homo sapien
gatttagaatcttgcacctggtact

SEQ ID NO: 642158 - DNA, 25 bp, Homo sapien
acctggtactgttgctcttcttgta

SEQ ID NO: 642159 - DNA, 25 bp, Homo sapien
actgttgctcttcttgtaaccattt

SEQ ID NO: 642160 - DNA, 25 bp, Homo sapien
gtcttttaagttgtttatcactctg

SEQ ID NO: 642161 - DNA, 25 bp, Homo sapien
gtttatcactctgtaaccattttga

SEQ ID NO: 642162 - DNA, 25 bp, Homo sapien
aagttaatcgagccccttcctcgtg

SEQ ID NO: 642163 - DNA, 25 bp, Homo sapien
tcgtggccgaaagaattttgagcat

SEQ ID NO: 642164 - DNA, 25 bp, Homo sapien
tttgagcattagctgtctctttggc

SEQ ID NO: 642165 - DNA, 25 bp, Homo sapien
gccaggcgtggtagtcgtcccctgt

SEQ ID NO: 642166 - DNA, 25 bp, Homo sapien
ccaggcgtggtagtcgtcccctgtt

SEQ ID NO: 642167 - DNA, 25 bp, Homo sapien
caggcgtggtagtcgtcccctgtta

SEQ ID NO: 642168 - DNA, 25 bp, Homo sapien
ggcgtggtagtcgtcccctgttaat

SEQ ID NO: 642169 - DNA, 25 bp, Homo sapien
gcgtggtagtcgtcccctgttaata

SEQ ID NO: 642170 - DNA, 25 bp, Homo sapien
ggtagtcgtcccctgttaataccag

SEQ ID NO: 642171 - DNA, 25 bp, Homo sapien
gtagtcgtcccctgttaataccagc

SEQ ID NO: 642172 - DNA, 25 bp, Homo sapien
tagtcgtcccctgttaataccagct

SEQ ID NO: 642173 - DNA, 25 bp, Homo sapien
agtcgtcccctgttaataccagcta

SEQ ID NO: 642174 - DNA, 25 bp, Homo sapien
gtcgtcccctgttaataccagctac

SEQ ID NO: 642175 - DNA, 25 bp, Homo sapien
tcgtcccctgttaataccagctact

SEQ ID NO: 642176 - DNA, 25 bp, Homo sapien
gaagaacatggattttccccactgg

SEQ ID NO: 642177 - DNA, 25 bp, Homo sapien
aacatggattttccccactggtagt

SEQ ID NO: 642178 - DNA, 25 bp, Homo sapien
atggattttccccactggtagttag

SEQ ID NO: 642179 - DNA, 25 bp, Homo sapien
gattttccccactggtagttagttg

SEQ ID NO: 642180 - DNA, 25 bp, Homo sapien
tttccccactggtagttagttgtct

SEQ ID NO: 642181 - DNA, 25 bp, Homo sapien
cccactggtagttagttgtctcttc

SEQ ID NO: 642182 - DNA, 25 bp, Homo sapien
ggtagttagttgtctcttccatatc

SEQ ID NO: 642183 - DNA, 25 bp, Homo sapien
tagttagttgtctcttccatatcca

SEQ ID NO: 642184 - DNA, 25 bp, Homo sapien
ctcttccatatccagaaataacttg

SEQ ID NO: 642185 - DNA, 25 bp, Homo sapien
gaaataacttgaacacgttagacgg

SEQ ID NO: 642186 - DNA, 25 bp, Homo sapien
ggccactgtgcatagtgtcctccca

SEQ ID NO: 642187 - DNA, 25 bp, Homo sapien
tcattcagggctgggagtaagcagt

SEQ ID NO: 642188 - DNA, 25 bp, Homo sapien
gtaaggttttacactcgggactcag

SEQ ID NO: 642189 - DNA, 25 bp, Homo sapien
ttttacactcgggactcagcgaaag

SEQ ID NO: 642190 - DNA, 25 bp, Homo sapien
ggactcagcgaaaggacagcgtgct

SEQ ID NO: 642191 - DNA, 25 bp, Homo sapien
ggacagcgtgctgacttctgagtca

SEQ ID NO: 642192 - DNA, 25 bp, Homo sapien
gctcttgccagctatgtggtcttcg

SEQ ID NO: 642193 - DNA, 25 bp, Homo sapien
gccagctatgtggtcttcgacgaat

SEQ ID NO: 642194 - DNA, 25 bp, Homo sapien
gtggtcttcgacgaatacttccacc

SEQ ID NO: 642195 - DNA, 25 bp, Homo sapien
gacgaatacttccacccctgtgtgg

SEQ ID NO: 642196 - DNA, 25 bp, Homo sapien
acccctgtgtggtgcagtttgctca

SEQ ID NO: 642197 - DNA, 25 bp, Homo sapien
tctgcaaaatgggactaatctaata

SEQ ID NO: 642198 - DNA, 25 bp, Homo sapien
gcctgaaggtcgaggatcataagaa

SEQ ID NO: 642199 - DNA, 25 bp, Homo sapien
gttcacttggagagccctgtggaag

SEQ ID NO: 642200 - DNA, 25 bp, Homo sapien
agccctgtggaagtccctcttagaa

SEQ ID NO: 642201 - DNA, 25 bp, Homo sapien
ggaagtccctcttagaagaatcaag

SEQ ID NO: 642202 - DNA, 25 bp, Homo sapien
aagaatcaagatgcggacagcactt

SEQ ID NO: 642203 - DNA, 25 bp, Homo sapien
gacagcacttgggaagcacgtggca

SEQ ID NO: 642204 - DNA, 25 bp, Homo sapien
agcacgtggcagcttccatggagat

SEQ ID NO: 642205 - DNA, 25 bp, Homo sapien
ggcagcttccatggagatgtgagaa

SEQ ID NO: 642206 - DNA, 25 bp, Homo sapien
gatgtgagaaccacgtcatgtcctt

SEQ ID NO: 642207 - DNA, 25 bp, Homo sapien
gtcatgtccttgctgctgtgaacat

SEQ ID NO: 642208 - DNA, 25 bp, Homo sapien
tttgtcgtggtaaaatatgcgtaat

SEQ ID NO: 642209 - DNA, 25 bp, Homo sapien
tctgccctcggttggtgtccgcagg

SEQ ID NO: 642210 - DNA, 25 bp, Homo sapien
tctccactcagccctggtgggtgcg

SEQ ID NO: 642211 - DNA, 25 bp, Homo sapien
tgcgggaaccaagggaagccagccc

SEQ ID NO: 642212 - DNA, 25 bp, Homo sapien
ggaagccagccctatcttcttgtct

SEQ ID NO: 642213 - DNA, 25 bp, Homo sapien
cagccctatcttcttgtctcaagac

SEQ ID NO: 642214 - DNA, 25 bp, Homo sapien
atcttcttgtctcaagaccaagagg

SEQ ID NO: 642215 - DNA, 25 bp, Homo sapien
cctggagctgagctgagctttcttt

SEQ ID NO: 642216 - DNA, 25 bp, Homo sapien
ggagctgagctgagctttctttccc

SEQ ID NO: 642217 - DNA, 25 bp, Homo sapien
tgagctgagctttctttccctatgt

SEQ ID NO: 642218 - DNA, 25 bp, Homo sapien
tctttccctatgtttatttgaaatt

SEQ ID NO: 642219 - DNA, 25 bp, Homo sapien
tttcatttttaaagacgagtcaggg

SEQ ID NO: 642220 - DNA, 25 bp, Homo sapien
tttttggtcagtaaagagccaaaca

SEQ ID NO: 642221 - DNA, 25 bp, Homo sapien
ttttggtcagtaaagagccaaacac

SEQ ID NO: 642222 - DNA, 25 bp, Homo sapien
tttggtcagtaaagagccaaacacc

SEQ ID NO: 642223 - DNA, 25 bp, Homo sapien
ttggtcagtaaagagccaaacaccg

SEQ ID NO: 642224 - DNA, 25 bp, Homo sapien
tggtcagtaaagagccaaacaccgg

SEQ ID NO: 642225 - DNA, 25 bp, Homo sapien
ggtcagtaaagagccaaacaccggc

SEQ ID NO: 642226 - DNA, 25 bp, Homo sapien
gtcagtaaagagccaaacaccggcc

SEQ ID NO: 642227 - DNA, 25 bp, Homo sapien
tcagtaaagagccaaacaccggccg

SEQ ID NO: 642228 - DNA, 25 bp, Homo sapien
cagtaaagagccaaacaccggccgg

SEQ ID NO: 642229 - DNA, 25 bp, Homo sapien
aagagccaaacaccggccgggcgcg

SEQ ID NO: 642230 - DNA, 25 bp, Homo sapien
agagccaaacaccggccgggcgcgg

SEQ ID NO: 642231 - DNA, 25 bp, Homo sapien
ttgttgctaccccattgattgaaat

SEQ ID NO: 642232 - DNA, 25 bp, Homo sapien
gttgctaccccattgattgaaatgt

SEQ ID NO: 642233 - DNA, 25 bp, Homo sapien
taccccattgattgaaatgtactag

SEQ ID NO: 642234 - DNA, 25 bp, Homo sapien
atgtactagaccttaatttctttat

SEQ ID NO: 642235 - DNA, 25 bp, Homo sapien
atttctttattacagacattggtgt

SEQ ID NO: 642236 - DNA, 25 bp, Homo sapien
agacattggtgtacttgaaggtttt

SEQ ID NO: 642237 - DNA, 25 bp, Homo sapien
tcccctctcaccttattaacaataa

SEQ ID NO: 642238 - DNA, 25 bp, Homo sapien
tcctcattaacaagtcattgcatga

SEQ ID NO: 642239 - DNA, 25 bp, Homo sapien
aacaagtcattgcatgagatgagaa

SEQ ID NO: 642240 - DNA, 25 bp, Homo sapien
tttcaggcccggaatgggaaaatct

SEQ ID NO: 642241 - DNA, 25 bp, Homo sapien
aaatctattccaaagagacacacta

SEQ ID NO: 642242 - DNA, 25 bp, Homo sapien
tggactgtcataagctagcacccgt

SEQ ID NO: 642243 - DNA, 25 bp, Homo sapien
tgtcataagctagcacccgtggtaa

SEQ ID NO: 642244 - DNA, 25 bp, Homo sapien
ctagcacccgtggtaagcgggacga

SEQ ID NO: 642245 - DNA, 25 bp, Homo sapien
ggacgagacaagctcccgaagcccg

SEQ ID NO: 642246 - DNA, 25 bp, Homo sapien
gacaccttacttgtcagtgttcctc

SEQ ID NO: 642247 - DNA, 25 bp, Homo sapien
ttacttgtcagtgttcctccgggcc

SEQ ID NO: 642248 - DNA, 25 bp, Homo sapien
catttggcagctcccgtatcttttg

SEQ ID NO: 642249 - DNA, 25 bp, Homo sapien
agctcccgtatcttttgttatgttg

SEQ ID NO: 642250 - DNA, 25 bp, Homo sapien
tcttggtgacagtagatgctctctg

SEQ ID NO: 642251 - DNA, 25 bp, Homo sapien
agtagatgctctctggagcgcagac

SEQ ID NO: 642252 - DNA, 25 bp, Homo sapien
atgctctctggagcgcagacgaggc

SEQ ID NO: 642253 - DNA, 25 bp, Homo sapien
gtatttgtcctattactgccacaga

SEQ ID NO: 642254 - DNA, 25 bp, Homo sapien
gccacagatgcaagataacctttta

SEQ ID NO: 642255 - DNA, 25 bp, Homo sapien
caaatacttttatagacttcagaaa

SEQ ID NO: 642256 - DNA, 25 bp, Homo sapien
agagaagttattcctgttatttctg

SEQ ID NO: 642257 - DNA, 25 bp, Homo sapien
gttatttctgaagcgttctgcatat

SEQ ID NO: 642258 - DNA, 25 bp, Homo sapien
aatacacagatttcccaggttgctt

SEQ ID NO: 642259 - DNA, 25 bp, Homo sapien
acagatttcccaggttgcttgttaa

SEQ ID NO: 642260 - DNA, 25 bp, Homo sapien
ggttgcttgttaaagttgtcaattt

SEQ ID NO: 642261 - DNA, 25 bp, Homo sapien
gttgtcaatttcactgaaccctctt

SEQ ID NO: 642262 - DNA, 25 bp, Homo sapien
aatttcactgaaccctcttcatgaa

SEQ ID NO: 642263 - DNA, 25 bp, Homo sapien
accctcttcatgaattgttttcctg

SEQ ID NO: 642264 - DNA, 25 bp, Homo sapien
atcggcaggaaaaactcctaactca

SEQ ID NO: 642265 - DNA, 25 bp, Homo sapien
ggcaggaaaaactcctaactcagtt

SEQ ID NO: 642266 - DNA, 25 bp, Homo sapien
ggaaaaactcctaactcagttacat

SEQ ID NO: 642267 - DNA, 25 bp, Homo sapien
aaaactcctaactcagttacattgg

SEQ ID NO: 642268 - DNA, 25 bp, Homo sapien
aactcctaactcagttacattggca

SEQ ID NO: 642269 - DNA, 25 bp, Homo sapien
ggagtgatcagcctcagatttgatg

SEQ ID NO: 642270 - DNA, 25 bp, Homo sapien
agtgatcagcctcagatttgatgtg

SEQ ID NO: 642271 - DNA, 25 bp, Homo sapien
tgatgtgcaactcaaagatctagaa

SEQ ID NO: 642272 - DNA, 25 bp, Homo sapien
tgtgcaactcaaagatctagaaaaa

SEQ ID NO: 642273 - DNA, 25 bp, Homo sapien
tcatggaccataaggaagcaagatg

SEQ ID NO: 642274 - DNA, 25 bp, Homo sapien
tggaccataaggaagcaagatgaaa

SEQ ID NO: 642275 - DNA, 25 bp, Homo sapien
tccatctccatggtaacaagtatat

SEQ ID NO: 642276 - DNA, 25 bp, Homo sapien
catctccatggtaacaagtatatat

SEQ ID NO: 642277 - DNA, 25 bp, Homo sapien
atctccatggtaacaagtatatata

SEQ ID NO: 642278 - DNA, 25 bp, Homo sapien
ctccatggtaacaagtatatatagt

SEQ ID NO: 642279 - DNA, 25 bp, Homo sapien
gtaagtactcaataactcataaatc

SEQ ID NO: 642280 - DNA, 25 bp, Homo sapien
gtactcaataactcataaatctatt

SEQ ID NO: 642281 - DNA, 25 bp, Homo sapien
attcaagggaaatttaaagctcatt

SEQ ID NO: 642282 - DNA, 25 bp, Homo sapien
gggaaatttaaagctcatttgaagg

SEQ ID NO: 642283 - DNA, 25 bp, Homo sapien
gaaatttaaagctcatttgaaggtt

SEQ ID NO: 642284 - DNA, 25 bp, Homo sapien
aaaacggataacatagccgggtgcg

SEQ ID NO: 642285 - DNA, 25 bp, Homo sapien
aaacggataacatagccgggtgcgg

SEQ ID NO: 642286 - DNA, 25 bp, Homo sapien
gagacaatggatgcaaacagcccac

SEQ ID NO: 642287 - DNA, 25 bp, Homo sapien
gacaatggatgcaaacagcccacac

SEQ ID NO: 642288 - DNA, 25 bp, Homo sapien
acaatggatgcaaacagcccacaca

SEQ ID NO: 642289 - DNA, 25 bp, Homo sapien
tgcaaacagcccacacaggaaagac

SEQ ID NO: 642290 - DNA, 25 bp, Homo sapien
aaacagcccacacaggaaagacaaa

SEQ ID NO: 642291 - DNA, 25 bp, Homo sapien
cagcccacacaggaaagacaaagca

SEQ ID NO: 642292 - DNA, 25 bp, Homo sapien
aaactcatagcacatcctccagtta

SEQ ID NO: 642293 - DNA, 25 bp, Homo sapien
aactcatagcacatcctccagttac

SEQ ID NO: 642294 - DNA, 25 bp, Homo sapien
catcctccagttacatggcagaaga

SEQ ID NO: 642295 - DNA, 25 bp, Homo sapien
atcctccagttacatggcagaagag

SEQ ID NO: 642296 - DNA, 25 bp, Homo sapien
cctccagttacatggcagaagaggg

SEQ ID NO: 642297 - DNA, 25 bp, Homo sapien
accgcacgggcacgctggagttcat

SEQ ID NO: 642298 - DNA, 25 bp, Homo sapien
acgggcacgctggagttcatggctc

SEQ ID NO: 642299 - DNA, 25 bp, Homo sapien
cgctggagttcatggctccggagat

SEQ ID NO: 642300 - DNA, 25 bp, Homo sapien
aagggagaacccatcggctctgcca

SEQ ID NO: 642301 - DNA, 25 bp, Homo sapien
catcggctctgccacggacatctgg

SEQ ID NO: 642302 - DNA, 25 bp, Homo sapien
agcgggtgtgctcacttacattatg

SEQ ID NO: 642303 - DNA, 25 bp, Homo sapien
gggtgtgctcacttacattatgctc

SEQ ID NO: 642304 - DNA, 25 bp, Homo sapien
agctgtaccccaatacatcccagag

SEQ ID NO: 642305 - DNA, 25 bp, Homo sapien
tcttcttgcgaaaggttctctctgt

SEQ ID NO: 642306 - DNA, 25 bp, Homo sapien
aaggttctctctgtacatccctgga

SEQ ID NO: 642307 - DNA, 25 bp, Homo sapien
tctgtacatccctggagccggccat

SEQ ID NO: 642308 - DNA, 25 bp, Homo sapien
atcaatggcttctcacacttggtgt

SEQ ID NO: 642309 - DNA, 25 bp, Homo sapien
ttctcacacttggtgtcagaggcct

SEQ ID NO: 642310 - DNA, 25 bp, Homo sapien
agaggccttcacacgagggtttgca

SEQ ID NO: 642311 - DNA, 25 bp, Homo sapien
ttgcactcccctacaaggacatgaa

SEQ ID NO: 642312 - DNA, 25 bp, Homo sapien
ggacatgaagactttctagaaggta

SEQ ID NO: 642313 - DNA, 25 bp, Homo sapien
aagtaatcattttccagagccgcct

SEQ ID NO: 642314 - DNA, 25 bp, Homo sapien
atatgttcccctccttatattggtg

SEQ ID NO: 642315 - DNA, 25 bp, Homo sapien
ccctccttatattggtgggcctaag

SEQ ID NO: 642316 - DNA, 25 bp, Homo sapien
aagccacaggcctgacagctgtcct

SEQ ID NO: 642317 - DNA, 25 bp, Homo sapien
attctgaatcctactctggctcctt

SEQ ID NO: 642318 - DNA, 25 bp, Homo sapien
ccttgctctgcgctgtaaaaaacaa

SEQ ID NO: 642319 - DNA, 25 bp, Homo sapien
actattgctcacttatttaatgaaa

SEQ ID NO: 642320 - DNA, 25 bp, Homo sapien
attgctcacttatttaatgaaacag

SEQ ID NO: 642321 - DNA, 25 bp, Homo sapien
ttgctcacttatttaatgaaacagc

SEQ ID NO: 642322 - DNA, 25 bp, Homo sapien
tgaaacagcataaagtccagaccct

SEQ ID NO: 642323 - DNA, 25 bp, Homo sapien
gaaacagcataaagtccagacccta

SEQ ID NO: 642324 - DNA, 25 bp, Homo sapien
aaacagcataaagtccagaccctat

SEQ ID NO: 642325 - DNA, 25 bp, Homo sapien
aacagcataaagtccagaccctatt

SEQ ID NO: 642326 - DNA, 25 bp, Homo sapien
acagcataaagtccagaccctattt

SEQ ID NO: 642327 - DNA, 25 bp, Homo sapien
cagcataaagtccagaccctatttt

SEQ ID NO: 642328 - DNA, 25 bp, Homo sapien
agcataaagtccagaccctatttta

SEQ ID NO: 642329 - DNA, 25 bp, Homo sapien
gcataaagtccagaccctattttaa

SEQ ID NO: 642330 - DNA, 25 bp, Homo sapien
gggtctactatgtatcctggcctgc

SEQ ID NO: 642331 - DNA, 25 bp, Homo sapien
tggcctgccatcacggttggaacga

SEQ ID NO: 642332 - DNA, 25 bp, Homo sapien
ttggaacgagaacttaaacagcttt

SEQ ID NO: 642333 - DNA, 25 bp, Homo sapien
acagctttacttagaacgagttttg

SEQ ID NO: 642334 - DNA, 25 bp, Homo sapien
tattcctgggtggtgcagttctagc

SEQ ID NO: 642335 - DNA, 25 bp, Homo sapien
ggtgcagttctagcggatatcatga

SEQ ID NO: 642336 - DNA, 25 bp, Homo sapien
aagacaacttttggatgacccgaca

SEQ ID NO: 642337 - DNA, 25 bp, Homo sapien
ggatgacccgacaagagtaccaaga

SEQ ID NO: 642338 - DNA, 25 bp, Homo sapien
aagggtgtccgtgtgctagagaaac

SEQ ID NO: 642339 - DNA, 25 bp, Homo sapien
ggtgtgactgttcgataaactccaa

SEQ ID NO: 642340 - DNA, 25 bp, Homo sapien
ataaactccaaagcttgttcccatc

SEQ ID NO: 642341 - DNA, 25 bp, Homo sapien
aagtcacactcactgtatcccatgg

SEQ ID NO: 642342 - DNA, 25 bp, Homo sapien
actgtggccactacgaagtctactc

SEQ ID NO: 642343 - DNA, 25 bp, Homo sapien
aagtctactctcagtctcagcgtct

SEQ ID NO: 642344 - DNA, 25 bp, Homo sapien
tgctctctgtaatctgtgctttttc

SEQ ID NO: 642345 - DNA, 25 bp, Homo sapien
gaccactcttcttctgctggaagta

SEQ ID NO: 642346 - DNA, 25 bp, Homo sapien
agtgagttccttgagtctcactctc

SEQ ID NO: 642347 - DNA, 25 bp, Homo sapien
actctcctgagtttcgtgttgtgat

SEQ ID NO: 642348 - DNA, 25 bp, Homo sapien
gttgtgataaattctgtttcccatc

SEQ ID NO: 642349 - DNA, 25 bp, Homo sapien
gaaatgccctttaccgtgagcagat

SEQ ID NO: 642350 - DNA, 25 bp, Homo sapien
gtgagcagattcttgaacaaccatc

SEQ ID NO: 642351 - DNA, 25 bp, Homo sapien
atggtgaagagtcccaagtcacact

SEQ ID NO: 642352 - DNA, 25 bp, Homo sapien
ggcaaaataaagaccttctcgaatg

SEQ ID NO: 642353 - DNA, 25 bp, Homo sapien
taaagaccttctcgaatgaaaggaa

SEQ ID NO: 642354 - DNA, 25 bp, Homo sapien
aagcgaagtcatgggcagcagtgct

SEQ ID NO: 642355 - DNA, 25 bp, Homo sapien
gaagtcatgggcagcagtgctactc

SEQ ID NO: 642356 - DNA, 25 bp, Homo sapien
gtcatgggcagcagtgctactcaac

SEQ ID NO: 642357 - DNA, 25 bp, Homo sapien
gtgctactcaacaggaaatactaaa

SEQ ID NO: 642358 - DNA, 25 bp, Homo sapien
ttcttccgctggaggagagcaactt

SEQ ID NO: 642359 - DNA, 25 bp, Homo sapien
tcttccgctggaggagagcaacttg

SEQ ID NO: 642360 - DNA, 25 bp, Homo sapien
ggaaaaccaacagaaatggccaata

SEQ ID NO: 642361 - DNA, 25 bp, Homo sapien
aaatggccaatatctgggtaaatat

SEQ ID NO: 642362 - DNA, 25 bp, Homo sapien
tggccaatatctgggtaaatataat

SEQ ID NO: 642363 - DNA, 25 bp, Homo sapien
gtttctgcgcctgatctcagcggac

SEQ ID NO: 642364 - DNA, 25 bp, Homo sapien
atctcagcggaccagtgcgggactt

SEQ ID NO: 642365 - DNA, 25 bp, Homo sapien
tgcaaccaccattacggcgtgatcc

SEQ ID NO: 642366 - DNA, 25 bp, Homo sapien
gacttctccctttatttctgcagag

SEQ ID NO: 642367 - DNA, 25 bp, Homo sapien
ctttatttctgcagagccgagggca

SEQ ID NO: 642368 - DNA, 25 bp, Homo sapien
ggcaggcggcgcaacaaatctcagc

SEQ ID NO: 642369 - DNA, 25 bp, Homo sapien
gcaacaaatctcagccatgctcttt

SEQ ID NO: 642370 - DNA, 25 bp, Homo sapien
attacggcgtgatccactccttttc

SEQ ID NO: 642371 - DNA, 25 bp, Homo sapien
gaatgctgaacggtaccactctaga

SEQ ID NO: 642372 - DNA, 25 bp, Homo sapien
ggtaccactctagaggcagtcctaa

SEQ ID NO: 642373 - DNA, 25 bp, Homo sapien
tagaggcagtcctaacccagcgcac

SEQ ID NO: 642374 - DNA, 25 bp, Homo sapien
gaaggcggggtctctcttactgtag

SEQ ID NO: 642375 - DNA, 25 bp, Homo sapien
ctttcttctctgtcctgactgagaa

SEQ ID NO: 642376 - DNA, 25 bp, Homo sapien
tgagaagcacaggtgccttgaccac

SEQ ID NO: 642377 - DNA, 25 bp, Homo sapien
aagcacaggtgccttgaccacctgt

SEQ ID NO: 642378 - DNA, 25 bp, Homo sapien
gccagctgcatgtttcccctgcagg

SEQ ID NO: 642379 - DNA, 25 bp, Homo sapien
tgcatgtttcccctgcaggctcgag

SEQ ID NO: 642380 - DNA, 25 bp, Homo sapien
tcgagcccaagctgaacattcccag

SEQ ID NO: 642381 - DNA, 25 bp, Homo sapien
aagctgaacattcccagacactgat

SEQ ID NO: 642382 - DNA, 25 bp, Homo sapien
cagacactgataaacttgcttagat

SEQ ID NO: 642383 - DNA, 25 bp, Homo sapien
tgttgctcaaaacactgagggattg

SEQ ID NO: 642384 - DNA, 25 bp, Homo sapien
ctcaaaacactgagggattggccta

SEQ ID NO: 642385 - DNA, 25 bp, Homo sapien
gagcaacttacgagaggacagcctt

SEQ ID NO: 642386 - DNA, 25 bp, Homo sapien
ggacagccttatgagggtttgcttg

SEQ ID NO: 642387 - DNA, 25 bp, Homo sapien
tgtgactgccagctctaaatctcga

SEQ ID NO: 642388 - DNA, 25 bp, Homo sapien
cagctctaaatctcgatcttgccat

SEQ ID NO: 642389 - DNA, 25 bp, Homo sapien
gatcttgccataactttacagggta

SEQ ID NO: 642390 - DNA, 25 bp, Homo sapien
ttacagggtaacttgggtccacagt

SEQ ID NO: 642391 - DNA, 25 bp, Homo sapien
taacttgggtccacagtcactcttt

SEQ ID NO: 642392 - DNA, 25 bp, Homo sapien
tccacagtcactctttgtgcctcag

SEQ ID NO: 642393 - DNA, 25 bp, Homo sapien
ctcagtttacccacccattaaatgg

SEQ ID NO: 642394 - DNA, 25 bp, Homo sapien
atgggaacattactgtcttcccctc

SEQ ID NO: 642395 - DNA, 25 bp, Homo sapien
gcaaatgtgtgaatcttagtcatgg

SEQ ID NO: 642396 - DNA, 25 bp, Homo sapien
cattatttgggatgttaactcatag

SEQ ID NO: 642397 - DNA, 25 bp, Homo sapien
gttaactcatagtatgtctctcata

SEQ ID NO: 642398 - DNA, 25 bp, Homo sapien
agccaaatattttagaggagagtcc

SEQ ID NO: 642399 - DNA, 25 bp, Homo sapien
tttcctgtggcttctacaatggtca

SEQ ID NO: 642400 - DNA, 25 bp, Homo sapien
ggcttctacaatggtcacactgtgt

SEQ ID NO: 642401 - DNA, 25 bp, Homo sapien
ggtcacactgtgtcatgatgtttgg

SEQ ID NO: 642402 - DNA, 25 bp, Homo sapien
gtgtcatgatgtttggtactcacaa

SEQ ID NO: 642403 - DNA, 25 bp, Homo sapien
gtactcacaaataagaccctaggga

SEQ ID NO: 642404 - DNA, 25 bp, Homo sapien
tagggaccccgaaaggtcatacaat

SEQ ID NO: 642405 - DNA, 25 bp, Homo sapien
aggtcatacaatgccttttgaatga

SEQ ID NO: 642406 - DNA, 25 bp, Homo sapien
catacaatgccttttgaatgaacaa

SEQ ID NO: 642407 - DNA, 25 bp, Homo sapien
gagcaaatactgatacttgtagctg

SEQ ID NO: 642408 - DNA, 25 bp, Homo sapien
gtggtcaaacttcacttttacgact

SEQ ID NO: 642409 - DNA, 25 bp, Homo sapien
ttgtgacagaaagtgcaggttgcca

SEQ ID NO: 642410 - DNA, 25 bp, Homo sapien
tgcaggttgccagaggatccttaac

SEQ ID NO: 642411 - DNA, 25 bp, Homo sapien
ggatccttaactgaatatatgcctc

SEQ ID NO: 642412 - DNA, 25 bp, Homo sapien
tgaatatatgcctccttttctaccc

SEQ ID NO: 642413 - DNA, 25 bp, Homo sapien
ccttttctaccccaggaagatagat

SEQ ID NO: 642414 - DNA, 25 bp, Homo sapien
gatagatggccagccttatttcacc

SEQ ID NO: 642415 - DNA, 25 bp, Homo sapien
ctaggactgctctctgaaaccatat

SEQ ID NO: 642416 - DNA, 25 bp, Homo sapien
gaaaccatatactccaggcatctga

SEQ ID NO: 642417 - DNA, 25 bp, Homo sapien
gaacagtccagcattaaccttaggg

SEQ ID NO: 642418 - DNA, 25 bp, Homo sapien
ggcctgaaaggccacttcactggtt

SEQ ID NO: 642419 - DNA, 25 bp, Homo sapien
ctgctcatttctggcttccggtgaa

SEQ ID NO: 642420 - DNA, 25 bp, Homo sapien
gcttccggtgaagtgagttttcttg

SEQ ID NO: 642421 - DNA, 25 bp, Homo sapien
gagttttcttgagctagtgttctag

SEQ ID NO: 642422 - DNA, 25 bp, Homo sapien
tgttctagactagaggccacatgct

SEQ ID NO: 642423 - DNA, 25 bp, Homo sapien
ttctctctggctgtatttagtgcct

SEQ ID NO: 642424 - DNA, 25 bp, Homo sapien
gctgtatttagtgcctttcgtccta

SEQ ID NO: 642425 - DNA, 25 bp, Homo sapien
agtgcctttcgtcctaaataatcaa

SEQ ID NO: 642426 - DNA, 25 bp, Homo sapien
tcttctttggacagtacgtttttat

SEQ ID NO: 642427 - DNA, 25 bp, Homo sapien
tacgtttttatctatttcccaagtg

SEQ ID NO: 642428 - DNA, 25 bp, Homo sapien
ttcccaagtgttattgactctacga

SEQ ID NO: 642429 - DNA, 25 bp, Homo sapien
acacatgaaaacttaaacttatctg

SEQ ID NO: 642430 - DNA, 25 bp, Homo sapien
aaacttatctgtattcaaatgtttc

SEQ ID NO: 642431 - DNA, 25 bp, Homo sapien
tattcaaatgtttcactatagtttt

SEQ ID NO: 642432 - DNA, 25 bp, Homo sapien
ttcaaatgtttcactatagttttat

SEQ ID NO: 642433 - DNA, 25 bp, Homo sapien
attttcatattcagaggaaggtcat

SEQ ID NO: 642434 - DNA, 25 bp, Homo sapien
tttcatattcagaggaaggtcatta

SEQ ID NO: 642435 - DNA, 25 bp, Homo sapien
catattcagaggaaggtcattaaaa

SEQ ID NO: 642436 - DNA, 25 bp, Homo sapien
gaaatacagaattacaattattgac

SEQ ID NO: 642437 - DNA, 25 bp, Homo sapien
tgacatattaagatgatcatgacat

SEQ ID NO: 642438 - DNA, 25 bp, Homo sapien
cacatcaatttttttgtataagcag

SEQ ID NO: 642439 - DNA, 25 bp, Homo sapien
tttttgtataagcagtacacatgca

SEQ ID NO: 642440 - DNA, 25 bp, Homo sapien
ctgtgttactgtaggcaaatcgctg

SEQ ID NO: 642441 - DNA, 25 bp, Homo sapien
gtaggcaaatcgctgaactcttcca

SEQ ID NO: 642442 - DNA, 25 bp, Homo sapien
tcgctgaactcttccaggccttagt

SEQ ID NO: 642443 - DNA, 25 bp, Homo sapien
gtttcttcacaggtacattggagat

SEQ ID NO: 642444 - DNA, 25 bp, Homo sapien
tggagataatacctacaaacctgat

SEQ ID NO: 642445 - DNA, 25 bp, Homo sapien
tacaaacctgatctattgtgcagat

SEQ ID NO: 642446 - DNA, 25 bp, Homo sapien
gctctaaaaatgttcatgtgtcatt

SEQ ID NO: 642447 - DNA, 25 bp, Homo sapien
gagtgactaagtgactccaagctta

SEQ ID NO: 642448 - DNA, 25 bp, Homo sapien
gtgactccaagcttattagctggaa

SEQ ID NO: 642449 - DNA, 25 bp, Homo sapien
taggagagccgattctctgggacat

SEQ ID NO: 642450 - DNA, 25 bp, Homo sapien
gagccgattctctgggacatgcctg

SEQ ID NO: 642451 - DNA, 25 bp, Homo sapien
ggacagttgtgctgtgtaaccttca

SEQ ID NO: 642452 - DNA, 25 bp, Homo sapien
gtgctgtgtaaccttcagatttccc

SEQ ID NO: 642453 - DNA, 25 bp, Homo sapien
taaccttcagatttcccacacatta

SEQ ID NO: 642454 - DNA, 25 bp, Homo sapien
cagatttcccacacattacagcaaa

SEQ ID NO: 642455 - DNA, 25 bp, Homo sapien
aatacacatagaaatcagtggttcc

SEQ ID NO: 642456 - DNA, 25 bp, Homo sapien
gtttagagacacatggtgccatctt

SEQ ID NO: 642457 - DNA, 25 bp, Homo sapien
acatggtgccatcttcatcttccgc

SEQ ID NO: 642458 - DNA, 25 bp, Homo sapien
acccagcagtgggttgcagagctcc

SEQ ID NO: 642459 - DNA, 25 bp, Homo sapien
ggttgcagagctccccatgccagaa

SEQ ID NO: 642460 - DNA, 25 bp, Homo sapien
atgccagaaccttcctcttttttct

SEQ ID NO: 642461 - DNA, 25 bp, Homo sapien
taaatgttctacttgtgtaatcatg

SEQ ID NO: 642462 - DNA, 25 bp, Homo sapien
aagcatgcatcctgtcttgggaact

SEQ ID NO: 642463 - DNA, 25 bp, Homo sapien
ccacctcactgtacagtacttttca

SEQ ID NO: 642464 - DNA, 25 bp, Homo sapien
ttggctgcagtgaatttagttccct

SEQ ID NO: 642465 - DNA, 25 bp, Homo sapien
ttagttccctacatgggacccagta

SEQ ID NO: 642466 - DNA, 25 bp, Homo sapien
gtaccccaccagactgagttcaagt

SEQ ID NO: 642467 - DNA, 25 bp, Homo sapien
gttcaagtgccatggcaggctcgga

SEQ ID NO: 642468 - DNA, 25 bp, Homo sapien
aggctcggagccatctgaaacaacg

SEQ ID NO: 642469 - DNA, 25 bp, Homo sapien
aacggaatatgttgccaccagcagc

SEQ ID NO: 642470 - DNA, 25 bp, Homo sapien
tctttttgtgccttccggaggaaag

SEQ ID NO: 642471 - DNA, 25 bp, Homo sapien
gtggtttgagttctttggctcttcc

SEQ ID NO: 642472 - DNA, 25 bp, Homo sapien
ttggctcttcctggaaccataaaca

SEQ ID NO: 642473 - DNA, 25 bp, Homo sapien
tctgcgggaacctggtatgggccat

SEQ ID NO: 642474 - DNA, 25 bp, Homo sapien
atgggccatgagaatgtactgtaca

SEQ ID NO: 642475 - DNA, 25 bp, Homo sapien
actgtacaaccacatcttcaaaatg

SEQ ID NO: 642476 - DNA, 25 bp, Homo sapien
aaatgtccagtagccaagttccacc

SEQ ID NO: 642477 - DNA, 25 bp, Homo sapien
aagttccaccacttttcacagattg

SEQ ID NO: 642478 - DNA, 25 bp, Homo sapien
ggcttccaagttgtacctattttgg

SEQ ID NO: 642479 - DNA, 25 bp, Homo sapien
gtacctattttggagttagacttga

SEQ ID NO: 642480 - DNA, 25 bp, Homo sapien
ggatttgctacttccatagtttact

SEQ ID NO: 642481 - DNA, 25 bp, Homo sapien
gtttacttgacatggttcagactga

SEQ ID NO: 642482 - DNA, 25 bp, Homo sapien
gttcagactgaccaatgcatttttt

SEQ ID NO: 642483 - DNA, 25 bp, Homo sapien
gtgacagtctgtagcagttgaagct

SEQ ID NO: 642484 - DNA, 25 bp, Homo sapien
gatacggcatgttatgaatccagtc

SEQ ID NO: 642485 - DNA, 25 bp, Homo sapien
tatgaatccagtcggtagaggtcag

SEQ ID NO: 642486 - DNA, 25 bp, Homo sapien
gtcagggaggctactgaacatccaa

SEQ ID NO: 642487 - DNA, 25 bp, Homo sapien
ctgaacatccaaaatgggccaggtg

SEQ ID NO: 642488 - DNA, 25 bp, Homo sapien
atttcaagaacagccggagccacac

SEQ ID NO: 642489 - DNA, 25 bp, Homo sapien
agaacagccggagccacacagcaag

SEQ ID NO: 642490 - DNA, 25 bp, Homo sapien
aaagcaaaggagtctctagcccaga

SEQ ID NO: 642491 - DNA, 25 bp, Homo sapien
tctagcccagaggttctcaactaca

SEQ ID NO: 642492 - DNA, 25 bp, Homo sapien
gaggttctcaactacaggcaaattt

SEQ ID NO: 642493 - DNA, 25 bp, Homo sapien
aggcaaatttgtccctcagggccat

SEQ ID NO: 642494 - DNA, 25 bp, Homo sapien
tcagggccatctggcaatatctgga

SEQ ID NO: 642495 - DNA, 25 bp, Homo sapien
accagggctctctgggtccacggcc

SEQ ID NO: 642496 - DNA, 25 bp, Homo sapien
ggccgcgcaccggagaggacgaggt

SEQ ID NO: 642497 - DNA, 25 bp, Homo sapien
caccggagaggacgaggtggaccac

SEQ ID NO: 642498 - DNA, 25 bp, Homo sapien
atcctgctggccctcatgacagtgg

SEQ ID NO: 642499 - DNA, 25 bp, Homo sapien
tcctgctggccctcatgacagtggt

SEQ ID NO: 642500 - DNA, 25 bp, Homo sapien
ctgctggccctcatgacagtggtca

SEQ ID NO: 642501 - DNA, 25 bp, Homo sapien
tgctggccctcatgacagtggtcat

SEQ ID NO: 642502 - DNA, 25 bp, Homo sapien
gctggccctcatgacagtggtcatg

SEQ ID NO: 642503 - DNA, 25 bp, Homo sapien
tgacagtggtcatggccgtgtgctc

SEQ ID NO: 642504 - DNA, 25 bp, Homo sapien
gacagtggtcatggccgtgtgctcc

SEQ ID NO: 642505 - DNA, 25 bp, Homo sapien
gtggtcatggccgtgtgctccctgc

SEQ ID NO: 642506 - DNA, 25 bp, Homo sapien
ttggaggctcaagctaagaaagctg

SEQ ID NO: 642507 - DNA, 25 bp, Homo sapien
ttaagccttcaagtagaagggttct

SEQ ID NO: 642508 - DNA, 25 bp, Homo sapien
agtagaagggttctatcaagtgctt

SEQ ID NO: 642509 - DNA, 25 bp, Homo sapien
aagtgctttctaggattattgtggg

SEQ ID NO: 642510 - DNA, 25 bp, Homo sapien
gtgctttctaggattattgtgggaa

SEQ ID NO: 642511 - DNA, 25 bp, Homo sapien
acatatcatggtgaggttggtaaac

SEQ ID NO: 642512 - DNA, 25 bp, Homo sapien
agccaatgggcttgtctaaaaccta

SEQ ID NO: 642513 - DNA, 25 bp, Homo sapien
aatgggcttgtctaaaacctagtca

SEQ ID NO: 642514 - DNA, 25 bp, Homo sapien
tgggcttgtctaaaacctagtcaaa

SEQ ID NO: 642515 - DNA, 25 bp, Homo sapien
gcttgtctaaaacctagtcaaaaag

SEQ ID NO: 642516 - DNA, 25 bp, Homo sapien
cctagtcaaaaaggtcaaagtgata

SEQ ID NO: 642517 - DNA, 25 bp, Homo sapien
gggaaggcttcatgataccagatca

SEQ ID NO: 642518 - DNA, 25 bp, Homo sapien
tcatgccatgagaaggctagatgtt

SEQ ID NO: 642519 - DNA, 25 bp, Homo sapien
gatgttagcacatctctgagggcgt

SEQ ID NO: 642520 - DNA, 25 bp, Homo sapien
atctctgagggcgttaatgtgtgaa

SEQ ID NO: 642521 - DNA, 25 bp, Homo sapien
gtgaaatacccaccagggcagtcct

SEQ ID NO: 642522 - DNA, 25 bp, Homo sapien
ggcagtcctcagtgagttgtcctca

SEQ ID NO: 642523 - DNA, 25 bp, Homo sapien
gtcctcagctgaaatggagcccaca

SEQ ID NO: 642524 - DNA, 25 bp, Homo sapien
gaaacaggattctaaattctccggg

SEQ ID NO: 642525 - DNA, 25 bp, Homo sapien
tgtccaatattgtagccgctcatca

SEQ ID NO: 642526 - DNA, 25 bp, Homo sapien
gctcatcacatacagctactgggca

SEQ ID NO: 642527 - DNA, 25 bp, Homo sapien
actgggcacttgaaatatggctcat

SEQ ID NO: 642528 - DNA, 25 bp, Homo sapien
accatcgtcttgctgattatatgtc

SEQ ID NO: 642529 - DNA, 25 bp, Homo sapien
gctgattatatgtcaagttctgtgt

SEQ ID NO: 642530 - DNA, 25 bp, Homo sapien
caagttctgtgtgaaatgagagacc

SEQ ID NO: 642531 - DNA, 25 bp, Homo sapien
gggattcattattgctggagttgac

SEQ ID NO: 642532 - DNA, 25 bp, Homo sapien
tggagttgacggtattgcagtttta

SEQ ID NO: 642533 - DNA, 25 bp, Homo sapien
ggtattgcagttttataaccatcta

SEQ ID NO: 642534 - DNA, 25 bp, Homo sapien
gagatttcatcttaaactcagagga

SEQ ID NO: 642535 - DNA, 25 bp, Homo sapien
gcaaggagaagcaatggaaaccatt

SEQ ID NO: 642536 - DNA, 25 bp, Homo sapien
ggatcttggatctttgcattcactt

SEQ ID NO: 642537 - DNA, 25 bp, Homo sapien
ggatctttgcattcacttgatttgt

SEQ ID NO: 642538 - DNA, 25 bp, Homo sapien
gcattcacttgatttgtcagaatat

SEQ ID NO: 642539 - DNA, 25 bp, Homo sapien
gaacaatacaggtttgaactctgtg

SEQ ID NO: 642540 - DNA, 25 bp, Homo sapien
atacaggtttgaactctgtgggtcc

SEQ ID NO: 642541 - DNA, 25 bp, Homo sapien
tacaggtttgaactctgtgggtcca

SEQ ID NO: 642542 - DNA, 25 bp, Homo sapien
ttgaactctgtgggtccacttacat

SEQ ID NO: 642543 - DNA, 25 bp, Homo sapien
gtgggtccacttacatgcggttttt

SEQ ID NO: 642544 - DNA, 25 bp, Homo sapien
gtaaaagttacacccgatgcgtcag

SEQ ID NO: 642545 - DNA, 25 bp, Homo sapien
aaaagttacacccgatgcgtcagcc

SEQ ID NO: 642546 - DNA, 25 bp, Homo sapien
tcctcagcctactcagggtaaagac

SEQ ID NO: 642547 - DNA, 25 bp, Homo sapien
ctcagcctactcagggtaaagacaa

SEQ ID NO: 642548 - DNA, 25 bp, Homo sapien
gcctactcagggtaaagacaaggat

SEQ ID NO: 642549 - DNA, 25 bp, Homo sapien
ctcctcatgattttcttaaaacttt

SEQ ID NO: 642550 - DNA, 25 bp, Homo sapien
tgtgctatactaaaattcctctgat

SEQ ID NO: 642551 - DNA, 25 bp, Homo sapien
tccagctttacatagtggcaacaaa

SEQ ID NO: 642552 - DNA, 25 bp, Homo sapien
gtaagcgtaatactcacttagaaag

SEQ ID NO: 642553 - DNA, 25 bp, Homo sapien
aaaatgctggttaattactaattca

SEQ ID NO: 642554 - DNA, 25 bp, Homo sapien
tactaattcattactgtatggcaga

SEQ ID NO: 642555 - DNA, 25 bp, Homo sapien
gtatggcagagacccacagcagacc

SEQ ID NO: 642556 - DNA, 25 bp, Homo sapien
acagcagacctctaatttctttgta

SEQ ID NO: 642557 - DNA, 25 bp, Homo sapien
atttctttgtatgtggttcctttct

SEQ ID NO: 642558 - DNA, 25 bp, Homo sapien
ggttcctttctgttttcgttgatct

SEQ ID NO: 642559 - DNA, 25 bp, Homo sapien
ttcgttgatctttagtaggtatctt

SEQ ID NO: 642560 - DNA, 25 bp, Homo sapien
ttaaacactgtgtatcactgccttc

SEQ ID NO: 642561 - DNA, 25 bp, Homo sapien
gggtccttatttctggcaggaatgt

SEQ ID NO: 642562 - DNA, 25 bp, Homo sapien
atttctggcaggaatgtcgactgta

SEQ ID NO: 642563 - DNA, 25 bp, Homo sapien
gaatgtcgactgtagcactgagaac

SEQ ID NO: 642564 - DNA, 25 bp, Homo sapien
gggatgctcttcaacaccgtcttac

SEQ ID NO: 642565 - DNA, 25 bp, Homo sapien
gtcttacccttcttggtgatcctta

SEQ ID NO: 642566 - DNA, 25 bp, Homo sapien
gagcaaggagacaccactgggacaa

SEQ ID NO: 642567 - DNA, 25 bp, Homo sapien
ctgacaccatctaatccagcagggt

SEQ ID NO: 642568 - DNA, 25 bp, Homo sapien
gaagggactgtcaagtttgtaaggc

SEQ ID NO: 642569 - DNA, 25 bp, Homo sapien
gtttgtaaggctgtagacaccacca

SEQ ID NO: 642570 - DNA, 25 bp, Homo sapien
gtaactgtgggaaactggccttgcc

SEQ ID NO: 642571 - DNA, 25 bp, Homo sapien
ggccttgccaggatataaacagttt

SEQ ID NO: 642572 - DNA, 25 bp, Homo sapien
atagtaccatttcttcctcccagtt

SEQ ID NO: 642573 - DNA, 25 bp, Homo sapien
atttcttcctcccagttgcgttctc

SEQ ID NO: 642574 - DNA, 25 bp, Homo sapien
agttgcgttctcctccatctcagtc

SEQ ID NO: 642575 - DNA, 25 bp, Homo sapien
gtctccccgctttgcaatgccagat

SEQ ID NO: 642576 - DNA, 25 bp, Homo sapien
aatgccagattctctacaatttctc

SEQ ID NO: 642577 - DNA, 25 bp, Homo sapien
agattctctacaatttctcaccttg

SEQ ID NO: 642578 - DNA, 25 bp, Homo sapien
tacaatttctcaccttgtacccaga

SEQ ID NO: 642579 - DNA, 25 bp, Homo sapien
tcaccttgtacccagactgcaatat

SEQ ID NO: 642580 - DNA, 25 bp, Homo sapien
gtacccagactgcaatatgtgatcc

SEQ ID NO: 642581 - DNA, 25 bp, Homo sapien
gactgcaatatgtgatcctaatcct

SEQ ID NO: 642582 - DNA, 25 bp, Homo sapien
tatgtgatcctaatcctaatttttt

SEQ ID NO: 642583 - DNA, 25 bp, Homo sapien
caggcgcagtggcacttagggaggc

SEQ ID NO: 642584 - DNA, 25 bp, Homo sapien
aggcgcagtggcacttagggaggcc

SEQ ID NO: 642585 - DNA, 25 bp, Homo sapien
ggcgcagtggcacttagggaggcca

SEQ ID NO: 642586 - DNA, 25 bp, Homo sapien
aaaatacaaagtttgccagtgtggt

SEQ ID NO: 642587 - DNA, 25 bp, Homo sapien
aaatacaaagtttgccagtgtggtg

SEQ ID NO: 642588 - DNA, 25 bp, Homo sapien
atacaaagtttgccagtgtggtggc

SEQ ID NO: 642589 - DNA, 25 bp, Homo sapien
tacaaagtttgccagtgtggtggca

SEQ ID NO: 642590 - DNA, 25 bp, Homo sapien
acaaagtttgccagtgtggtggcac

SEQ ID NO: 642591 - DNA, 25 bp, Homo sapien
caaagtttgccagtgtggtggcaca

SEQ ID NO: 642592 - DNA, 25 bp, Homo sapien
aaagtttgccagtgtggtggcacat

SEQ ID NO: 642593 - DNA, 25 bp, Homo sapien
aagtttgccagtgtggtggcacatg

SEQ ID NO: 642594 - DNA, 25 bp, Homo sapien
tggtacaggaaaacctccacagtga

SEQ ID NO: 642595 - DNA, 25 bp, Homo sapien
aaacctccacagtgaggtggtcgaa

SEQ ID NO: 642596 - DNA, 25 bp, Homo sapien
gtggtcgaagtctgcacctcaagta

SEQ ID NO: 642597 - DNA, 25 bp, Homo sapien
gtcgaagtctgcacctcaagtactt

SEQ ID NO: 642598 - DNA, 25 bp, Homo sapien
aatagtctaacagacagcacctgcg

SEQ ID NO: 642599 - DNA, 25 bp, Homo sapien
ttttagcattggaaaagcaccactg

SEQ ID NO: 642600 - DNA, 25 bp, Homo sapien
gaaaagcaccactgaaagatgaaca

SEQ ID NO: 642601 - DNA, 25 bp, Homo sapien
acaggaaatgagagcatctcccaaa

SEQ ID NO: 642602 - DNA, 25 bp, Homo sapien
gagcatctcccaaaataagtcgaaa

SEQ ID NO: 642603 - DNA, 25 bp, Homo sapien
aagtcgaaaatgtgctaatagacac

SEQ ID NO: 642604 - DNA, 25 bp, Homo sapien
atcgagttttcttttcaaaggagat

SEQ ID NO: 642605 - DNA, 25 bp, Homo sapien
attacttacctcaaagcatgctgca

SEQ ID NO: 642606 - DNA, 25 bp, Homo sapien
agttagttacttgtcatgctttgaa

SEQ ID NO: 642607 - DNA, 25 bp, Homo sapien
tgtcatgctttgaaatctctggatg

SEQ ID NO: 642608 - DNA, 25 bp, Homo sapien
aatctctggatgaaaggtgctttgg

SEQ ID NO: 642609 - DNA, 25 bp, Homo sapien
tggaagcacaaaccattatcacttg

SEQ ID NO: 642610 - DNA, 25 bp, Homo sapien
acaaaccattatcacttgtctcata

SEQ ID NO: 642611 - DNA, 25 bp, Homo sapien
catagggattgtccccttgaacatc

SEQ ID NO: 642612 - DNA, 25 bp, Homo sapien
ttgtccccttgaacatccagcagtg

SEQ ID NO: 642613 - DNA, 25 bp, Homo sapien
catccagcagtgttattttacagaa

SEQ ID NO: 642614 - DNA, 25 bp, Homo sapien
gacaaattaactgaaggcttttctt

SEQ ID NO: 642615 - DNA, 25 bp, Homo sapien
tctaaagagctctacataaacaggt

SEQ ID NO: 642616 - DNA, 25 bp, Homo sapien
gagacttaccagcttttgaaaccaa

SEQ ID NO: 642617 - DNA, 25 bp, Homo sapien
aaatggctgtaggtatcccatctcc

SEQ ID NO: 642618 - DNA, 25 bp, Homo sapien
gtatcccatctccattggctgaata

SEQ ID NO: 642619 - DNA, 25 bp, Homo sapien
cattggctgaatacttcgaggcttc

SEQ ID NO: 642620 - DNA, 25 bp, Homo sapien
aatacttcgaggcttcagcctgctg

SEQ ID NO: 642621 - DNA, 25 bp, Homo sapien
aacatttcattcattctacagtttg

SEQ ID NO: 642622 - DNA, 25 bp, Homo sapien
ctacagtttgattcacttggttctt

SEQ ID NO: 642623 - DNA, 25 bp, Homo sapien
attcacttggttcttctttggcttc

SEQ ID NO: 642624 - DNA, 25 bp, Homo sapien
tttggcttctcactgcgatctatct

SEQ ID NO: 642625 - DNA, 25 bp, Homo sapien
ttctcactgcgatctatcttcagaa

SEQ ID NO: 642626 - DNA, 25 bp, Homo sapien
tgccgcatgaatatggaagtctttg

SEQ ID NO: 642627 - DNA, 25 bp, Homo sapien
tcctattggtaataatacactactg

SEQ ID NO: 642628 - DNA, 25 bp, Homo sapien
gaaatattcagtttgatccacttgt

SEQ ID NO: 642629 - DNA, 25 bp, Homo sapien
cagtttgatccacttgtttatcaga

SEQ ID NO: 642630 - DNA, 25 bp, Homo sapien
gtttatcagaaaccttcacttactg

SEQ ID NO: 642631 - DNA, 25 bp, Homo sapien
gtactgtgctttacctgcttacaaa

SEQ ID NO: 642632 - DNA, 25 bp, Homo sapien
gtgctttacctgcttacaaatcaat

SEQ ID NO: 642633 - DNA, 25 bp, Homo sapien
tacctgcttacaaatcaatgatact

SEQ ID NO: 642634 - DNA, 25 bp, Homo sapien
aatgatactgtacgtgccttgctca

SEQ ID NO: 642635 - DNA, 25 bp, Homo sapien
tgtacgtgccttgctcagaagtatt

SEQ ID NO: 642636 - DNA, 25 bp, Homo sapien
gtgccttgctcagaagtattgaatt

SEQ ID NO: 642637 - DNA, 25 bp, Homo sapien
aagcctgttgtttcaggaccttatt

SEQ ID NO: 642638 - DNA, 25 bp, Homo sapien
tgttctggctctggccataagaaga

SEQ ID NO: 642639 - DNA, 25 bp, Homo sapien
ggccataagaagaatagctgctctg

SEQ ID NO: 642640 - DNA, 25 bp, Homo sapien
agctgctctggccatagcctgaagt

SEQ ID NO: 642641 - DNA, 25 bp, Homo sapien
catagcctgaagtgtccgtggactg

SEQ ID NO: 642642 - DNA, 25 bp, Homo sapien
agtgtccgtggactggctataacca

SEQ ID NO: 642643 - DNA, 25 bp, Homo sapien
tggactggctataaccactgtaact

SEQ ID NO: 642644 - DNA, 25 bp, Homo sapien
aaccactgtaactctgctgtccgta

SEQ ID NO: 642645 - DNA, 25 bp, Homo sapien
gtaactctgctgtccgtagggctga

SEQ ID NO: 642646 - DNA, 25 bp, Homo sapien
tctgctgtccgtagggctgactgct

SEQ ID NO: 642647 - DNA, 25 bp, Homo sapien
ggaaaaccagcgtgatcagaaaaca

SEQ ID NO: 642648 - DNA, 25 bp, Homo sapien
atcagaaaacatggcgtgaccaccc

SEQ ID NO: 642649 - DNA, 25 bp, Homo sapien
atctatataaaagaagttagtggcc

SEQ ID NO: 642650 - DNA, 25 bp, Homo sapien
tctatataaaagaagttagtggcca

SEQ ID NO: 642651 - DNA, 25 bp, Homo sapien
ctatataaaagaagttagtggccag

SEQ ID NO: 642652 - DNA, 25 bp, Homo sapien
tatataaaagaagttagtggccagg

SEQ ID NO: 642653 - DNA, 25 bp, Homo sapien
atataaaagaagttagtggccaggc

SEQ ID NO: 642654 - DNA, 25 bp, Homo sapien
tataaaagaagttagtggccaggct

SEQ ID NO: 642655 - DNA, 25 bp, Homo sapien
ataaaagaagttagtggccaggctc

SEQ ID NO: 642656 - DNA, 25 bp, Homo sapien
taaaagaagttagtggccaggctca

SEQ ID NO: 642657 - DNA, 25 bp, Homo sapien
tattgactgttcatcattatgggaa

SEQ ID NO: 642658 - DNA, 25 bp, Homo sapien
gttcatcattatgggaatgcctgat

SEQ ID NO: 642659 - DNA, 25 bp, Homo sapien
atgcctgatgttaagatatgtattt

SEQ ID NO: 642660 - DNA, 25 bp, Homo sapien
ataccagagaagtgattttgtgtct

SEQ ID NO: 642661 - DNA, 25 bp, Homo sapien
ttttgtgtctgtctcagagtacatc

SEQ ID NO: 642662 - DNA, 25 bp, Homo sapien
gtctcagagtacatcatatcaacca

SEQ ID NO: 642663 - DNA, 25 bp, Homo sapien
gagtacatcatatcaaccaattatt

SEQ ID NO: 642664 - DNA, 25 bp, Homo sapien
ttaatcttgcaagaaaacatccctc

SEQ ID NO: 642665 - DNA, 25 bp, Homo sapien
tttctttggttacatgtataaacaa

SEQ ID NO: 642666 - DNA, 25 bp, Homo sapien
acattcttcccttgcaatgtgaata

SEQ ID NO: 642667 - DNA, 25 bp, Homo sapien
tcttcccttgcaatgtgaatatatt

SEQ ID NO: 642668 - DNA, 25 bp, Homo sapien
tttccacccactgcagctgtgatgg

SEQ ID NO: 642669 - DNA, 25 bp, Homo sapien
acccactgcagctgtgatggagtct

SEQ ID NO: 642670 - DNA, 25 bp, Homo sapien
ccactgcagctgtgatggagtcttg

SEQ ID NO: 642671 - DNA, 25 bp, Homo sapien
tcaccaaaaattctgcctcctgggt

SEQ ID NO: 642672 - DNA, 25 bp, Homo sapien
ctgggttcaagtgcctccacaccca

SEQ ID NO: 642673 - DNA, 25 bp, Homo sapien
atgcccggcctacctggagcattat

SEQ ID NO: 642674 - DNA, 25 bp, Homo sapien
tgcccggcctacctggagcattatt

SEQ ID NO: 642675 - DNA, 25 bp, Homo sapien
gcccggcctacctggagcattatta

SEQ ID NO: 642676 - DNA, 25 bp, Homo sapien
cccggcctacctggagcattattaa

SEQ ID NO: 642677 - DNA, 25 bp, Homo sapien
ccggcctacctggagcattattaaa

SEQ ID NO: 642678 - DNA, 25 bp, Homo sapien
cggcctacctggagcattattaaaa

SEQ ID NO: 642679 - DNA, 25 bp, Homo sapien
gttcttgcccaagagtgtgtctgac

SEQ ID NO: 642680 - DNA, 25 bp, Homo sapien
tcttgcccaagagtgtgtctgacta

SEQ ID NO: 642681 - DNA, 25 bp, Homo sapien
gtgtgtctgactatgacggcaaact

SEQ ID NO: 642682 - DNA, 25 bp, Homo sapien
gactatgacggcaaactgagcaact

SEQ ID NO: 642683 - DNA, 25 bp, Homo sapien
gacggcaaactgagcaacttcaaaa

SEQ ID NO: 642684 - DNA, 25 bp, Homo sapien
gagcaacttcaaaacagcagccgag

SEQ ID NO: 642685 - DNA, 25 bp, Homo sapien
ttcaaaacagcagccgagagcttca

SEQ ID NO: 642686 - DNA, 25 bp, Homo sapien
acagcagccgagagcttcaagggca

SEQ ID NO: 642687 - DNA, 25 bp, Homo sapien
agcttcaagggcaagatcctgttca

SEQ ID NO: 642688 - DNA, 25 bp, Homo sapien
caagggcaagatcctgttcatcttc

SEQ ID NO: 642689 - DNA, 25 bp, Homo sapien
tcctgttcatcttcatcgacagcga

SEQ ID NO: 642690 - DNA, 25 bp, Homo sapien
acatctgcagtcagctgactggagt

SEQ ID NO: 642691 - DNA, 25 bp, Homo sapien
gtgaaaggccattactctcaatcat

SEQ ID NO: 642692 - DNA, 25 bp, Homo sapien
ccattactctcaatcatgtggcggg

SEQ ID NO: 642693 - DNA, 25 bp, Homo sapien
cttgtgcaaccagtgaaatgccttg

SEQ ID NO: 642694 - DNA, 25 bp, Homo sapien
gggtttccctgaggacagagagatt

SEQ ID NO: 642695 - DNA, 25 bp, Homo sapien
cagagagattttacctgtggactat

SEQ ID NO: 642696 - DNA, 25 bp, Homo sapien
tgtggactatagcatcgcctactgc

SEQ ID NO: 642697 - DNA, 25 bp, Homo sapien
atagcatcgcctactgcccgagagg

SEQ ID NO: 642698 - DNA, 25 bp, Homo sapien
ctatggatttccaccttgctcagcc

SEQ ID NO: 642699 - DNA, 25 bp, Homo sapien
caccttgtctgagccaatttttcac

SEQ ID NO: 642700 - DNA, 25 bp, Homo sapien
gtctgagccaatttttcacaataaa

SEQ ID NO: 642701 - DNA, 25 bp, Homo sapien
aaagcttaaggccaagattattagt

SEQ ID NO: 642702 - DNA, 25 bp, Homo sapien
agattattagtaaagggctccctgt

SEQ ID NO: 642703 - DNA, 25 bp, Homo sapien
aagggctccctgtgagattttatag

SEQ ID NO: 642704 - DNA, 25 bp, Homo sapien
gattttatagtgatctccacgagtt

SEQ ID NO: 642705 - DNA, 25 bp, Homo sapien
tccacgagttgggtgagctggtttt

SEQ ID NO: 642706 - DNA, 25 bp, Homo sapien
agctggtttttaaggactggtcagt

SEQ ID NO: 642707 - DNA, 25 bp, Homo sapien
aggactggtcagttgtgatagaaaa

SEQ ID NO: 642708 - DNA, 25 bp, Homo sapien
gaaaaacttcatccagccactttaa

SEQ ID NO: 642709 - DNA, 25 bp, Homo sapien
catccagccactttaatgattgaaa

SEQ ID NO: 642710 - DNA, 25 bp, Homo sapien
atgtttttataggtcttccttgtga

SEQ ID NO: 642711 - DNA, 25 bp, Homo sapien
gagaggctgccctcaagttcttcaa

SEQ ID NO: 642712 - DNA, 25 bp, Homo sapien
gtagagccgtaattaaaatgccttt

SEQ ID NO: 642713 - DNA, 25 bp, Homo sapien
atgccttttatagtataatctggac

SEQ ID NO: 642714 - DNA, 25 bp, Homo sapien
atctggacttgatttgaacaactga

SEQ ID NO: 642715 - DNA, 25 bp, Homo sapien
taatcttaggtttagtcttgacata

SEQ ID NO: 642716 - DNA, 25 bp, Homo sapien
attttgtattcttgcttgttccctt

SEQ ID NO: 642717 - DNA, 25 bp, Homo sapien
tattcttgcttgttcccttttattt

SEQ ID NO: 642718 - DNA, 25 bp, Homo sapien
aaatagtcatcacttctacagaagg

SEQ ID NO: 642719 - DNA, 25 bp, Homo sapien
gaaggtgttcttttgttcttaatga

SEQ ID NO: 642720 - DNA, 25 bp, Homo sapien
aaatgcagcactgtaatttctatac

SEQ ID NO: 642721 - DNA, 25 bp, Homo sapien
tactaagtatttaatccctgtcatg

SEQ ID NO: 642722 - DNA, 25 bp, Homo sapien
agtatttaatccctgtcatgatgtt

SEQ ID NO: 642723 - DNA, 25 bp, Homo sapien
tccaaatcaaggcacaaaatctatg

SEQ ID NO: 642724 - DNA, 25 bp, Homo sapien
caaggcacaaaatctatgatgatca

SEQ ID NO: 642725 - DNA, 25 bp, Homo sapien
acttttaactaatggcaggatgagt

SEQ ID NO: 642726 - DNA, 25 bp, Homo sapien
ctaatggcaggatgagtagctgtgt

SEQ ID NO: 642727 - DNA, 25 bp, Homo sapien
gtagctgtgtggtgacaagccgtat

SEQ ID NO: 642728 - DNA, 25 bp, Homo sapien
gtgtggtgacaagccgtatgtatca

SEQ ID NO: 642729 - DNA, 25 bp, Homo sapien
gacaagccgtatgtatcagggccca

SEQ ID NO: 642730 - DNA, 25 bp, Homo sapien
aagccgtatgtatcagggcccaggg

SEQ ID NO: 642731 - DNA, 25 bp, Homo sapien
ccgtatgtatcagggcccagggcaa

SEQ ID NO: 642732 - DNA, 25 bp, Homo sapien
attttcttcaccagggactgcctgt

SEQ ID NO: 642733 - DNA, 25 bp, Homo sapien
tcaccagggactgcctgtattcatt

SEQ ID NO: 642734 - DNA, 25 bp, Homo sapien
attttttacactcatctacctcttc

SEQ ID NO: 642735 - DNA, 25 bp, Homo sapien
tggctcaagaactgcctttatcaac

SEQ ID NO: 642736 - DNA, 25 bp, Homo sapien
aagaactgcctttatcaactcccac

SEQ ID NO: 642737 - DNA, 25 bp, Homo sapien
tttatcaactcccacactgaccaaa

SEQ ID NO: 642738 - DNA, 25 bp, Homo sapien
tcccacactgaccaaacagaaactg

SEQ ID NO: 642739 - DNA, 25 bp, Homo sapien
ggaattttggctccttctttatatg

SEQ ID NO: 642740 - DNA, 25 bp, Homo sapien
ggctccttctttatatgcgttttta

SEQ ID NO: 642741 - DNA, 25 bp, Homo sapien
tttcccattcatctagctccattgt

SEQ ID NO: 642742 - DNA, 25 bp, Homo sapien
gctccattgtcccttgttctgggaa

SEQ ID NO: 642743 - DNA, 25 bp, Homo sapien
aaactgctctactgtatcaaagagt

SEQ ID NO: 642744 - DNA, 25 bp, Homo sapien
taagttctgagtattaactttcact

SEQ ID NO: 642745 - DNA, 25 bp, Homo sapien
tgtcgtgtcatttcatgactcagga

SEQ ID NO: 642746 - DNA, 25 bp, Homo sapien
atttcatgactcaggagctgcgggt

SEQ ID NO: 642747 - DNA, 25 bp, Homo sapien
aaatgttgccactttgagatccgta

SEQ ID NO: 642748 - DNA, 25 bp, Homo sapien
gttgccactttgagatccgtagatg

SEQ ID NO: 642749 - DNA, 25 bp, Homo sapien
ttgagatccgtagatggtcatccct

SEQ ID NO: 642750 - DNA, 25 bp, Homo sapien
agatccgtagatggtcatccctggc

SEQ ID NO: 642751 - DNA, 25 bp, Homo sapien
atccgtagatggtcatccctggctc

SEQ ID NO: 642752 - DNA, 25 bp, Homo sapien
tctgttacctctttcatcattagcc

SEQ ID NO: 642753 - DNA, 25 bp, Homo sapien
gttacctctttcatcattagccaaa

SEQ ID NO: 642754 - DNA, 25 bp, Homo sapien
atcattagccaaagctccgggactt

SEQ ID NO: 642755 - DNA, 25 bp, Homo sapien
ttagccaaagctccgggacttggtt

SEQ ID NO: 642756 - DNA, 25 bp, Homo sapien
tgtaaagatgctaccctatcctgtc

SEQ ID NO: 642757 - DNA, 25 bp, Homo sapien
tgtccccaagttacacatacacaca

SEQ ID NO: 642758 - DNA, 25 bp, Homo sapien
ctcaaagtctccctcatgtttatat

SEQ ID NO: 642759 - DNA, 25 bp, Homo sapien
aagtctccctcatgtttatatgcca

SEQ ID NO: 642760 - DNA, 25 bp, Homo sapien
gtttatatgccaatattgcacttat

SEQ ID NO: 642761 - DNA, 25 bp, Homo sapien
acttattcgaaactgtgctatccac

SEQ ID NO: 642762 - DNA, 25 bp, Homo sapien
gaaactgtgctatccactgcgacac

SEQ ID NO: 642763 - DNA, 25 bp, Homo sapien
gctgtgctccccttgcagcaatgag

SEQ ID NO: 642764 - DNA, 25 bp, Homo sapien
gcagcaatgagcactttctctttct

SEQ ID NO: 642765 - DNA, 25 bp, Homo sapien
agcactttctctttcttacgacaaa

SEQ ID NO: 642766 - DNA, 25 bp, Homo sapien
tctttcttacgacaaacccttcagg

SEQ ID NO: 642767 - DNA, 25 bp, Homo sapien
taagaccatggcaggcttttgaggc

SEQ ID NO: 642768 - DNA, 25 bp, Homo sapien
ttgaggcctttatatttctcctgac

SEQ ID NO: 642769 - DNA, 25 bp, Homo sapien
cctttatatttctcctgactgtgca

SEQ ID NO: 642770 - DNA, 25 bp, Homo sapien
atttctcctgactgtgcaatatatt

SEQ ID NO: 642771 - DNA, 25 bp, Homo sapien
gtgcaatatattttggctctctgtc

SEQ ID NO: 642772 - DNA, 25 bp, Homo sapien
ttggctctctgtctaagacttggct

SEQ ID NO: 642773 - DNA, 25 bp, Homo sapien
aagacttggctgtcacagtagcaat

SEQ ID NO: 642774 - DNA, 25 bp, Homo sapien
ctgtcacagtagcaatggtaatatt

SEQ ID NO: 642775 - DNA, 25 bp, Homo sapien
tggtaatattagctactgtgccaga

SEQ ID NO: 642776 - DNA, 25 bp, Homo sapien
tactgtgccagaagcagcctatcaa

SEQ ID NO: 642777 - DNA, 25 bp, Homo sapien
gaagcagcctatcaatagagttgaa

SEQ ID NO: 642778 - DNA, 25 bp, Homo sapien
acattttggaccagggagccctaca

SEQ ID NO: 642779 - DNA, 25 bp, Homo sapien
cattttggaccagggagccctacag

SEQ ID NO: 642780 - DNA, 25 bp, Homo sapien
ttttggaccagggagccctacagcg

SEQ ID NO: 642781 - DNA, 25 bp, Homo sapien
tttggaccagggagccctacagcgt

SEQ ID NO: 642782 - DNA, 25 bp, Homo sapien
ttggaccagggagccctacagcgtc

SEQ ID NO: 642783 - DNA, 25 bp, Homo sapien
gaccagggagccctacagcgtctct

SEQ ID NO: 642784 - DNA, 25 bp, Homo sapien
accagggagccctacagcgtctctt

SEQ ID NO: 642785 - DNA, 25 bp, Homo sapien
cagggagccctacagcgtctcttca

SEQ ID NO: 642786 - DNA, 25 bp, Homo sapien
agggagccctacagcgtctcttcaa

SEQ ID NO: 642787 - DNA, 25 bp, Homo sapien
gggagccctacagcgtctcttcaaa

SEQ ID NO: 642788 - DNA, 25 bp, Homo sapien
gagccctacagcgtctcttcaaaaa

SEQ ID NO: 642789 - DNA, 25 bp, Homo sapien
agaagtgaaaatggcgcgtgcctgc

SEQ ID NO: 642790 - DNA, 25 bp, Homo sapien
aagtgaaaatggcgcgtgcctgcct

SEQ ID NO: 642791 - DNA, 25 bp, Homo sapien
gtgaaaatggcgcgtgcctgcctta

SEQ ID NO: 642792 - DNA, 25 bp, Homo sapien
tgaaaatggcgcgtgcctgccttaa

SEQ ID NO: 642793 - DNA, 25 bp, Homo sapien
gaaaatggcgcgtgcctgccttaac

SEQ ID NO: 642794 - DNA, 25 bp, Homo sapien
aaatggcgcgtgcctgccttaactg

SEQ ID NO: 642795 - DNA, 25 bp, Homo sapien
aatggcgcgtgcctgccttaactga

SEQ ID NO: 642796 - DNA, 25 bp, Homo sapien
atggcgcgtgcctgccttaactgat

SEQ ID NO: 642797 - DNA, 25 bp, Homo sapien
tgcctaacagagaacaatccccttt

SEQ ID NO: 642798 - DNA, 25 bp, Homo sapien
gcctaacagagaacaatcccctttg

SEQ ID NO: 642799 - DNA, 25 bp, Homo sapien
cagagcagagcctaaaagattcctt

SEQ ID NO: 642800 - DNA, 25 bp, Homo sapien
gagcagagcctaaaagattccttcc

SEQ ID NO: 642801 - DNA, 25 bp, Homo sapien
agcagagcctaaaagattccttcca

SEQ ID NO: 642802 - DNA, 25 bp, Homo sapien
cagagcctaaaagattccttccaaa

SEQ ID NO: 642803 - DNA, 25 bp, Homo sapien
gatagtgacaagatatgaaaaacgt

SEQ ID NO: 642804 - DNA, 25 bp, Homo sapien
gaaaaacgtgaatatggcaatttag

SEQ ID NO: 642805 - DNA, 25 bp, Homo sapien
aaacgtgaatatggcaatttagagt

SEQ ID NO: 642806 - DNA, 25 bp, Homo sapien
cgtgaatatggcaatttagagttaa

SEQ ID NO: 642807 - DNA, 25 bp, Homo sapien
gaaagtgtggatgagggtaaagtac

SEQ ID NO: 642808 - DNA, 25 bp, Homo sapien
atgtgatacatatgtgaaagtctct

SEQ ID NO: 642809 - DNA, 25 bp, Homo sapien
gtgaaagtctctcatatattttcaa

SEQ ID NO: 642810 - DNA, 25 bp, Homo sapien
tgaacagctagcaccttaaagacag

SEQ ID NO: 642811 - DNA, 25 bp, Homo sapien
aaacgttgagagcatttccactccc

SEQ ID NO: 642812 - DNA, 25 bp, Homo sapien
atttccactcccagacaacgagggc

SEQ ID NO: 642813 - DNA, 25 bp, Homo sapien
tgatgtaaacctttctgtgggccaa

SEQ ID NO: 642814 - DNA, 25 bp, Homo sapien
caagttctaggctgggagtgtccaa

SEQ ID NO: 642815 - DNA, 25 bp, Homo sapien
gggagtgtccaagtcatcaccttca

SEQ ID NO: 642816 - DNA, 25 bp, Homo sapien
tcaccttcaccgtaaagctgcatag

SEQ ID NO: 642817 - DNA, 25 bp, Homo sapien
gctgcatagaccaaggacctgctag

SEQ ID NO: 642818 - DNA, 25 bp, Homo sapien
gacctgctaggaagcgctgcatgtt

SEQ ID NO: 642819 - DNA, 25 bp, Homo sapien
atgttctcactcaatccttgcaata

SEQ ID NO: 642820 - DNA, 25 bp, Homo sapien
ttacttatttgtgggtttgtctgga

SEQ ID NO: 642821 - DNA, 25 bp, Homo sapien
tgcacactatctggtttttcttatt

SEQ ID NO: 642822 - DNA, 25 bp, Homo sapien
cactatctggtttttcttattcctg

SEQ ID NO: 642823 - DNA, 25 bp, Homo sapien
tattcctgttatagaaagtcacgtg

SEQ ID NO: 642824 - DNA, 25 bp, Homo sapien
aagtcacgtgatgaaaacagcattt

SEQ ID NO: 642825 - DNA, 25 bp, Homo sapien
aaaagcttctgataacatactcaat

SEQ ID NO: 642826 - DNA, 25 bp, Homo sapien
actcaatacgtttgtttccattttg

SEQ ID NO: 642827 - DNA, 25 bp, Homo sapien
ctgtttcacagatgatatgtcataa

SEQ ID NO: 642828 - DNA, 25 bp, Homo sapien
atttcattaccagcatattgtatag

SEQ ID NO: 642829 - DNA, 25 bp, Homo sapien
catattgtatagtggtttagttgct

SEQ ID NO: 642830 - DNA, 25 bp, Homo sapien
tagttgctatgaaggctctgtttcc

SEQ ID NO: 642831 - DNA, 25 bp, Homo sapien
tgctatgaaggctctgtttccttta

SEQ ID NO: 642832 - DNA, 25 bp, Homo sapien
aaacatggtaggactcacactggat

SEQ ID NO: 642833 - DNA, 25 bp, Homo sapien
aacatggtaggactcacactggata

SEQ ID NO: 642834 - DNA, 25 bp, Homo sapien
actggatagaaaccaaagcaggtga

SEQ ID NO: 642835 - DNA, 25 bp, Homo sapien
agaaaccaaagcaggtgaatcacct

SEQ ID NO: 642836 - DNA, 25 bp, Homo sapien
ttcaagactggcctgatcaatatga

SEQ ID NO: 642837 - DNA, 25 bp, Homo sapien
caagactggcctgatcaatatgatg

SEQ ID NO: 642838 - DNA, 25 bp, Homo sapien
aagactggcctgatcaatatgatga

SEQ ID NO: 642839 - DNA, 25 bp, Homo sapien
agactggcctgatcaatatgatgaa

SEQ ID NO: 642840 - DNA, 25 bp, Homo sapien
gactggcctgatcaatatgatgaaa

SEQ ID NO: 642841 - DNA, 25 bp, Homo sapien
ctggcctgatcaatatgatgaaacc

SEQ ID NO: 642842 - DNA, 25 bp, Homo sapien
gtggcctgcttctgtaatcctagct

SEQ ID NO: 642843 - DNA, 25 bp, Homo sapien
tcagtgacattaagagtttcagttt

SEQ ID NO: 642844 - DNA, 25 bp, Homo sapien
gagtttcagtttaaagttgggtatg

SEQ ID NO: 642845 - DNA, 25 bp, Homo sapien
tttcagtttaaagttgggtatggtg

SEQ ID NO: 642846 - DNA, 25 bp, Homo sapien
ttcagtttaaagttgggtatggtgg

SEQ ID NO: 642847 - DNA, 25 bp, Homo sapien
tcagtttaaagttgggtatggtggc

SEQ ID NO: 642848 - DNA, 25 bp, Homo sapien
cagtttaaagttgggtatggtggct

SEQ ID NO: 642849 - DNA, 25 bp, Homo sapien
gtttaaagttgggtatggtggctca

SEQ ID NO: 642850 - DNA, 25 bp, Homo sapien
tttaaagttgggtatggtggctcac

SEQ ID NO: 642851 - DNA, 25 bp, Homo sapien
ttaaagttgggtatggtggctcact

SEQ ID NO: 642852 - DNA, 25 bp, Homo sapien
taaagttgggtatggtggctcactc

SEQ ID NO: 642853 - DNA, 25 bp, Homo sapien
aaagttgggtatggtggctcactcc

SEQ ID NO: 642854 - DNA, 25 bp, Homo sapien
gcagagcagtcagccctacggacag

SEQ ID NO: 642855 - DNA, 25 bp, Homo sapien
gagcagtcagccctacggacagcag

SEQ ID NO: 642856 - DNA, 25 bp, Homo sapien
cagtcagccctacggacagcagagt

SEQ ID NO: 642857 - DNA, 25 bp, Homo sapien
tcagccctacggacagcagagttac

SEQ ID NO: 642858 - DNA, 25 bp, Homo sapien
gccctacggacagcagagttacagt

SEQ ID NO: 642859 - DNA, 25 bp, Homo sapien
ctacggacagcagagttacagtggt

SEQ ID NO: 642860 - DNA, 25 bp, Homo sapien
ttacagtggttatagccagtccacg

SEQ ID NO: 642861 - DNA, 25 bp, Homo sapien
tggttatagccagtccacggacact

SEQ ID NO: 642862 - DNA, 25 bp, Homo sapien
tatagccagtccacggacacttcag

SEQ ID NO: 642863 - DNA, 25 bp, Homo sapien
cagtccacggacacttcaggctatg

SEQ ID NO: 642864 - DNA, 25 bp, Homo sapien
gtccacggacacttcaggctatggc

SEQ ID NO: 642865 - DNA, 25 bp, Homo sapien
tttttggtcagtaaagagccaaaca

SEQ ID NO: 642866 - DNA, 25 bp, Homo sapien
ttttggtcagtaaagagccaaacac

SEQ ID NO: 642867 - DNA, 25 bp, Homo sapien
tttggtcagtaaagagccaaacacc

SEQ ID NO: 642868 - DNA, 25 bp, Homo sapien
ttggtcagtaaagagccaaacaccg

SEQ ID NO: 642869 - DNA, 25 bp, Homo sapien
tggtcagtaaagagccaaacaccgg

SEQ ID NO: 642870 - DNA, 25 bp, Homo sapien
ggtcagtaaagagccaaacaccggc

SEQ ID NO: 642871 - DNA, 25 bp, Homo sapien
gtcagtaaagagccaaacaccggcc

SEQ ID NO: 642872 - DNA, 25 bp, Homo sapien
tcagtaaagagccaaacaccggccg

SEQ ID NO: 642873 - DNA, 25 bp, Homo sapien
cagtaaagagccaaacaccggccgg

SEQ ID NO: 642874 - DNA, 25 bp, Homo sapien
aagagccaaacaccggccgggcgcg

SEQ ID NO: 642875 - DNA, 25 bp, Homo sapien
gggaggaccggcctcggcgagggag

SEQ ID NO: 642876 - DNA, 25 bp, Homo sapien
gggagctgcgaacacccagacccaa

SEQ ID NO: 642877 - DNA, 25 bp, Homo sapien
ggagctgcgaacacccagacccaaa

SEQ ID NO: 642878 - DNA, 25 bp, Homo sapien
agacccaaaccctgacatgctctgg

SEQ ID NO: 642879 - DNA, 25 bp, Homo sapien
aaaccctgacatgctctggggcgga

SEQ ID NO: 642880 - DNA, 25 bp, Homo sapien
aggaagccaggagctgagcgcgccg

SEQ ID NO: 642881 - DNA, 25 bp, Homo sapien
gcctgggcagcagccttgctggtct

SEQ ID NO: 642882 - DNA, 25 bp, Homo sapien
gccggcaggaccatgctgctgaaag

SEQ ID NO: 642883 - DNA, 25 bp, Homo sapien
cggcaggaccatgctgctgaaagag

SEQ ID NO: 642884 - DNA, 25 bp, Homo sapien
catgctgctgaaagagtaccggatc

SEQ ID NO: 642885 - DNA, 25 bp, Homo sapien
tgctgaaagagtaccggatctgcat

SEQ ID NO: 642886 - DNA, 25 bp, Homo sapien
aatgaatcacattccggatggtggc

SEQ ID NO: 642887 - DNA, 25 bp, Homo sapien
attccggatggtggcttcaggtcag

SEQ ID NO: 642888 - DNA, 25 bp, Homo sapien
ggtggcttcaggtcagaaagctgtc

SEQ ID NO: 642889 - DNA, 25 bp, Homo sapien
gaaagctgtcaggtcacccaggtgc

SEQ ID NO: 642890 - DNA, 25 bp, Homo sapien
tgccatgcgagctgctccccggaga

SEQ ID NO: 642891 - DNA, 25 bp, Homo sapien
ggctttcggccttgggtttatcaca

SEQ ID NO: 642892 - DNA, 25 bp, Homo sapien
cttgggtttatcacagcggctgttt

SEQ ID NO: 642893 - DNA, 25 bp, Homo sapien
ggctgttttccgtctgccaagccaa

SEQ ID NO: 642894 - DNA, 25 bp, Homo sapien
agcctctgggcttatagtggttttc

SEQ ID NO: 642895 - DNA, 25 bp, Homo sapien
tttcttttctactgtctgaaattga

SEQ ID NO: 642896 - DNA, 25 bp, Homo sapien
gaatgtttagttcatctattttcta

SEQ ID NO: 642897 - DNA, 25 bp, Homo sapien
aacgaggactcgtcctacagctcag

SEQ ID NO: 642898 - DNA, 25 bp, Homo sapien
aggactcgtcctacagctcagacga

SEQ ID NO: 642899 - DNA, 25 bp, Homo sapien
cgtcctacagctcagacgacgagga

SEQ ID NO: 642900 - DNA, 25 bp, Homo sapien
tacagctcagacgacgaggacccgg

SEQ ID NO: 642901 - DNA, 25 bp, Homo sapien
cagacgacgaggacccggctctgct

SEQ ID NO: 642902 - DNA, 25 bp, Homo sapien
tgcttcctgtccagggccacggtgg

SEQ ID NO: 642903 - DNA, 25 bp, Homo sapien
tggctggcaccggtgcgggctcagg

SEQ ID NO: 642904 - DNA, 25 bp, Homo sapien
agcagcaaatccaagctcaagcgca

SEQ ID NO: 642905 - DNA, 25 bp, Homo sapien
aagctcaagcgcaaagaggccctga

SEQ ID NO: 642906 - DNA, 25 bp, Homo sapien
caagcgcaaagaggccctgagcttc

SEQ ID NO: 642907 - DNA, 25 bp, Homo sapien
ccctgagcttctccaaagccaaaga

SEQ ID NO: 642908 - DNA, 25 bp, Homo sapien
ccacactcagccaaaatttttacct

SEQ ID NO: 642909 - DNA, 25 bp, Homo sapien
cagccaaaatttttaccttgcaaag

SEQ ID NO: 642910 - DNA, 25 bp, Homo sapien
taagagatagcacattcccaagcca

SEQ ID NO: 642911 - DNA, 25 bp, Homo sapien
cattcccaagccagagtatttgaaa

SEQ ID NO: 642912 - DNA, 25 bp, Homo sapien
aagacacatcacagtgtgacttttc

SEQ ID NO: 642913 - DNA, 25 bp, Homo sapien
atcacagtgtgacttttctctttcc

SEQ ID NO: 642914 - DNA, 25 bp, Homo sapien
cagtgtgacttttctctttccagaa

SEQ ID NO: 642915 - DNA, 25 bp, Homo sapien
gtgacttttctctttccagaaagaa

SEQ ID NO: 642916 - DNA, 25 bp, Homo sapien
gaatgggctttgtgattcttttaaa

SEQ ID NO: 642917 - DNA, 25 bp, Homo sapien
acatgtgtatgtactatcactccaa

SEQ ID NO: 642918 - DNA, 25 bp, Homo sapien
gtatgtactatcactccaaaattaa

SEQ ID NO: 642919 - DNA, 25 bp, Homo sapien
cacacccttcttgggtcacatggta

SEQ ID NO: 642920 - DNA, 25 bp, Homo sapien
gtcacatggtacctttattctctgt

SEQ ID NO: 642921 - DNA, 25 bp, Homo sapien
attctctgttagtcatactcgatag

SEQ ID NO: 642922 - DNA, 25 bp, Homo sapien
gtcatactcgatagtagcattttat

SEQ ID NO: 642923 - DNA, 25 bp, Homo sapien
agtactatgctttctatttcacaag

SEQ ID NO: 642924 - DNA, 25 bp, Homo sapien
cacaagaagattgcacctgccattt

SEQ ID NO: 642925 - DNA, 25 bp, Homo sapien
gattgcacctgccatttaaagttat

SEQ ID NO: 642926 - DNA, 25 bp, Homo sapien
taaagttatctgatgggcggttttt

SEQ ID NO: 642927 - DNA, 25 bp, Homo sapien
ctaacaatgttcttttagcttgaat

SEQ ID NO: 642928 - DNA, 25 bp, Homo sapien
ttagcttgaattgtctgccttagag

SEQ ID NO: 642929 - DNA, 25 bp, Homo sapien
tctgccttagagaaagttgcatatt

SEQ ID NO: 642930 - DNA, 25 bp, Homo sapien
gggtgagatgaaatttccactccac

SEQ ID NO: 642931 - DNA, 25 bp, Homo sapien
actccacaagtgtccacgggatcag

SEQ ID NO: 642932 - DNA, 25 bp, Homo sapien
aagtgtccacgggatcaggctgaag

SEQ ID NO: 642933 - DNA, 25 bp, Homo sapien
ggatcaggctgaaggaaccctccat

SEQ ID NO: 642934 - DNA, 25 bp, Homo sapien
tgaaggaaccctccatggactttgc

SEQ ID NO: 642935 - DNA, 25 bp, Homo sapien
atggactttgcctgaaactgcatct

SEQ ID NO: 642936 - DNA, 25 bp, Homo sapien
aaactgcatcttgcctggctccttt

SEQ ID NO: 642937 - DNA, 25 bp, Homo sapien
tgctctgctttctacactttcttac

SEQ ID NO: 642938 - DNA, 25 bp, Homo sapien
tttctacactttcttactcttctgc

SEQ ID NO: 642939 - DNA, 25 bp, Homo sapien
acactttcttactcttctgccttgt

SEQ ID NO: 642940 - DNA, 25 bp, Homo sapien
gccttgtgagctctgctctaataaa

SEQ ID NO: 642941 - DNA, 25 bp, Homo sapien
ggaaagatgggctgaacccaatggc

SEQ ID NO: 642942 - DNA, 25 bp, Homo sapien
gaaagatgggctgaacccaatggct

SEQ ID NO: 642943 - DNA, 25 bp, Homo sapien
aaagatgggctgaacccaatggctc

SEQ ID NO: 642944 - DNA, 25 bp, Homo sapien
aagatgggctgaacccaatggctcc

SEQ ID NO: 642945 - DNA, 25 bp, Homo sapien
agatgggctgaacccaatggctcct

SEQ ID NO: 642946 - DNA, 25 bp, Homo sapien
atgggctgaacccaatggctcctgc

SEQ ID NO: 642947 - DNA, 25 bp, Homo sapien
tgggctgaacccaatggctcctgcc

SEQ ID NO: 642948 - DNA, 25 bp, Homo sapien
gggctgaacccaatggctcctgcct

SEQ ID NO: 642949 - DNA, 25 bp, Homo sapien
ggctgaacccaatggctcctgcctg

SEQ ID NO: 642950 - DNA, 25 bp, Homo sapien
gctgaacccaatggctcctgcctgt

SEQ ID NO: 642951 - DNA, 25 bp, Homo sapien
gctacttggaagacaggcgggagga

SEQ ID NO: 642952 - DNA, 25 bp, Homo sapien
aactattgacttggtaagtctactg

SEQ ID NO: 642953 - DNA, 25 bp, Homo sapien
attgacttggtaagtctactgtata

SEQ ID NO: 642954 - DNA, 25 bp, Homo sapien
gtctactgtatataacatctaatat

SEQ ID NO: 642955 - DNA, 25 bp, Homo sapien
aaaatgaactaaacattgccttgct

SEQ ID NO: 642956 - DNA, 25 bp, Homo sapien
aaatgaactaaacattgccttgcta

SEQ ID NO: 642957 - DNA, 25 bp, Homo sapien
acattgccttgctatattcaccaaa

SEQ ID NO: 642958 - DNA, 25 bp, Homo sapien
cattgccttgctatattcaccaaaa

SEQ ID NO: 642959 - DNA, 25 bp, Homo sapien
gaaacactgtctatgataggatttc

SEQ ID NO: 642960 - DNA, 25 bp, Homo sapien
acactgtctatgataggatttccaa

SEQ ID NO: 642961 - DNA, 25 bp, Homo sapien
ggatttccaaaagtatttgtggaca

SEQ ID NO: 642962 - DNA, 25 bp, Homo sapien
caaaagtatttgtggacagttaaat

SEQ ID NO: 642963 - DNA, 25 bp, Homo sapien
ggataagagcactggatctggaatc

SEQ ID NO: 642964 - DNA, 25 bp, Homo sapien
tgtttgcttcctggcagtaccactt

SEQ ID NO: 642965 - DNA, 25 bp, Homo sapien
agtaccacttactggttgtgtgtcc

SEQ ID NO: 642966 - DNA, 25 bp, Homo sapien
ttactggttgtgtgtccttgagcaa

SEQ ID NO: 642967 - DNA, 25 bp, Homo sapien
ttaacctttctgtgcatctgtgacc

SEQ ID NO: 642968 - DNA, 25 bp, Homo sapien
tgtgcatctgtgacctttttccaaa

SEQ ID NO: 642969 - DNA, 25 bp, Homo sapien
aacattgcttatatcatatggtgat

SEQ ID NO: 642970 - DNA, 25 bp, Homo sapien
ctgtagacataagtgggagctggtt

SEQ ID NO: 642971 - DNA, 25 bp, Homo sapien
ggagctggttatgaaaggccatgaa

SEQ ID NO: 642972 - DNA, 25 bp, Homo sapien
gaaaggccatgaatgtgacactaag

SEQ ID NO: 642973 - DNA, 25 bp, Homo sapien
gacactaaggactttgtgctttatt

SEQ ID NO: 642974 - DNA, 25 bp, Homo sapien
ttccccaatcatgatatattagtga

SEQ ID NO: 642975 - DNA, 25 bp, Homo sapien
aatattacagaaccggactatcagt

SEQ ID NO: 642976 - DNA, 25 bp, Homo sapien
gaaccggactatcagtcacttaaaa

SEQ ID NO: 642977 - DNA, 25 bp, Homo sapien
aaacagtataattctaatgctagta

SEQ ID NO: 642978 - DNA, 25 bp, Homo sapien
tagttctggaaggacagttgtcttt

SEQ ID NO: 642979 - DNA, 25 bp, Homo sapien
tgtctttgattaaagccccaccaaa

SEQ ID NO: 642980 - DNA, 25 bp, Homo sapien
tgattaaagccccaccaaaacccat

SEQ ID NO: 642981 - DNA, 25 bp, Homo sapien
tcatattattatggcctgtaaacac

SEQ ID NO: 642982 - DNA, 25 bp, Homo sapien
atggcctgtaaacactaatatctga

SEQ ID NO: 642983 - DNA, 25 bp, Homo sapien
aatatctgagcaatcaaactgtttt

SEQ ID NO: 642984 - DNA, 25 bp, Homo sapien
aatcaaactgttttatctaccattt

SEQ ID NO: 642985 - DNA, 25 bp, Homo sapien
aaccatgcttggcacttggcttctg

SEQ ID NO: 642986 - DNA, 25 bp, Homo sapien
gcacttggcttctggcggaggaaac

SEQ ID NO: 642987 - DNA, 25 bp, Homo sapien
ggcttctggcggaggaaacacccaa

SEQ ID NO: 642988 - DNA, 25 bp, Homo sapien
ggaggaaacacccaaagctggcagc

SEQ ID NO: 642989 - DNA, 25 bp, Homo sapien
aaagctggcagctaaagcccacagc

SEQ ID NO: 642990 - DNA, 25 bp, Homo sapien
taaagcccacagcccatgcacggaa

SEQ ID NO: 642991 - DNA, 25 bp, Homo sapien
catgcacggaaaggcaggaccccag

SEQ ID NO: 642992 - DNA, 25 bp, Homo sapien
accccagggcgatgagcggatgcac

SEQ ID NO: 642993 - DNA, 25 bp, Homo sapien
cgatgagcggatgcacatgcacgcg

SEQ ID NO: 642994 - DNA, 25 bp, Homo sapien
ggatgcacatgcacgcgggccactg

SEQ ID NO: 642995 - DNA, 25 bp, Homo sapien
ctgggctccgagatgtgcctgaggt

SEQ ID NO: 642996 - DNA, 25 bp, Homo sapien
agaaactagcactctgttatccaga

SEQ ID NO: 642997 - DNA, 25 bp, Homo sapien
gttatccagagtgactatcatttta

SEQ ID NO: 642998 - DNA, 25 bp, Homo sapien
attttacattcccatcatcaatgaa

SEQ ID NO: 642999 - DNA, 25 bp, Homo sapien
ttctgttttttcaaatcctcttagc

SEQ ID NO: 643000 - DNA, 25 bp, Homo sapien
ttcaaatcctcttagccatactgac

SEQ ID NO: 643001 - DNA, 25 bp, Homo sapien
tcctcttagccatactgactgatat

SEQ ID NO: 643002 - DNA, 25 bp, Homo sapien
gccatactgactgatatgtattgat

SEQ ID NO: 643003 - DNA, 25 bp, Homo sapien
aatgttctcatatgacatctgccta

SEQ ID NO: 643004 - DNA, 25 bp, Homo sapien
tatgacatctgcctattatctctga

SEQ ID NO: 643005 - DNA, 25 bp, Homo sapien
atctgcctattatctctgatgaaat

SEQ ID NO: 643006 - DNA, 25 bp, Homo sapien
gagagttctgtttatattctggtta

SEQ ID NO: 643007 - DNA, 25 bp, Homo sapien
tgccacagcgcgctggccgtgtgac

SEQ ID NO: 643008 - DNA, 25 bp, Homo sapien
cttccctcttattttctaagagtct

SEQ ID NO: 643009 - DNA, 25 bp, Homo sapien
attttctaagagtctgtgaacccag

SEQ ID NO: 643010 - DNA, 25 bp, Homo sapien
aagagtctgtgaacccaggagcctc

SEQ ID NO: 643011 - DNA, 25 bp, Homo sapien
agtctgtgaacccaggagcctctcg

SEQ ID NO: 643012 - DNA, 25 bp, Homo sapien
ggagcctctcgctctggctttaaga

SEQ ID NO: 643013 - DNA, 25 bp, Homo sapien
ctctggctttaagatgctatgacta

SEQ ID NO: 643014 - DNA, 25 bp, Homo sapien
agatgctatgactaagacgtgacca

SEQ ID NO: 643015 - DNA, 25 bp, Homo sapien
tgctatgactaagacgtgaccaggc

SEQ ID NO: 643016 - DNA, 25 bp, Homo sapien
tatgactaagacgtgaccaggcgca

SEQ ID NO: 643017 - DNA, 25 bp, Homo sapien
gactaagacgtgaccaggcgcagtg

SEQ ID NO: 643018 - DNA, 25 bp, Homo sapien
gaaaggtagaatcttgagctccatt

SEQ ID NO: 643019 - DNA, 25 bp, Homo sapien
tagaatcttgagctccattccaggt

SEQ ID NO: 643020 - DNA, 25 bp, Homo sapien
gagctccattccaggtcaactgaat

SEQ ID NO: 643021 - DNA, 25 bp, Homo sapien
gagaagcattgcctgacatcatatt

SEQ ID NO: 643022 - DNA, 25 bp, Homo sapien
attgcctgacatcatattgcctcta

SEQ ID NO: 643023 - DNA, 25 bp, Homo sapien
gcctgacatcatattgcctctaaat

SEQ ID NO: 643024 - DNA, 25 bp, Homo sapien
ttgcctctaaatgaaatgattacca

SEQ ID NO: 643025 - DNA, 25 bp, Homo sapien
tgtcctgtggacatgtaccagatta

SEQ ID NO: 643026 - DNA, 25 bp, Homo sapien
aagggaagagtctgtcacctagaca

SEQ ID NO: 643027 - DNA, 25 bp, Homo sapien
tgtcacctagacagacttcaggagg

SEQ ID NO: 643028 - DNA, 25 bp, Homo sapien
cagacttcaggagggatctgtgatg

SEQ ID NO: 643029 - DNA, 25 bp, Homo sapien
agaaatttgtctgtgtaactgaggt

SEQ ID NO: 643030 - DNA, 25 bp, Homo sapien
ggagaattggtctgccacaatcctt

SEQ ID NO: 643031 - DNA, 25 bp, Homo sapien
gtctgccacaatccttttctaagca

SEQ ID NO: 643032 - DNA, 25 bp, Homo sapien
atccttttctaagcatagccaatag

SEQ ID NO: 643033 - DNA, 25 bp, Homo sapien
gaaattgccttacagagagtaacac

SEQ ID NO: 643034 - DNA, 25 bp, Homo sapien
gtaacacatttctatactctccttc

SEQ ID NO: 643035 - DNA, 25 bp, Homo sapien
atttctatactctccttccataaca

SEQ ID NO: 643036 - DNA, 25 bp, Homo sapien
ctctccttccataacagacacttaa

SEQ ID NO: 643037 - DNA, 25 bp, Homo sapien
aatgtatgcttgctgtggacctcat

SEQ ID NO: 643038 - DNA, 25 bp, Homo sapien
gtggacctcatttaagattgcaaca

SEQ ID NO: 643039 - DNA, 25 bp, Homo sapien
taagattgcaacagaagcacttttc

SEQ ID NO: 643040 - DNA, 25 bp, Homo sapien
taatggtaagaaaccagatcctttc

SEQ ID NO: 643041 - DNA, 25 bp, Homo sapien
tcctttccccgtaggatcaggaaca

SEQ ID NO: 643042 - DNA, 25 bp, Homo sapien
ggaacaaggcaaggacttcccttct

SEQ ID NO: 643043 - DNA, 25 bp, Homo sapien
actcctattcaacatcatactggac

SEQ ID NO: 643044 - DNA, 25 bp, Homo sapien
ttcaacatcatactggacatcctag

SEQ ID NO: 643045 - DNA, 25 bp, Homo sapien
ggacatcctagctaatgcagtaaaa

SEQ ID NO: 643046 - DNA, 25 bp, Homo sapien
gttaataattacatgttctcagcaa

SEQ ID NO: 643047 - DNA, 25 bp, Homo sapien
aattacatgttctcagcaaactaga

SEQ ID NO: 643048 - DNA, 25 bp, Homo sapien
aaatagaggaggatttcctccactt

SEQ ID NO: 643049 - DNA, 25 bp, Homo sapien
tttcctccacttgataaataaaatt

SEQ ID NO: 643050 - DNA, 25 bp, Homo sapien
cttacagcaaacaccatacctaatg

SEQ ID NO: 643051 - DNA, 25 bp, Homo sapien
ggcaaaataaagaccttctcgaatg

SEQ ID NO: 643052 - DNA, 25 bp, Homo sapien
taaagaccttctcgaatgaaaggaa

SEQ ID NO: 643053 - DNA, 25 bp, Homo sapien
aagcgaagtcatgggcagcagtgct

SEQ ID NO: 643054 - DNA, 25 bp, Homo sapien
gaagtcatgggcagcagtgctactc

SEQ ID NO: 643055 - DNA, 25 bp, Homo sapien
gtcatgggcagcagtgctactcaac

SEQ ID NO: 643056 - DNA, 25 bp, Homo sapien
ggcagcagtgctactcaacaggaaa

SEQ ID NO: 643057 - DNA, 25 bp, Homo sapien
gtgctactcaacaggaaatactaaa

SEQ ID NO: 643058 - DNA, 25 bp, Homo sapien
ttcttccgctggaggagagcaactt

SEQ ID NO: 643059 - DNA, 25 bp, Homo sapien
gagcaacttgggactccaggaatga

SEQ ID NO: 643060 - DNA, 25 bp, Homo sapien
ggaaaaccaacagaaatggccaata

SEQ ID NO: 643061 - DNA, 25 bp, Homo sapien
aaatggccaatatctgggtaaatat

SEQ ID NO: 643062 - DNA, 25 bp, Homo sapien
gaacaatacaggtttgaactctgtg

SEQ ID NO: 643063 - DNA, 25 bp, Homo sapien
atacaggtttgaactctgtgggtcc

SEQ ID NO: 643064 - DNA, 25 bp, Homo sapien
tacaggtttgaactctgtgggtcca

SEQ ID NO: 643065 - DNA, 25 bp, Homo sapien
ttgaactctgtgggtccacttacat

SEQ ID NO: 643066 - DNA, 25 bp, Homo sapien
ttctgtaaaagttacacccgatgcg

SEQ ID NO: 643067 - DNA, 25 bp, Homo sapien
tgtaaaagttacacccgatgcgtca

SEQ ID NO: 643068 - DNA, 25 bp, Homo sapien
gtaaaagttacacccgatgcgtcag

SEQ ID NO: 643069 - DNA, 25 bp, Homo sapien
aaaagttacacccgatgcgtcagcc

SEQ ID NO: 643070 - DNA, 25 bp, Homo sapien
tcctcagcctactcagggtaaagac

SEQ ID NO: 643071 - DNA, 25 bp, Homo sapien
ctcagcctactcagggtaaagacaa

SEQ ID NO: 643072 - DNA, 25 bp, Homo sapien
gcctactcagggtaaagacaaggat

SEQ ID NO: 643073 - DNA, 25 bp, Homo sapien
ataaaccaaaacgtaattcatcaga

SEQ ID NO: 643074 - DNA, 25 bp, Homo sapien
gtaattcatcagacaggcttcccct

SEQ ID NO: 643075 - DNA, 25 bp, Homo sapien
atcagacaggcttcccctacagaaa

SEQ ID NO: 643076 - DNA, 25 bp, Homo sapien
ggcttcccctacagaaacacagtca

SEQ ID NO: 643077 - DNA, 25 bp, Homo sapien
gtagtgggtggtttttctgagccac

SEQ ID NO: 643078 - DNA, 25 bp, Homo sapien
tggtttttctgagccacccagatac

SEQ ID NO: 643079 - DNA, 25 bp, Homo sapien
tggacccacgtctttgtccacattc

SEQ ID NO: 643080 - DNA, 25 bp, Homo sapien
tttgtccacattcgccacttcctga

SEQ ID NO: 643081 - DNA, 25 bp, Homo sapien
acgccaaccctgtgtctacttcggg

SEQ ID NO: 643082 - DNA, 25 bp, Homo sapien
gggcagaagtgagccttgctctcag

SEQ ID NO: 643083 - DNA, 25 bp, Homo sapien
ggcttctaatggagtagcggagaaa

SEQ ID NO: 643084 - DNA, 25 bp, Homo sapien
tatgaaaaacgtgaatatggcaatt

SEQ ID NO: 643085 - DNA, 25 bp, Homo sapien
atgaaaaacgtgaatatggcaattt

SEQ ID NO: 643086 - DNA, 25 bp, Homo sapien
gaaaaacgtgaatatggcaatttag

SEQ ID NO: 643087 - DNA, 25 bp, Homo sapien
aaaaacgtgaatatggcaatttaga

SEQ ID NO: 643088 - DNA, 25 bp, Homo sapien
aaaacgtgaatatggcaatttagag

SEQ ID NO: 643089 - DNA, 25 bp, Homo sapien
aaacgtgaatatggcaatttagagt

SEQ ID NO: 643090 - DNA, 25 bp, Homo sapien
acgtgaatatggcaatttagagtta

SEQ ID NO: 643091 - DNA, 25 bp, Homo sapien
cgtgaatatggcaatttagagttaa

SEQ ID NO: 643092 - DNA, 25 bp, Homo sapien
gtgaatatggcaatttagagttaaa

SEQ ID NO: 643093 - DNA, 25 bp, Homo sapien
gaatatggcaatttagagttaaaaa

SEQ ID NO: 643094 - DNA, 25 bp, Homo sapien
gaaagtgtggatgagggtaaagtac

SEQ ID NO: 643095 - DNA, 25 bp, Homo sapien
agcagggtacagtagcccaaagaaa

SEQ ID NO: 643096 - DNA, 25 bp, Homo sapien
taaagaaaatgtacttaccacctgg

SEQ ID NO: 643097 - DNA, 25 bp, Homo sapien
ccacctggactcaaaaggcagggat

SEQ ID NO: 643098 - DNA, 25 bp, Homo sapien
gaactgctgaaattctgtgacccct

SEQ ID NO: 643099 - DNA, 25 bp, Homo sapien
tgctgaaattctgtgaccccttttt

SEQ ID NO: 643100 - DNA, 25 bp, Homo sapien
tgaaattctgtgacccctttttagt

SEQ ID NO: 643101 - DNA, 25 bp, Homo sapien
aatctctcccaccaacatgtctggg

SEQ ID NO: 643102 - DNA, 25 bp, Homo sapien
caccaacatgtctgggagaaaccaa

SEQ ID NO: 643103 - DNA, 25 bp, Homo sapien
gaaaccaagagctgtaaatcagaaa

SEQ ID NO: 643104 - DNA, 25 bp, Homo sapien
gtaaatcagaaaccgcttccagcaa

SEQ ID NO: 643105 - DNA, 25 bp, Homo sapien
aaccgcttccagcaaaagagttagt

SEQ ID NO: 643106 - DNA, 25 bp, Homo sapien
caaatagattgtgttccaggaatgc

SEQ ID NO: 643107 - DNA, 25 bp, Homo sapien
gttccaggaatgcaaaggtggctta

SEQ ID NO: 643108 - DNA, 25 bp, Homo sapien
aaggtggcttaatattcacaagtca

SEQ ID NO: 643109 - DNA, 25 bp, Homo sapien
acaagtcagttgctattatacacca

SEQ ID NO: 643110 - DNA, 25 bp, Homo sapien
gttgctattatacaccacctgtaga

SEQ ID NO: 643111 - DNA, 25 bp, Homo sapien
ggcatgcagaacattcttgtggtac

SEQ ID NO: 643112 - DNA, 25 bp, Homo sapien
cttgtggtacaattaatgttcgttt

SEQ ID NO: 643113 - DNA, 25 bp, Homo sapien
aatgttcgtttatgatcttagcaaa

SEQ ID NO: 643114 - DNA, 25 bp, Homo sapien
gaaagggacttacttaactgcataa

SEQ ID NO: 643115 - DNA, 25 bp, Homo sapien
tagtgaacatttctcctaagattat

SEQ ID NO: 643116 - DNA, 25 bp, Homo sapien
acaaggatatctgctgtcaatgatt

SEQ ID NO: 643117 - DNA, 25 bp, Homo sapien
tccctgcctctcacgcatgtagaaa

SEQ ID NO: 643118 - DNA, 25 bp, Homo sapien
ccctgcctctcacgcatgtagaaag

SEQ ID NO: 643119 - DNA, 25 bp, Homo sapien
ctgcctctcacgcatgtagaaaggc

SEQ ID NO: 643120 - DNA, 25 bp, Homo sapien
tgcctctcacgcatgtagaaaggcc

SEQ ID NO: 643121 - DNA, 25 bp, Homo sapien
gcctctcacgcatgtagaaaggccg

SEQ ID NO: 643122 - DNA, 25 bp, Homo sapien
cctctcacgcatgtagaaaggccga

SEQ ID NO: 643123 - DNA, 25 bp, Homo sapien
ctctcacgcatgtagaaaggccgag

SEQ ID NO: 643124 - DNA, 25 bp, Homo sapien
tctcacgcatgtagaaaggccgagg

SEQ ID NO: 643125 - DNA, 25 bp, Homo sapien
tcacgcatgtagaaaggccgaggca

SEQ ID NO: 643126 - DNA, 25 bp, Homo sapien
cacgcatgtagaaaggccgaggcag

SEQ ID NO: 643127 - DNA, 25 bp, Homo sapien
aggccgaggcaggaccggatgcggt

SEQ ID NO: 643128 - DNA, 25 bp, Homo sapien
gagtaccaagttcgatccatagcaa

SEQ ID NO: 643129 - DNA, 25 bp, Homo sapien
gttcgatccatagcaagtcatgttc

SEQ ID NO: 643130 - DNA, 25 bp, Homo sapien
ccatagcaagtcatgttcgtcctga

SEQ ID NO: 643131 - DNA, 25 bp, Homo sapien
aagtcatgttcgtcctgacaggcag

SEQ ID NO: 643132 - DNA, 25 bp, Homo sapien
cctgacaggcagactctcttattta

SEQ ID NO: 643133 - DNA, 25 bp, Homo sapien
ggcagactctcttatttagtgcaac

SEQ ID NO: 643134 - DNA, 25 bp, Homo sapien
ctcttatttagtgcaacttttcgga

SEQ ID NO: 643135 - DNA, 25 bp, Homo sapien
tagtgcaacttttcggaagaagatt

SEQ ID NO: 643136 - DNA, 25 bp, Homo sapien
agagacatcctgatcgaccctattc

SEQ ID NO: 643137 - DNA, 25 bp, Homo sapien
gatcgaccctattcgagtggtgcag

SEQ ID NO: 643138 - DNA, 25 bp, Homo sapien
cctattcgagtggtgcagggagata

SEQ ID NO: 643139 - DNA, 25 bp, Homo sapien
accctgcttattccttgaataccaa

SEQ ID NO: 643140 - DNA, 25 bp, Homo sapien
gaagctctagaggacaaaatcccag

SEQ ID NO: 643141 - DNA, 25 bp, Homo sapien
aaaatcccagtccttggcacaaact

SEQ ID NO: 643142 - DNA, 25 bp, Homo sapien
agtccttggcacaaactcaggaaat

SEQ ID NO: 643143 - DNA, 25 bp, Homo sapien
atggaagccggagtctgttttttgt

SEQ ID NO: 643144 - DNA, 25 bp, Homo sapien
gggctgctaattgtgctgattgtca

SEQ ID NO: 643145 - DNA, 25 bp, Homo sapien
ctgattgtcagcctggcactggttt

SEQ ID NO: 643146 - DNA, 25 bp, Homo sapien
ggcactggttttttttcgtgatatt

SEQ ID NO: 643147 - DNA, 25 bp, Homo sapien
gatatttctaatagttcaaactgga

SEQ ID NO: 643148 - DNA, 25 bp, Homo sapien
tcgtaaagcgactcaaccaactcaa

SEQ ID NO: 643149 - DNA, 25 bp, Homo sapien
ccaactcaaccaactggactctgaa

SEQ ID NO: 643150 - DNA, 25 bp, Homo sapien
attttcaatctatgacttgactggt

SEQ ID NO: 643151 - DNA, 25 bp, Homo sapien
caatctatgacttgactggtattaa

SEQ ID NO: 643152 - DNA, 25 bp, Homo sapien
atgacttgactggtattaaagctgc

SEQ ID NO: 643153 - DNA, 25 bp, Homo sapien
gacttgactggtattaaagctgcta

SEQ ID NO: 643154 - DNA, 25 bp, Homo sapien
tgactggtattaaagctgctatttg

SEQ ID NO: 643155 - DNA, 25 bp, Homo sapien
ggttcagcaaacaaactaaaatgat

SEQ ID NO: 643156 - DNA, 25 bp, Homo sapien
ggtgttgctgatttgtgagcatgct

SEQ ID NO: 643157 - DNA, 25 bp, Homo sapien
gttgctgatttgtgagcatgcttta

SEQ ID NO: 643158 - DNA, 25 bp, Homo sapien
gctgatttgtgagcatgctttaaga

SEQ ID NO: 643159 - DNA, 25 bp, Homo sapien
gatttgtgagcatgctttaagatga

SEQ ID NO: 643160 - DNA, 25 bp, Homo sapien
gtgagcatgctttaagatgaaaaaa

SEQ ID NO: 643161 - DNA, 25 bp, Homo sapien
gaaatgtatcaataatcaccttgtg

SEQ ID NO: 643162 - DNA, 25 bp, Homo sapien
atgtatcaataatcaccttgtgagt

SEQ ID NO: 643163 - DNA, 25 bp, Homo sapien
atcaccttgtgagttaaattcttct

SEQ ID NO: 643164 - DNA, 25 bp, Homo sapien
accttgtgagttaaattcttctatg

SEQ ID NO: 643165 - DNA, 25 bp, Homo sapien
taagcaaaaatatgcagtactatat

SEQ ID NO: 643166 - DNA, 25 bp, Homo sapien
gtactatattgtttttaagatatcc

SEQ ID NO: 643167 - DNA, 25 bp, Homo sapien
tatcaaacaaaatagaggcccaagt

SEQ ID NO: 643168 - DNA, 25 bp, Homo sapien
caaacaaaatagaggcccaagtcaa

SEQ ID NO: 643169 - DNA, 25 bp, Homo sapien
gattaaaatacacaacctaccaaga

SEQ ID NO: 643170 - DNA, 25 bp, Homo sapien
aaaagtcacaaacctaataacagag

SEQ ID NO: 643171 - DNA, 25 bp, Homo sapien
gtcacaaacctaataacagagaacc

SEQ ID NO: 643172 - DNA, 25 bp, Homo sapien
tacactgatgtggtccctcggctgg

SEQ ID NO: 643173 - DNA, 25 bp, Homo sapien
accaggtgacacctgccagttatga

SEQ ID NO: 643174 - DNA, 25 bp, Homo sapien
caggtgacacctgccagttatgagg

SEQ ID NO: 643175 - DNA, 25 bp, Homo sapien
gtgacacctgccagttatgagggac

SEQ ID NO: 643176 - DNA, 25 bp, Homo sapien
gacacctgccagttatgagggacag

SEQ ID NO: 643177 - DNA, 25 bp, Homo sapien
cctgccagttatgagggacaggtag

SEQ ID NO: 643178 - DNA, 25 bp, Homo sapien
gagtgcaaagaagcattggctcttc

SEQ ID NO: 643179 - DNA, 25 bp, Homo sapien
gcaaagaagcattggctcttcaggt

SEQ ID NO: 643180 - DNA, 25 bp, Homo sapien
aagcattggctcttcaggtattatg

SEQ ID NO: 643181 - DNA, 25 bp, Homo sapien
gcattggctcttcaggtattatgtt

SEQ ID NO: 643182 - DNA, 25 bp, Homo sapien
ggctcttcaggtattatgtttaaca

SEQ ID NO: 643183 - DNA, 25 bp, Homo sapien
ttctttcctgctttcactgggcgct

SEQ ID NO: 643184 - DNA, 25 bp, Homo sapien
tctttcctgctttcactgggcgctc

SEQ ID NO: 643185 - DNA, 25 bp, Homo sapien
ctttcctgctttcactgggcgctcc

SEQ ID NO: 643186 - DNA, 25 bp, Homo sapien
tttcctgctttcactgggcgctccc

SEQ ID NO: 643187 - DNA, 25 bp, Homo sapien
ttcctgctttcactgggcgctccct

SEQ ID NO: 643188 - DNA, 25 bp, Homo sapien
tcctgctttcactgggcgctccctt

SEQ ID NO: 643189 - DNA, 25 bp, Homo sapien
cctgctttcactgggcgctcccttt

SEQ ID NO: 643190 - DNA, 25 bp, Homo sapien
ctgctttcactgggcgctccctttc

SEQ ID NO: 643191 - DNA, 25 bp, Homo sapien
tgctttcactgggcgctccctttct

SEQ ID NO: 643192 - DNA, 25 bp, Homo sapien
tttcactgggcgctccctttctctg

SEQ ID NO: 643193 - DNA, 25 bp, Homo sapien
ttcactgggcgctccctttctctgt

SEQ ID NO: 643194 - DNA, 25 bp, Homo sapien
tacactgatgtggtccctcggctgg

SEQ ID NO: 643195 - DNA, 25 bp, Homo sapien
accaggtgacacctgccagttatga

SEQ ID NO: 643196 - DNA, 25 bp, Homo sapien
caggtgacacctgccagttatgagg

SEQ ID NO: 643197 - DNA, 25 bp, Homo sapien
gtgacacctgccagttatgagggac

SEQ ID NO: 643198 - DNA, 25 bp, Homo sapien
gacacctgccagttatgagggacag

SEQ ID NO: 643199 - DNA, 25 bp, Homo sapien
gtaggagaggatgggctttccatca

SEQ ID NO: 643200 - DNA, 25 bp, Homo sapien
gagtgcaaagaagcattggctcttc

SEQ ID NO: 643201 - DNA, 25 bp, Homo sapien
aagcattggctcttcaggtattatg

SEQ ID NO: 643202 - DNA, 25 bp, Homo sapien
gcattggctcttcaggtattatgtt

SEQ ID NO: 643203 - DNA, 25 bp, Homo sapien
ggctcttcaggtattatgtttaaca

SEQ ID NO: 643204 - DNA, 25 bp, Homo sapien
attttgcaggaattgctttactcta

SEQ ID NO: 643205 - DNA, 25 bp, Homo sapien
aagtttgagaccagggccgggcaca

SEQ ID NO: 643206 - DNA, 25 bp, Homo sapien
agtttgagaccagggccgggcacag

SEQ ID NO: 643207 - DNA, 25 bp, Homo sapien
actttgagaggccgagttgggagga

SEQ ID NO: 643208 - DNA, 25 bp, Homo sapien
ctttgagaggccgagttgggaggat

SEQ ID NO: 643209 - DNA, 25 bp, Homo sapien
tttgagaggccgagttgggaggatc

SEQ ID NO: 643210 - DNA, 25 bp, Homo sapien
ttgagaggccgagttgggaggatca

SEQ ID NO: 643211 - DNA, 25 bp, Homo sapien
tgagaggccgagttgggaggatcac

SEQ ID NO: 643212 - DNA, 25 bp, Homo sapien
gagaggccgagttgggaggatcacg

SEQ ID NO: 643213 - DNA, 25 bp, Homo sapien
agaggccgagttgggaggatcacga

SEQ ID NO: 643214 - DNA, 25 bp, Homo sapien
gaggccgagttgggaggatcacgag

SEQ ID NO: 643215 - DNA, 25 bp, Homo sapien
ctgggccacagagcgagacttaaaa

SEQ ID NO: 643216 - DNA, 25 bp, Homo sapien
gtgttacattcaccagactgtacaa

SEQ ID NO: 643217 - DNA, 25 bp, Homo sapien
cagactgtacaagttttgagcccaa

SEQ ID NO: 643218 - DNA, 25 bp, Homo sapien
tgtacaagttttgagcccaagggct

SEQ ID NO: 643219 - DNA, 25 bp, Homo sapien
agcccaagggctgttgtatccatcc

SEQ ID NO: 643220 - DNA, 25 bp, Homo sapien
aagggctgttgtatccatccagcct

SEQ ID NO: 643221 - DNA, 25 bp, Homo sapien
gttgtatccatccagcctggtctta

SEQ ID NO: 643222 - DNA, 25 bp, Homo sapien
cagcctggtcttacacatggatgtt

SEQ ID NO: 643223 - DNA, 25 bp, Homo sapien
gcctggtcttacacatggatgttgg

SEQ ID NO: 643224 - DNA, 25 bp, Homo sapien
gtcttacacatggatgttggtgaaa

SEQ ID NO: 643225 - DNA, 25 bp, Homo sapien
gagtataatgttattacatggtcct

SEQ ID NO: 643226 - DNA, 25 bp, Homo sapien
atgttattacatggtcctaaatatc

SEQ ID NO: 643227 - DNA, 25 bp, Homo sapien
gaaatgcatagctgcacttaatctg

SEQ ID NO: 643228 - DNA, 25 bp, Homo sapien
gcatagctgcacttaatctgaatga

SEQ ID NO: 643229 - DNA, 25 bp, Homo sapien
agctgcacttaatctgaatgacaca

SEQ ID NO: 643230 - DNA, 25 bp, Homo sapien
tgcacttaatctgaatgacacacac

SEQ ID NO: 643231 - DNA, 25 bp, Homo sapien
aaaactgctgaatggagttcgtcct

SEQ ID NO: 643232 - DNA, 25 bp, Homo sapien
tgctgaatggagttcgtcctgccaa

SEQ ID NO: 643233 - DNA, 25 bp, Homo sapien
tgaatggagttcgtcctgccaagat

SEQ ID NO: 643234 - DNA, 25 bp, Homo sapien
aatggagttcgtcctgccaagatca

SEQ ID NO: 643235 - DNA, 25 bp, Homo sapien
ggagttcgtcctgccaagatcagag

SEQ ID NO: 643236 - DNA, 25 bp, Homo sapien
gttcgtcctgccaagatcagagttt

SEQ ID NO: 643237 - DNA, 25 bp, Homo sapien
cgtcctgccaagatcagagtttaag

SEQ ID NO: 643238 - DNA, 25 bp, Homo sapien
tgttcctcacagtaggtgcctttga

SEQ ID NO: 643239 - DNA, 25 bp, Homo sapien
taggtgcctttgaagggagatctca

SEQ ID NO: 643240 - DNA, 25 bp, Homo sapien
aagggagatctcagtggtacaactc

SEQ ID NO: 643241 - DNA, 25 bp, Homo sapien
agtggtacaactccatggtccctac

SEQ ID NO: 643242 - DNA, 25 bp, Homo sapien
acaactccatggtccctacaatata

SEQ ID NO: 643243 - DNA, 25 bp, Homo sapien
gtccctacaatatacaaaagctctt

SEQ ID NO: 643244 - DNA, 25 bp, Homo sapien
tttggagtgctcaatgatttttaag

SEQ ID NO: 643245 - DNA, 25 bp, Homo sapien
gattgtaaagggatcctgagatcaa

SEQ ID NO: 643246 - DNA, 25 bp, Homo sapien
gagaattgctgctgtatcaccattt

SEQ ID NO: 643247 - DNA, 25 bp, Homo sapien
gtaactgcatcatattctgttatat

SEQ ID NO: 643248 - DNA, 25 bp, Homo sapien
gtcatagtatatgttaccaattctt

SEQ ID NO: 643249 - DNA, 25 bp, Homo sapien
gttatatatcttacatactacctga

SEQ ID NO: 643250 - DNA, 25 bp, Homo sapien
atactacctgaacatatctttctaa

SEQ ID NO: 643251 - DNA, 25 bp, Homo sapien
gcacagccatttgcatgttgccaga

SEQ ID NO: 643252 - DNA, 25 bp, Homo sapien
atgttgccagatgctcttaatttgc

SEQ ID NO: 643253 - DNA, 25 bp, Homo sapien
gatgctcttaatttgctggtagact

SEQ ID NO: 643254 - DNA, 25 bp, Homo sapien
ggtatagaattcttgctggcagttt

SEQ ID NO: 643255 - DNA, 25 bp, Homo sapien
ttgaatatttcaatccatcaccatg

SEQ ID NO: 643256 - DNA, 25 bp, Homo sapien
accatgtggcctctgttttttctga

SEQ ID NO: 643257 - DNA, 25 bp, Homo sapien
gaattccttggacaaaatgagttgc

SEQ ID NO: 643258 - DNA, 25 bp, Homo sapien
aatgagttgcttctcttttgtttct

SEQ ID NO: 643259 - DNA, 25 bp, Homo sapien
tcttttgagattcttcctttgcctt

SEQ ID NO: 643260 - DNA, 25 bp, Homo sapien
aaagtcccactttcaacatgcatgg

SEQ ID NO: 643261 - DNA, 25 bp, Homo sapien
aagtcccactttcaacatgcatggg

SEQ ID NO: 643262 - DNA, 25 bp, Homo sapien
gtcccactttcaacatgcatgggag

SEQ ID NO: 643263 - DNA, 25 bp, Homo sapien
ccactttcaacatgcatgggaggat

SEQ ID NO: 643264 - DNA, 25 bp, Homo sapien
actttcaacatgcatgggaggatga

SEQ ID NO: 643265 - DNA, 25 bp, Homo sapien
catgcatgggaggatgaagtttcca

SEQ ID NO: 643266 - DNA, 25 bp, Homo sapien
aatgcaattccggtaacagcatatt

SEQ ID NO: 643267 - DNA, 25 bp, Homo sapien
tgcaattccggtaacagcatatttg

SEQ ID NO: 643268 - DNA, 25 bp, Homo sapien
gcaattccggtaacagcatatttgt

SEQ ID NO: 643269 - DNA, 25 bp, Homo sapien
aattccggtaacagcatatttgttc

SEQ ID NO: 643270 - DNA, 25 bp, Homo sapien
attccggtaacagcatatttgttca

SEQ ID NO: 643271 - DNA, 25 bp, Homo sapien
cctgggttcaagtgcctccacaccc

SEQ ID NO: 643272 - DNA, 25 bp, Homo sapien
ctgggttcaagtgcctccacaccca

SEQ ID NO: 643273 - DNA, 25 bp, Homo sapien
ccatgcccggcctacctggagcatt

SEQ ID NO: 643274 - DNA, 25 bp, Homo sapien
catgcccggcctacctggagcatta

SEQ ID NO: 643275 - DNA, 25 bp, Homo sapien
atgcccggcctacctggagcattat

SEQ ID NO: 643276 - DNA, 25 bp, Homo sapien
tgcccggcctacctggagcattatt

SEQ ID NO: 643277 - DNA, 25 bp, Homo sapien
gcccggcctacctggagcattatta

SEQ ID NO: 643278 - DNA, 25 bp, Homo sapien
cccggcctacctggagcattattaa

SEQ ID NO: 643279 - DNA, 25 bp, Homo sapien
ccggcctacctggagcattattaaa

SEQ ID NO: 643280 - DNA, 25 bp, Homo sapien
cggcctacctggagcattattaaaa

SEQ ID NO: 643281 - DNA, 25 bp, Homo sapien
aagtatgacttttgcacatctattg

SEQ ID NO: 643282 - DNA, 25 bp, Homo sapien
gacttttgcacatctattgttgaat

SEQ ID NO: 643283 - DNA, 25 bp, Homo sapien
gcacatctattgttgaatttgttca

SEQ ID NO: 643284 - DNA, 25 bp, Homo sapien
tatttattgtttatgatgctgttga

SEQ ID NO: 643285 - DNA, 25 bp, Homo sapien
gttcattgctagtgtttagaaacat

SEQ ID NO: 643286 - DNA, 25 bp, Homo sapien
gccaccttgctgaacttgcttatta

SEQ ID NO: 643287 - DNA, 25 bp, Homo sapien
accttgctgaacttgcttattagtt

SEQ ID NO: 643288 - DNA, 25 bp, Homo sapien
tagtggattatttaggatttgctgt

SEQ ID NO: 643289 - DNA, 25 bp, Homo sapien
ggatttgctgtatacaagatcatgt

SEQ ID NO: 643290 - DNA, 25 bp, Homo sapien
gctgtatacaagatcatgtcacctg

SEQ ID NO: 643291 - DNA, 25 bp, Homo sapien
acaagatcatgtcacctgtaaatat

SEQ ID NO: 643292 - DNA, 25 bp, Homo sapien
cagacactgtgctacaagctgggaa

SEQ ID NO: 643293 - DNA, 25 bp, Homo sapien
agacactgtgctacaagctgggaat

SEQ ID NO: 643294 - DNA, 25 bp, Homo sapien
gacactgtgctacaagctgggaatg

SEQ ID NO: 643295 - DNA, 25 bp, Homo sapien
cactgtgctacaagctgggaatgct

SEQ ID NO: 643296 - DNA, 25 bp, Homo sapien
ctgtgctacaagctgggaatgctga

SEQ ID NO: 643297 - DNA, 25 bp, Homo sapien
gtgctacaagctgggaatgctgaca

SEQ ID NO: 643298 - DNA, 25 bp, Homo sapien
aaaatgcatacatgcactagtgcat

SEQ ID NO: 643299 - DNA, 25 bp, Homo sapien
tgcactagtgcatgaatggcagcca

SEQ ID NO: 643300 - DNA, 25 bp, Homo sapien
gcactagtgcatgaatggcagccag

SEQ ID NO: 643301 - DNA, 25 bp, Homo sapien
ctagtgcatgaatggcagccaggat

SEQ ID NO: 643302 - DNA, 25 bp, Homo sapien
tgcatgaatggcagccaggatgagt

SEQ ID NO: 643303 - DNA, 25 bp, Homo sapien
gaatttcctacttttgctcattctc

SEQ ID NO: 643304 - DNA, 25 bp, Homo sapien
atttcctacttttgctcattctcta

SEQ ID NO: 643305 - DNA, 25 bp, Homo sapien
ttcctacttttgctcattctctagg

SEQ ID NO: 643306 - DNA, 25 bp, Homo sapien
tacttttgctcattctctaggatag

SEQ ID NO: 643307 - DNA, 25 bp, Homo sapien
cttttgctcattctctaggatagtt

SEQ ID NO: 643308 - DNA, 25 bp, Homo sapien
ttgctcattctctaggatagttctt

SEQ ID NO: 643309 - DNA, 25 bp, Homo sapien
gctcattctctaggatagttcttat

SEQ ID NO: 643310 - DNA, 25 bp, Homo sapien
gatagttcttatccagaatgtggtt

SEQ ID NO: 643311 - DNA, 25 bp, Homo sapien
gttcttatccagaatgtggtttcag

SEQ ID NO: 643312 - DNA, 25 bp, Homo sapien
tatccagaatgtggtttcaggaatt

SEQ ID NO: 643313 - DNA, 25 bp, Homo sapien
cagaatgtggtttcaggaattcttt

SEQ ID NO: 643314 - DNA, 25 bp, Homo sapien
cagatggccgcctgcctcatcgaac

SEQ ID NO: 643315 - DNA, 25 bp, Homo sapien
aatctgatctgcacattccaccagg

SEQ ID NO: 643316 - DNA, 25 bp, Homo sapien
aggccacccttctgaggcagctgcg

SEQ ID NO: 643317 - DNA, 25 bp, Homo sapien
ccttctgaggcagctgcgagtccag

SEQ ID NO: 643318 - DNA, 25 bp, Homo sapien
agctgcgagtccagctggacttgag

SEQ ID NO: 643319 - DNA, 25 bp, Homo sapien
ctggacttgagtggcagagagcagc

SEQ ID NO: 643320 - DNA, 25 bp, Homo sapien
gagaaccatccggatcagtcctgtc

SEQ ID NO: 643321 - DNA, 25 bp, Homo sapien
atccggatcagtcctgtccaataga

SEQ ID NO: 643322 - DNA, 25 bp, Homo sapien
ggatcagtcctgtccaatagagaca

SEQ ID NO: 643323 - DNA, 25 bp, Homo sapien
gtcctgtccaatagagacatgatgc

SEQ ID NO: 643324 - DNA, 25 bp, Homo sapien
aagccacagatgtcacttaaaatgt

SEQ ID NO: 643325 - DNA, 25 bp, Homo sapien
gtctcagtgggtggttgccatcccg

SEQ ID NO: 643326 - DNA, 25 bp, Homo sapien
tacatccttggccttcgaacctttt

SEQ ID NO: 643327 - DNA, 25 bp, Homo sapien
aattctgtggaaatctcaagtgtgt

SEQ ID NO: 643328 - DNA, 25 bp, Homo sapien
ctcaagtgtgtggacgcagtgtgat

SEQ ID NO: 643329 - DNA, 25 bp, Homo sapien
gacgcagtgtgatgaatccctcttc

SEQ ID NO: 643330 - DNA, 25 bp, Homo sapien
agtgtgatgaatccctcttcctgcg

SEQ ID NO: 643331 - DNA, 25 bp, Homo sapien
tgcgccagcgattcgcggcactgct

SEQ ID NO: 643332 - DNA, 25 bp, Homo sapien
gattcgcggcactgctggtcccttt

SEQ ID NO: 643333 - DNA, 25 bp, Homo sapien
tttctgcccactgtggttctctttc

SEQ ID NO: 643334 - DNA, 25 bp, Homo sapien
ggttctctttccacagcgttttaga

SEQ ID NO: 643335 - DNA, 25 bp, Homo sapien
agagaaaatatccatcacatcattt

SEQ ID NO: 643336 - DNA, 25 bp, Homo sapien
atgcctgtagttctaatgctttgga

SEQ ID NO: 643337 - DNA, 25 bp, Homo sapien
gcctgtagttctaatgctttggaaa

SEQ ID NO: 643338 - DNA, 25 bp, Homo sapien
ctgtagttctaatgctttggaaatc

SEQ ID NO: 643339 - DNA, 25 bp, Homo sapien
tagttctaatgctttggaaatctga

SEQ ID NO: 643340 - DNA, 25 bp, Homo sapien
gagaatcacttgatctccagttcta

SEQ ID NO: 643341 - DNA, 25 bp, Homo sapien
gaatcacttgatctccagttctaga

SEQ ID NO: 643342 - DNA, 25 bp, Homo sapien
atcacttgatctccagttctagacc

SEQ ID NO: 643343 - DNA, 25 bp, Homo sapien
cacttgatctccagttctagaccag

SEQ ID NO: 643344 - DNA, 25 bp, Homo sapien
acttgatctccagttctagaccagc

SEQ ID NO: 643345 - DNA, 25 bp, Homo sapien
tgctgtgagccatgaacgcccctct

SEQ ID NO: 643346 - DNA, 25 bp, Homo sapien
tgtgagccatgaacgcccctctgca

SEQ ID NO: 643347 - DNA, 25 bp, Homo sapien
ctggcccctttgcacactggtgaag

SEQ ID NO: 643348 - DNA, 25 bp, Homo sapien
ctttgcacactggtgaagcctgtgg

SEQ ID NO: 643349 - DNA, 25 bp, Homo sapien
ggtgaagcctgtggatcccttttca

SEQ ID NO: 643350 - DNA, 25 bp, Homo sapien
aagcctgtggatcccttttcagtat

SEQ ID NO: 643351 - DNA, 25 bp, Homo sapien
gtggatcccttttcagtataacgct

SEQ ID NO: 643352 - DNA, 25 bp, Homo sapien
ggatcccttttcagtataacgcttt

SEQ ID NO: 643353 - DNA, 25 bp, Homo sapien
tcccttttcagtataacgcttttat

SEQ ID NO: 643354 - DNA, 25 bp, Homo sapien
tagtttttagagagacgaggtcttg

SEQ ID NO: 643355 - DNA, 25 bp, Homo sapien
accatgctgggcagtataaagtttt

SEQ ID NO: 643356 - DNA, 25 bp, Homo sapien
aaaatccacaagatgaccaaggaag

SEQ ID NO: 643357 - DNA, 25 bp, Homo sapien
gaccaaggaaggcaattatgttgaa

SEQ ID NO: 643358 - DNA, 25 bp, Homo sapien
ggttggcctccgtgcatttccgcta

SEQ ID NO: 643359 - DNA, 25 bp, Homo sapien
cctccgtgcatttccgctaggtggg

SEQ ID NO: 643360 - DNA, 25 bp, Homo sapien
ccggaggccttttgcagcggttcca

SEQ ID NO: 643361 - DNA, 25 bp, Homo sapien
agcggttccagctgcgccttgaccg

SEQ ID NO: 643362 - DNA, 25 bp, Homo sapien
agctgcgccttgaccgttcccggta

SEQ ID NO: 643363 - DNA, 25 bp, Homo sapien
accgttcccggtacgcacggtgcag

SEQ ID NO: 643364 - DNA, 25 bp, Homo sapien
ggtgcagctgttcggccgtggccgg

SEQ ID NO: 643365 - DNA, 25 bp, Homo sapien
gaagcggacctctgggtctcggtca

SEQ ID NO: 643366 - DNA, 25 bp, Homo sapien
tctgggtctcggtcacggctctggt

SEQ ID NO: 643367 - DNA, 25 bp, Homo sapien
ctcggtcacggctctggtgtgagaa

SEQ ID NO: 643368 - DNA, 25 bp, Homo sapien
cacggctctggtgtgagaataaaca

SEQ ID NO: 643369 - DNA, 25 bp, Homo sapien
tccgagaccgggactcccgcctgcg

SEQ ID NO: 643370 - DNA, 25 bp, Homo sapien
cgagaccgggactcccgcctgcggg

SEQ ID NO: 643371 - DNA, 25 bp, Homo sapien
gcagcctcggcctgcctggatgagg

SEQ ID NO: 643372 - DNA, 25 bp, Homo sapien
gcctggatgaggctcgggccagccg

SEQ ID NO: 643373 - DNA, 25 bp, Homo sapien
cctggatgaggctcgggccagccgg

SEQ ID NO: 643374 - DNA, 25 bp, Homo sapien
tggatgaggctcgggccagccggct

SEQ ID NO: 643375 - DNA, 25 bp, Homo sapien
ggatgaggctcgggccagccggctg

SEQ ID NO: 643376 - DNA, 25 bp, Homo sapien
tgaggctcgggccagccggctgctg

SEQ ID NO: 643377 - DNA, 25 bp, Homo sapien
gaggctcgggccagccggctgctgg

SEQ ID NO: 643378 - DNA, 25 bp, Homo sapien
ggctcgggccagccggctgctggcg

SEQ ID NO: 643379 - DNA, 25 bp, Homo sapien
gctggaggttctgcgggagcagctg

SEQ ID NO: 643380 - DNA, 25 bp, Homo sapien
ccgagcccctgttcagtgagctagg

SEQ ID NO: 643381 - DNA, 25 bp, Homo sapien
agcccctgttcagtgagctaggccg

SEQ ID NO: 643382 - DNA, 25 bp, Homo sapien
tgttcagtgagctaggccgctctcg

SEQ ID NO: 643383 - DNA, 25 bp, Homo sapien
ttcagtgagctaggccgctctcgtc

SEQ ID NO: 643384 - DNA, 25 bp, Homo sapien
gagctaggccgctctcgtctggcaa

SEQ ID NO: 643385 - DNA, 25 bp, Homo sapien
taggccgctctcgtctggcaaaggt

SEQ ID NO: 643386 - DNA, 25 bp, Homo sapien
ccgctctcgtctggcaaaggtggtg

SEQ ID NO: 643387 - DNA, 25 bp, Homo sapien
ctctcgtctggcaaaggtggtgaag

SEQ ID NO: 643388 - DNA, 25 bp, Homo sapien
gacgttgaaggagattcaccttgcc

SEQ ID NO: 643389 - DNA, 25 bp, Homo sapien
cgttgaaggagattcaccttgcctt

SEQ ID NO: 643390 - DNA, 25 bp, Homo sapien
tgaaggagattcaccttgccttcct

SEQ ID NO: 643391 - DNA, 25 bp, Homo sapien
ctatgcttgcagcttgatttttcag

SEQ ID NO: 643392 - DNA, 25 bp, Homo sapien
gatttttcaggctactttctgttag

SEQ ID NO: 643393 - DNA, 25 bp, Homo sapien
ttttcaggctactttctgttagaaa

SEQ ID NO: 643394 - DNA, 25 bp, Homo sapien
tcccaccctaatctttctcttatta

SEQ ID NO: 643395 - DNA, 25 bp, Homo sapien
ctcttattaggcagatgtggtttcc

SEQ ID NO: 643396 - DNA, 25 bp, Homo sapien
acacccacacacatggcgacaagga

SEQ ID NO: 643397 - DNA, 25 bp, Homo sapien
cacacacatggcgacaaggagaagg

SEQ ID NO: 643398 - DNA, 25 bp, Homo sapien
atatacctggcttttggcacagctg

SEQ ID NO: 643399 - DNA, 25 bp, Homo sapien
agctgccgggattcacctgtgcaag

SEQ ID NO: 643400 - DNA, 25 bp, Homo sapien
cgggattcacctgtgcaagtttcca

SEQ ID NO: 643401 - DNA, 25 bp, Homo sapien
gcttatctatgcttgcagcttgatt

SEQ ID NO: 643402 - DNA, 25 bp, Homo sapien
ttgctcccttcttcatggaatattt

SEQ ID NO: 643403 - DNA, 25 bp, Homo sapien
ctcccttcttcatggaatatttctg

SEQ ID NO: 643404 - DNA, 25 bp, Homo sapien
atagcccctatatttcaaaagatgg

SEQ ID NO: 643405 - DNA, 25 bp, Homo sapien
gcccctatatttcaaaagatggata

SEQ ID NO: 643406 - DNA, 25 bp, Homo sapien
tatcacaggaaagctggattgctct

SEQ ID NO: 643407 - DNA, 25 bp, Homo sapien
acaggaaagctggattgctctgcag

SEQ ID NO: 643408 - DNA, 25 bp, Homo sapien
aaagctggattgctctgcagtgagt

SEQ ID NO: 643409 - DNA, 25 bp, Homo sapien
gattgctctgcagtgagtgaaacgt

SEQ ID NO: 643410 - DNA, 25 bp, Homo sapien
gtgagtgaaacgtggaaaggccttt

SEQ ID NO: 643411 - DNA, 25 bp, Homo sapien
aggcctttccccaccaagcagtagg

SEQ ID NO: 643412 - DNA, 25 bp, Homo sapien
tttccccaccaagcagtaggccaaa

SEQ ID NO: 643413 - DNA, 25 bp, Homo sapien
tgatatagcagttaaccaagaccaa

SEQ ID NO: 643414 - DNA, 25 bp, Homo sapien
accaagaccaacatggtgtctgctt

SEQ ID NO: 643415 - DNA, 25 bp, Homo sapien
acatggtgtctgcttggttgatgct

SEQ ID NO: 643416 - DNA, 25 bp, Homo sapien
gtctgcttggttgatgcttgaaata

SEQ ID NO: 643417 - DNA, 25 bp, Homo sapien
tgaaataaggtgacctggccccagc

SEQ ID NO: 643418 - DNA, 25 bp, Homo sapien
aagggctgtaacaagtaggcagtga

SEQ ID NO: 643419 - DNA, 25 bp, Homo sapien
gtaggcagtgaatagtcttcaaact

SEQ ID NO: 643420 - DNA, 25 bp, Homo sapien
tagtcttcaaacttgttacttgcat

SEQ ID NO: 643421 - DNA, 25 bp, Homo sapien
aaacttgttacttgcatacctccct

SEQ ID NO: 643422 - DNA, 25 bp, Homo sapien
gttacttgcatacctccctacaaat

SEQ ID NO: 643423 - DNA, 25 bp, Homo sapien
aaccatgagactctgattgattttt

SEQ ID NO: 643424 - DNA, 25 bp, Homo sapien
taaactttgagcttcttgaaaagag

SEQ ID NO: 643425 - DNA, 25 bp, Homo sapien
tccatctccatggtaacaagtatat

SEQ ID NO: 643426 - DNA, 25 bp, Homo sapien
catctccatggtaacaagtatatat

SEQ ID NO: 643427 - DNA, 25 bp, Homo sapien
ctccatggtaacaagtatatatagt

SEQ ID NO: 643428 - DNA, 25 bp, Homo sapien
gtaagtactcaataactcataaatc

SEQ ID NO: 643429 - DNA, 25 bp, Homo sapien
gtactcaataactcataaatctatt

SEQ ID NO: 643430 - DNA, 25 bp, Homo sapien
attcaagggaaatttaaagctcatt

SEQ ID NO: 643431 - DNA, 25 bp, Homo sapien
gggaaatttaaagctcatttgaagg

SEQ ID NO: 643432 - DNA, 25 bp, Homo sapien
gaaatttaaagctcatttgaaggtt

SEQ ID NO: 643433 - DNA, 25 bp, Homo sapien
aaaacggataacatagccgggtgcg

SEQ ID NO: 643434 - DNA, 25 bp, Homo sapien
aaacggataacatagccgggtgcgg

SEQ ID NO: 643435 - DNA, 25 bp, Homo sapien
tctgggctgatgaatacatttacct

SEQ ID NO: 643436 - DNA, 25 bp, Homo sapien
acatttacctaagaaactcatttcg

SEQ ID NO: 643437 - DNA, 25 bp, Homo sapien
cttttttggccttctatgtgcttag

SEQ ID NO: 643438 - DNA, 25 bp, Homo sapien
ggccttctatgtgcttagccataac

SEQ ID NO: 643439 - DNA, 25 bp, Homo sapien
atgtgcttagccataacaattccat

SEQ ID NO: 643440 - DNA, 25 bp, Homo sapien
aacaattccattaagcaagaaggta

SEQ ID NO: 643441 - DNA, 25 bp, Homo sapien
aaaacttgcactggcttgtctcact

SEQ ID NO: 643442 - DNA, 25 bp, Homo sapien
actggcttgtctcacttacgaaaca

SEQ ID NO: 643443 - DNA, 25 bp, Homo sapien
ggcttgtctcacttacgaaacatgt

SEQ ID NO: 643444 - DNA, 25 bp, Homo sapien
gtctcacttacgaaacatgtcggag

SEQ ID NO: 643445 - DNA, 25 bp, Homo sapien
acatgtcggagctgtttgcctgggt

SEQ ID NO: 643446 - DNA, 25 bp, Homo sapien
cttctcctcttcagatggactgcag

SEQ ID NO: 643447 - DNA, 25 bp, Homo sapien
tctcctcttcagatggactgcaggg

SEQ ID NO: 643448 - DNA, 25 bp, Homo sapien
acgagactccagtggcagccgctca

SEQ ID NO: 643449 - DNA, 25 bp, Homo sapien
agtggcagccgctcaactctgaaca

SEQ ID NO: 643450 - DNA, 25 bp, Homo sapien
ggcagccgctcaactctgaacacag

SEQ ID NO: 643451 - DNA, 25 bp, Homo sapien
aactctgaacacagccactgcatag

SEQ ID NO: 643452 - DNA, 25 bp, Homo sapien
tctgaacacagccactgcatagagg

SEQ ID NO: 643453 - DNA, 25 bp, Homo sapien
acacagccactgcatagagggttca

SEQ ID NO: 643454 - DNA, 25 bp, Homo sapien
acagccactgcatagagggttcagt

SEQ ID NO: 643455 - DNA, 25 bp, Homo sapien
tccccaccaagcagtgagtggcttt

SEQ ID NO: 643456 - DNA, 25 bp, Homo sapien
caagcagtgagtggctttctgctgt

SEQ ID NO: 643457 - DNA, 25 bp, Homo sapien
gcaagggtggtcacgccatgttttc

SEQ ID NO: 643458 - DNA, 25 bp, Homo sapien
gggtggtcacgccatgttttctgat

SEQ ID NO: 643459 - DNA, 25 bp, Homo sapien
gtggtcacgccatgttttctgatca

SEQ ID NO: 643460 - DNA, 25 bp, Homo sapien
ggtcacgccatgttttctgatcacg

SEQ ID NO: 643461 - DNA, 25 bp, Homo sapien
tcacgccatgttttctgatcacgct

SEQ ID NO: 643462 - DNA, 25 bp, Homo sapien
acgccatgttttctgatcacgctgg

SEQ ID NO: 643463 - DNA, 25 bp, Homo sapien
catgttttctgatcacgctggtttt

SEQ ID NO: 643464 - DNA, 25 bp, Homo sapien
atgttttctgatcacgctggttttc

SEQ ID NO: 643465 - DNA, 25 bp, Homo sapien
gttttctgatcacgctggttttcct

SEQ ID NO: 643466 - DNA, 25 bp, Homo sapien
tttctgatcacgctggttttccttt

SEQ ID NO: 643467 - DNA, 25 bp, Homo sapien
tctgatcacgctggttttcctttta

SEQ ID NO: 643468 - DNA, 25 bp, Homo sapien
gagctaaaggctgggaacttgcata

SEQ ID NO: 643469 - DNA, 25 bp, Homo sapien
tgggaacttgcatagccttagccat

SEQ ID NO: 643470 - DNA, 25 bp, Homo sapien
tagccttagccatttgccaaggaac

SEQ ID NO: 643471 - DNA, 25 bp, Homo sapien
tgataactgtaaacactctagctcc

SEQ ID NO: 643472 - DNA, 25 bp, Homo sapien
tcccttgttccctgatcaggaaaac

SEQ ID NO: 643473 - DNA, 25 bp, Homo sapien
taatgtgtgatctccctgtctgcag

SEQ ID NO: 643474 - DNA, 25 bp, Homo sapien
tgcaggactttccttgctggttttc

SEQ ID NO: 643475 - DNA, 25 bp, Homo sapien
ccttgctggttttcttcacggtgtt

SEQ ID NO: 643476 - DNA, 25 bp, Homo sapien
aagtgcattgtacccttgattgcct

SEQ ID NO: 643477 - DNA, 25 bp, Homo sapien
ttgattgcctttcttccttgccctg

SEQ ID NO: 643478 - DNA, 25 bp, Homo sapien
ggaatgcttcttaataaacaccact

SEQ ID NO: 643479 - DNA, 25 bp, Homo sapien
gacaaagcaggagcgtgcacgctct

SEQ ID NO: 643480 - DNA, 25 bp, Homo sapien
gagcgtgcacgctctctctttctct

SEQ ID NO: 643481 - DNA, 25 bp, Homo sapien
ttaattttggtttctctcaagcttc

SEQ ID NO: 643482 - DNA, 25 bp, Homo sapien
ttctctcaagcttccaaatggtgct

SEQ ID NO: 643483 - DNA, 25 bp, Homo sapien
aagcttccaaatggtgctcagtgct

SEQ ID NO: 643484 - DNA, 25 bp, Homo sapien
ttccaaatggtgctcagtgctccaa

SEQ ID NO: 643485 - DNA, 25 bp, Homo sapien
aatggtgctcagtgctccaaggaaa

SEQ ID NO: 643486 - DNA, 25 bp, Homo sapien
ggtgctcagtgctccaaggaaagga

SEQ ID NO: 643487 - DNA, 25 bp, Homo sapien
aaaagcagcctgacagtccagctgt

SEQ ID NO: 643488 - DNA, 25 bp, Homo sapien
gcctgacagtccagctgtttgcaaa

SEQ ID NO: 643489 - DNA, 25 bp, Homo sapien
cagctgtttgcaaactcatagcaca

SEQ ID NO: 643490 - DNA, 25 bp, Homo sapien
gaaagatgggctgaacccaatggct

SEQ ID NO: 643491 - DNA, 25 bp, Homo sapien
aaagatgggctgaacccaatggctc

SEQ ID NO: 643492 - DNA, 25 bp, Homo sapien
aagatgggctgaacccaatggctcc

SEQ ID NO: 643493 - DNA, 25 bp, Homo sapien
agatgggctgaacccaatggctcct

SEQ ID NO: 643494 - DNA, 25 bp, Homo sapien
atgggctgaacccaatggctcctgc

SEQ ID NO: 643495 - DNA, 25 bp, Homo sapien
tgggctgaacccaatggctcctgcc

SEQ ID NO: 643496 - DNA, 25 bp, Homo sapien
gggctgaacccaatggctcctgcct

SEQ ID NO: 643497 - DNA, 25 bp, Homo sapien
ggctgaacccaatggctcctgcctg

SEQ ID NO: 643498 - DNA, 25 bp, Homo sapien
gctgaacccaatggctcctgcctgt

SEQ ID NO: 643499 - DNA, 25 bp, Homo sapien
gcgggaggttggcttgaagttagga

SEQ ID NO: 643500 - DNA, 25 bp, Homo sapien
gctacttggaagacaggcgggagga

SEQ ID NO: 643501 - DNA, 25 bp, Homo sapien
ttatcagcacagcttgggactggcc

SEQ ID NO: 643502 - DNA, 25 bp, Homo sapien
cagcttgggactggccacaaaattc

SEQ ID NO: 643503 - DNA, 25 bp, Homo sapien
cacaaaattcttctaaatctcccca

SEQ ID NO: 643504 - DNA, 25 bp, Homo sapien
aatctccccaggataatctcatgag

SEQ ID NO: 643505 - DNA, 25 bp, Homo sapien
gagagcacggatgctttgcccagaa

SEQ ID NO: 643506 - DNA, 25 bp, Homo sapien
gatgctttgcccagaatctctgcaa

SEQ ID NO: 643507 - DNA, 25 bp, Homo sapien
atctctgcaaccgaggaaggtctgt

SEQ ID NO: 643508 - DNA, 25 bp, Homo sapien
gggccctgagagacttcacctaaaa

SEQ ID NO: 643509 - DNA, 25 bp, Homo sapien
attccccacccgtgtgtgtatgtag

SEQ ID NO: 643510 - DNA, 25 bp, Homo sapien
tgtgtatgtaggtgtctctgtagac

SEQ ID NO: 643511 - DNA, 25 bp, Homo sapien
cagtgattaaaaatactcctgactt

SEQ ID NO: 643512 - DNA, 25 bp, Homo sapien
ggcagagaatttcttgaatctggga

SEQ ID NO: 643513 - DNA, 25 bp, Homo sapien
gcagagaatttcttgaatctgggag

SEQ ID NO: 643514 - DNA, 25 bp, Homo sapien
cagagaatttcttgaatctgggagg

SEQ ID NO: 643515 - DNA, 25 bp, Homo sapien
agagaatttcttgaatctgggaggc

SEQ ID NO: 643516 - DNA, 25 bp, Homo sapien
caaaacaaaagccaggcgcggttgc

SEQ ID NO: 643517 - DNA, 25 bp, Homo sapien
aaaacaaaagccaggcgcggttgct

SEQ ID NO: 643518 - DNA, 25 bp, Homo sapien
aaacaaaagccaggcgcggttgctc

SEQ ID NO: 643519 - DNA, 25 bp, Homo sapien
aacaaaagccaggcgcggttgctca

SEQ ID NO: 643520 - DNA, 25 bp, Homo sapien
acaaaagccaggcgcggttgctcac

SEQ ID NO: 643521 - DNA, 25 bp, Homo sapien
caaaagccaggcgcggttgctcacg

SEQ ID NO: 643522 - DNA, 25 bp, Homo sapien
gaccaacctggccaaggtggcgaaa

SEQ ID NO: 643523 - DNA, 25 bp, Homo sapien
aggatctgtgtcgtctgatgaagga

SEQ ID NO: 643524 - DNA, 25 bp, Homo sapien
gaagaaaacctcacccgggagctga

SEQ ID NO: 643525 - DNA, 25 bp, Homo sapien
cacccgggagctgaaatctgagatt

SEQ ID NO: 643526 - DNA, 25 bp, Homo sapien
gaaatctgagattgagcggcttcag

SEQ ID NO: 643527 - DNA, 25 bp, Homo sapien
gagcggcttcagaaacgaatggctg

SEQ ID NO: 643528 - DNA, 25 bp, Homo sapien
ggagtaagaatgactgtacccagct

SEQ ID NO: 643529 - DNA, 25 bp, Homo sapien
agctgtgtctgagcctgaatgagga

SEQ ID NO: 643530 - DNA, 25 bp, Homo sapien
tctcctctgagctggaaatgctcag

SEQ ID NO: 643531 - DNA, 25 bp, Homo sapien
ggaaatgctcagagtcaaagtgaaa

SEQ ID NO: 643532 - DNA, 25 bp, Homo sapien
agaatcttctgaggaccgcctggat

SEQ ID NO: 643533 - DNA, 25 bp, Homo sapien
atcttctgaggaccgcctggataaa

SEQ ID NO: 643534 - DNA, 25 bp, Homo sapien
gcccagctgcctaacagaagcaagc

SEQ ID NO: 643535 - DNA, 25 bp, Homo sapien
gctgcctaacagaagcaagcctgaa

SEQ ID NO: 643536 - DNA, 25 bp, Homo sapien
gaagcaagcctgaatactctaggga

SEQ ID NO: 643537 - DNA, 25 bp, Homo sapien
gcaagcctgaatactctagggaaga

SEQ ID NO: 643538 - DNA, 25 bp, Homo sapien
ctagggaagaaggtatcttatgctt

SEQ ID NO: 643539 - DNA, 25 bp, Homo sapien
atcttatgctttaaattgctgctgc

SEQ ID NO: 643540 - DNA, 25 bp, Homo sapien
ttgctgctgcagttttaaattagtg

SEQ ID NO: 643541 - DNA, 25 bp, Homo sapien
tgcagttttaaattagtgtctggca

SEQ ID NO: 643542 - DNA, 25 bp, Homo sapien
gtctggcacagaataaccaagtgtg

SEQ ID NO: 643543 - DNA, 25 bp, Homo sapien
agtgaaaatcagacccgttattaga

SEQ ID NO: 643544 - DNA, 25 bp, Homo sapien
gacccgttattagagtgaggcatgg

SEQ ID NO: 643545 - DNA, 25 bp, Homo sapien
tgcccaaacttggattatgatttaa

SEQ ID NO: 643546 - DNA, 25 bp, Homo sapien
gatattcttagacgttagtgttcat

SEQ ID NO: 643547 - DNA, 25 bp, Homo sapien
agtgttcatgattgaggtctgacca

SEQ ID NO: 643548 - DNA, 25 bp, Homo sapien
gattgaggtctgaccagtcacctgg

SEQ ID NO: 643549 - DNA, 25 bp, Homo sapien
gatagaggttgagttccggcttaaa

SEQ ID NO: 643550 - DNA, 25 bp, Homo sapien
gttttagtcaaaatctgtcaatgtt

SEQ ID NO: 643551 - DNA, 25 bp, Homo sapien
gttatcccagcaggtatttttcctc

SEQ ID NO: 643552 - DNA, 25 bp, Homo sapien
tttcctcctacttgttaggcatccc

SEQ ID NO: 643553 - DNA, 25 bp, Homo sapien
tgttaggcatccctctcttccattt

SEQ ID NO: 643554 - DNA, 25 bp, Homo sapien
ttttctcccctgacttagctttgtg

SEQ ID NO: 643555 - DNA, 25 bp, Homo sapien
gctttgtggcttatttagagggaac

SEQ ID NO: 643556 - DNA, 25 bp, Homo sapien
gggcgtcagacagaacacgcacata

SEQ ID NO: 643557 - DNA, 25 bp, Homo sapien
tgtgggagacatgccctatagatgt

SEQ ID NO: 643558 - DNA, 25 bp, Homo sapien
ggttcaggtataaatcggttcttct

SEQ ID NO: 643559 - DNA, 25 bp, Homo sapien
aaatcggttcttcttattcatcaag

SEQ ID NO: 643560 - DNA, 25 bp, Homo sapien
atcggttcttcttattcatcaaggg

SEQ ID NO: 643561 - DNA, 25 bp, Homo sapien
gggaaggcatttggtcgaagttcaa

SEQ ID NO: 643562 - DNA, 25 bp, Homo sapien
ttggtcgaagttcaaacctgcttgt

SEQ ID NO: 643563 - DNA, 25 bp, Homo sapien
tcgaagttcaaacctgcttgtccat

SEQ ID NO: 643564 - DNA, 25 bp, Homo sapien
aagttcaaacctgcttgtccatcag

SEQ ID NO: 643565 - DNA, 25 bp, Homo sapien
caaacctgcttgtccatcagagggt

SEQ ID NO: 643566 - DNA, 25 bp, Homo sapien
acctgcttgtccatcagagggtcca

SEQ ID NO: 643567 - DNA, 25 bp, Homo sapien
tgactcatctctccgattgcaaaga

SEQ ID NO: 643568 - DNA, 25 bp, Homo sapien
ttgcaaagagcaagacacgccactc

SEQ ID NO: 643569 - DNA, 25 bp, Homo sapien
ggcacagtatgcaatttaaggaaaa

SEQ ID NO: 643570 - DNA, 25 bp, Homo sapien
ccaaaggctacaggcgacctgctga

SEQ ID NO: 643571 - DNA, 25 bp, Homo sapien
tacaggcgacctgctgatcaggaaa

SEQ ID NO: 643572 - DNA, 25 bp, Homo sapien
tgatcaggaaagaatttcgctcttg

SEQ ID NO: 643573 - DNA, 25 bp, Homo sapien
cgctcttgtcaagtacatcatcctt

SEQ ID NO: 643574 - DNA, 25 bp, Homo sapien
aagtacatcatccttcatgaccact

SEQ ID NO: 643575 - DNA, 25 bp, Homo sapien
catccttcatgaccactaactttgt

SEQ ID NO: 643576 - DNA, 25 bp, Homo sapien
ttgttctgtttcctattttgccagg

SEQ ID NO: 643577 - DNA, 25 bp, Homo sapien
cctattttgccaggaagtatttcca

SEQ ID NO: 643578 - DNA, 25 bp, Homo sapien
atgagtcatggtgtgtcgcagtgga

SEQ ID NO: 643579 - DNA, 25 bp, Homo sapien
gtgtcgcagtggatagcacagtttc

SEQ ID NO: 643580 - DNA, 25 bp, Homo sapien
gtggatagcacagtttcgaataagt

SEQ ID NO: 643581 - DNA, 25 bp, Homo sapien
gtttcgaataagtgcaatattggca

SEQ ID NO: 643582 - DNA, 25 bp, Homo sapien
gcatataaacatgagggagactttg

SEQ ID NO: 643583 - DNA, 25 bp, Homo sapien
agggtagcatctttacatctttaca

SEQ ID NO: 643584 - DNA, 25 bp, Homo sapien
gcatctttacatctttacatgtcat

SEQ ID NO: 643585 - DNA, 25 bp, Homo sapien
tacatgtcattggcctggaataggg

SEQ ID NO: 643586 - DNA, 25 bp, Homo sapien
tcctgaagggtttgtcgtaagaaag

SEQ ID NO: 643587 - DNA, 25 bp, Homo sapien
gagaaagtgctcattgctgcaaggg

SEQ ID NO: 643588 - DNA, 25 bp, Homo sapien
gagcacagccgggttctgagaggca

SEQ ID NO: 643589 - DNA, 25 bp, Homo sapien
gtgccttcaaaactgatatcacaga

SEQ ID NO: 643590 - DNA, 25 bp, Homo sapien
atgcaactggcttcagataattctc

SEQ ID NO: 643591 - DNA, 25 bp, Homo sapien
ttctcaagaaacgtgaagagctctt

SEQ ID NO: 643592 - DNA, 25 bp, Homo sapien
gagttatccagaagcaaaggctctt

SEQ ID NO: 643593 - DNA, 25 bp, Homo sapien
ggaagttactccatctgcatgggtt

SEQ ID NO: 643594 - DNA, 25 bp, Homo sapien
atatgatgtgtgatttgggccaaga

SEQ ID NO: 643595 - DNA, 25 bp, Homo sapien
atattcatttatcagggcacccagc

SEQ ID NO: 643596 - DNA, 25 bp, Homo sapien
atcagggcacccagctaatattgct

SEQ ID NO: 643597 - DNA, 25 bp, Homo sapien
gctaatattgctgcaatggctggca

SEQ ID NO: 643598 - DNA, 25 bp, Homo sapien
atggctggcaggaaacaggtgatca

SEQ ID NO: 643599 - DNA, 25 bp, Homo sapien
caggtgatcaagagtgtcactgggt

SEQ ID NO: 643600 - DNA, 25 bp, Homo sapien
tggaccgcatcctccggcagagata

SEQ ID NO: 643601 - DNA, 25 bp, Homo sapien
atcctccggcagagatacttctcgg

SEQ ID NO: 643602 - DNA, 25 bp, Homo sapien
gcagagatacttctcggagcgcgaa

SEQ ID NO: 643603 - DNA, 25 bp, Homo sapien
ctgtgcaccatcaccaagaccatgg

SEQ ID NO: 643604 - DNA, 25 bp, Homo sapien
acctgtttagaggattcagctttgt

SEQ ID NO: 643605 - DNA, 25 bp, Homo sapien
cagctttgtggcctcaagcctgatc

SEQ ID NO: 643606 - DNA, 25 bp, Homo sapien
ttgtggcctcaagcctgatccagga

SEQ ID NO: 643607 - DNA, 25 bp, Homo sapien
gatccaggagccctcacagcaagat

SEQ ID NO: 643608 - DNA, 25 bp, Homo sapien
aggagccctcacagcaagatctgca

SEQ ID NO: 643609 - DNA, 25 bp, Homo sapien
agatctgcacaaagtcccagttcac

SEQ ID NO: 643610 - DNA, 25 bp, Homo sapien
tgcacaaagtcccagttcacccaat

SEQ ID NO: 643611 - DNA, 25 bp, Homo sapien
actattgctcacttatttaatgaaa

SEQ ID NO: 643612 - DNA, 25 bp, Homo sapien
tgaaacagcataaagtccagaccct

SEQ ID NO: 643613 - DNA, 25 bp, Homo sapien
gaaacagcataaagtccagacccta

SEQ ID NO: 643614 - DNA, 25 bp, Homo sapien
aaacagcataaagtccagaccctat

SEQ ID NO: 643615 - DNA, 25 bp, Homo sapien
aacagcataaagtccagaccctatt

SEQ ID NO: 643616 - DNA, 25 bp, Homo sapien
acagcataaagtccagaccctattt

SEQ ID NO: 643617 - DNA, 25 bp, Homo sapien
cagcataaagtccagaccctatttt

SEQ ID NO: 643618 - DNA, 25 bp, Homo sapien
agcataaagtccagaccctatttta

SEQ ID NO: 643619 - DNA, 25 bp, Homo sapien
gcataaagtccagaccctattttaa

SEQ ID NO: 643620 - DNA, 25 bp, Homo sapien
atgcagcgcttcctagcaggtcctt

SEQ ID NO: 643621 - DNA, 25 bp, Homo sapien
ctagcaggtccttggtctatgcagc

SEQ ID NO: 643622 - DNA, 25 bp, Homo sapien
gtctatgcagctttacggtgaaggt

SEQ ID NO: 643623 - DNA, 25 bp, Homo sapien
ttggacactcccagcctagaacttg

SEQ ID NO: 643624 - DNA, 25 bp, Homo sapien
cagcctagaacttggcccacagaaa

SEQ ID NO: 643625 - DNA, 25 bp, Homo sapien
gaaaggtttacatcagccctcgttg

SEQ ID NO: 643626 - DNA, 25 bp, Homo sapien
gccctcgttgtctgggagtggaaat

SEQ ID NO: 643627 - DNA, 25 bp, Homo sapien
aaatgctctcaacgtttcaaccaaa

SEQ ID NO: 643628 - DNA, 25 bp, Homo sapien
acattctgtctttaaggtgctagct

SEQ ID NO: 643629 - DNA, 25 bp, Homo sapien
ggtgctagctgttcattttccagac

SEQ ID NO: 643630 - DNA, 25 bp, Homo sapien
ttttccagacaaacccacaaataag

SEQ ID NO: 643631 - DNA, 25 bp, Homo sapien
taatacacatatacgcacacagaag

SEQ ID NO: 643632 - DNA, 25 bp, Homo sapien
gatttcagaatggttgagcagctca

SEQ ID NO: 643633 - DNA, 25 bp, Homo sapien
ggttgagcagctcatagcttttcta

SEQ ID NO: 643634 - DNA, 25 bp, Homo sapien
agctcatagcttttctaacactgaa

SEQ ID NO: 643635 - DNA, 25 bp, Homo sapien
taacactgaacttttctctctccaa

SEQ ID NO: 643636 - DNA, 25 bp, Homo sapien
aagtcccagtcgctcgtcaaaaact

SEQ ID NO: 643637 - DNA, 25 bp, Homo sapien
tcgctcgtcaaaaactgtgccatca

SEQ ID NO: 643638 - DNA, 25 bp, Homo sapien
aaaaactgtgccatcagcgcaagac

SEQ ID NO: 643639 - DNA, 25 bp, Homo sapien
gtgatttctgtggtattctaatttt

SEQ ID NO: 643640 - DNA, 25 bp, Homo sapien
aggagattggactctggcatcccac

SEQ ID NO: 643641 - DNA, 25 bp, Homo sapien
tggactctggcatcccacagcgtat

SEQ ID NO: 643642 - DNA, 25 bp, Homo sapien
ttggcctgtctgcacctctgtttcc

SEQ ID NO: 643643 - DNA, 25 bp, Homo sapien
gaatgatgagagaacccacctccca

SEQ ID NO: 643644 - DNA, 25 bp, Homo sapien
ggtcatcatggtttactcctgtaaa

SEQ ID NO: 643645 - DNA, 25 bp, Homo sapien
tagccccccactaaaaaacagcagt

SEQ ID NO: 643646 - DNA, 25 bp, Homo sapien
agcagtggctaataagccatgcctt

SEQ ID NO: 643647 - DNA, 25 bp, Homo sapien
tgggcttgcgttctattcaccatct

SEQ ID NO: 643648 - DNA, 25 bp, Homo sapien
tgcgttctattcaccatcttgatgg

SEQ ID NO: 643649 - DNA, 25 bp, Homo sapien
catatcaacctcttgtacatgtgta

SEQ ID NO: 643650 - DNA, 25 bp, Homo sapien
caacctcttgtacatgtgtaactat

SEQ ID NO: 643651 - DNA, 25 bp, Homo sapien
ttgtccttggtgagtaggaccatgt

SEQ ID NO: 643652 - DNA, 25 bp, Homo sapien
ttctacatgttctagaatgtctacg

SEQ ID NO: 643653 - DNA, 25 bp, Homo sapien
atgtacatttgcatgtacttgttga

SEQ ID NO: 643654 - DNA, 25 bp, Homo sapien
atgtacttgttgaactttgctagga

SEQ ID NO: 643655 - DNA, 25 bp, Homo sapien
gaactttgctaggaaggactcaatt

SEQ ID NO: 643656 - DNA, 25 bp, Homo sapien
gctaggaaggactcaatttttgaaa

SEQ ID NO: 643657 - DNA, 25 bp, Homo sapien
ttcactgtgggccttatgaggcaat

SEQ ID NO: 643658 - DNA, 25 bp, Homo sapien
tgggccttatgaggcaatctactgc

SEQ ID NO: 643659 - DNA, 25 bp, Homo sapien
gaggcaatctactgcaatggaaaaa

SEQ ID NO: 643660 - DNA, 25 bp, Homo sapien
atctaacttcaattattttgccaag

SEQ ID NO: 643661 - DNA, 25 bp, Homo sapien
ctctctgtgtctgtggttagaattt

SEQ ID NO: 643662 - DNA, 25 bp, Homo sapien
gaaaataacaatgctctgcttaaag

SEQ ID NO: 643663 - DNA, 25 bp, Homo sapien
tgcttaaagtaagagtcacagtcag

SEQ ID NO: 643664 - DNA, 25 bp, Homo sapien
atgtatggcttgaatgtgtccctcc

SEQ ID NO: 643665 - DNA, 25 bp, Homo sapien
ttggaaacttcatcctcccatgcat

SEQ ID NO: 643666 - DNA, 25 bp, Homo sapien
tggaaacttcatcctcccatgcatg

SEQ ID NO: 643667 - DNA, 25 bp, Homo sapien
ggaaacttcatcctcccatgcatgt

SEQ ID NO: 643668 - DNA, 25 bp, Homo sapien
gaaacttcatcctcccatgcatgtt

SEQ ID NO: 643669 - DNA, 25 bp, Homo sapien
ccatgcatgttgaaagtgggacttt

SEQ ID NO: 643670 - DNA, 25 bp, Homo sapien
tgaacaaatatgctgttaccggaat

SEQ ID NO: 643671 - DNA, 25 bp, Homo sapien
gaacaaatatgctgttaccggaatt

SEQ ID NO: 643672 - DNA, 25 bp, Homo sapien
aacaaatatgctgttaccggaattg

SEQ ID NO: 643673 - DNA, 25 bp, Homo sapien
aaatatgctgttaccggaattgcat

SEQ ID NO: 643674 - DNA, 25 bp, Homo sapien
aatatgctgttaccggaattgcatt

SEQ ID NO: 643675 - DNA, 25 bp, Homo sapien
cagccatgctctttcacgggatctc

SEQ ID NO: 643676 - DNA, 25 bp, Homo sapien
agccatgctctttcacgggatctcc

SEQ ID NO: 643677 - DNA, 25 bp, Homo sapien
ccatgctctttcacgggatctccgg

SEQ ID NO: 643678 - DNA, 25 bp, Homo sapien
gctctttcacgggatctccggaggc

SEQ ID NO: 643679 - DNA, 25 bp, Homo sapien
tctttcacgggatctccggaggcca

SEQ ID NO: 643680 - DNA, 25 bp, Homo sapien
tttcacgggatctccggaggccaca

SEQ ID NO: 643681 - DNA, 25 bp, Homo sapien
tccggaggccacatccaaggcatca

SEQ ID NO: 643682 - DNA, 25 bp, Homo sapien
cggaggccacatccaaggcatcatg

SEQ ID NO: 643683 - DNA, 25 bp, Homo sapien
ggaggccacatccaaggcatcatgg

SEQ ID NO: 643684 - DNA, 25 bp, Homo sapien
gaggccacatccaaggcatcatgga

SEQ ID NO: 643685 - DNA, 25 bp, Homo sapien
ggccacatccaaggcatcatggagg

SEQ ID NO: 643686 - DNA, 25 bp, Homo sapien
gttgagagcatgagaccaaacccaa

SEQ ID NO: 643687 - DNA, 25 bp, Homo sapien
aaacccaacctctcagagctaaggt

SEQ ID NO: 643688 - DNA, 25 bp, Homo sapien
ggtatagatcatcactcatgccccg

SEQ ID NO: 643689 - DNA, 25 bp, Homo sapien
actcatgccccgaaggtaaagaagg

SEQ ID NO: 643690 - DNA, 25 bp, Homo sapien
ggccaatggtgtcccacctcaagga

SEQ ID NO: 643691 - DNA, 25 bp, Homo sapien
cacagggcttgtccccaaagtgcta

SEQ ID NO: 643692 - DNA, 25 bp, Homo sapien
aaagtgctagggacccatggcttcc

SEQ ID NO: 643693 - DNA, 25 bp, Homo sapien
ctcttgggatggcatgaggcttctc

SEQ ID NO: 643694 - DNA, 25 bp, Homo sapien
aggcttctccctagatctctgagag

SEQ ID NO: 643695 - DNA, 25 bp, Homo sapien
tctgagaggttgtctagggtcacac

SEQ ID NO: 643696 - DNA, 25 bp, Homo sapien
gggtcacacgacagaacaggcttca

SEQ ID NO: 643697 - DNA, 25 bp, Homo sapien
attgttaccaacctgccagcacaac

SEQ ID NO: 643698 - DNA, 25 bp, Homo sapien
aacctgccagcacaacttatgtttg

SEQ ID NO: 643699 - DNA, 25 bp, Homo sapien
agcacaacttatgtttgtcccattt

SEQ ID NO: 643700 - DNA, 25 bp, Homo sapien
gtttgtcccatttcttgagagttta

SEQ ID NO: 643701 - DNA, 25 bp, Homo sapien
gtgttactttaagatgtctgcaagc

SEQ ID NO: 643702 - DNA, 25 bp, Homo sapien
gtctgcaagcattctgcaggactac

SEQ ID NO: 643703 - DNA, 25 bp, Homo sapien
gaaaatgtcattgtgtcctcaagga

SEQ ID NO: 643704 - DNA, 25 bp, Homo sapien
gtcattgtgtcctcaaggatctcat

SEQ ID NO: 643705 - DNA, 25 bp, Homo sapien
gatacaaaacttaagatcactttag

SEQ ID NO: 643706 - DNA, 25 bp, Homo sapien
atcactttagccctgttgtgagtca

SEQ ID NO: 643707 - DNA, 25 bp, Homo sapien
aaactaatataaaggctgctgctca

SEQ ID NO: 643708 - DNA, 25 bp, Homo sapien
actagcctcttccatcggtctgcat

SEQ ID NO: 643709 - DNA, 25 bp, Homo sapien
ctcttccatcggtctgcatgccggg

SEQ ID NO: 643710 - DNA, 25 bp, Homo sapien
gtgagagtgggagccgggtccgaat

SEQ ID NO: 643711 - DNA, 25 bp, Homo sapien
gagccgggtccgaatgctgagttct

SEQ ID NO: 643712 - DNA, 25 bp, Homo sapien
gggtccgaatgctgagttctcctcg

SEQ ID NO: 643713 - DNA, 25 bp, Homo sapien
taatgcccctggctcgacccaaagc

SEQ ID NO: 643714 - DNA, 25 bp, Homo sapien
gggtgacccactgcctgagttcgaa

SEQ ID NO: 643715 - DNA, 25 bp, Homo sapien
gtgacccactgcctgagttcgaatc

SEQ ID NO: 643716 - DNA, 25 bp, Homo sapien
cactgcctgagttcgaatccaagct

SEQ ID NO: 643717 - DNA, 25 bp, Homo sapien
tgcctgagttcgaatccaagctcca

SEQ ID NO: 643718 - DNA, 25 bp, Homo sapien
tgagttcgaatccaagctccaccca

SEQ ID NO: 643719 - DNA, 25 bp, Homo sapien
atataaaagaagttagtggccaggc

SEQ ID NO: 643720 - DNA, 25 bp, Homo sapien
tataaaagaagttagtggccaggct

SEQ ID NO: 643721 - DNA, 25 bp, Homo sapien
ataaaagaagttagtggccaggctc

SEQ ID NO: 643722 - DNA, 25 bp, Homo sapien
taaaagaagttagtggccaggctca

SEQ ID NO: 643723 - DNA, 25 bp, Homo sapien
aaaagaagttagtggccaggctcag

SEQ ID NO: 643724 - DNA, 25 bp, Homo sapien
aaagaagttagtggccaggctcagt

SEQ ID NO: 643725 - DNA, 25 bp, Homo sapien
aagaagttagtggccaggctcagtg

SEQ ID NO: 643726 - DNA, 25 bp, Homo sapien
agaagttagtggccaggctcagtgg

SEQ ID NO: 643727 - DNA, 25 bp, Homo sapien
gaagttagtggccaggctcagtggc

SEQ ID NO: 643728 - DNA, 25 bp, Homo sapien
aagttagtggccaggctcagtggct

SEQ ID NO: 643729 - DNA, 25 bp, Homo sapien
agttagtggccaggctcagtggctc

SEQ ID NO: 643730 - DNA, 25 bp, Homo sapien
gggattaacgatttaggctatagct

SEQ ID NO: 643731 - DNA, 25 bp, Homo sapien
attaacgatttaggctatagctgta

SEQ ID NO: 643732 - DNA, 25 bp, Homo sapien
cgatttaggctatagctgtagctat

SEQ ID NO: 643733 - DNA, 25 bp, Homo sapien
gtagctataaaaacaagagcacagt

SEQ ID NO: 643734 - DNA, 25 bp, Homo sapien
acagtagaatgctgtgcagccacct

SEQ ID NO: 643735 - DNA, 25 bp, Homo sapien
gcagccacctggaacaaatctatat

SEQ ID NO: 643736 - DNA, 25 bp, Homo sapien
cagccacctggaacaaatctatatg

SEQ ID NO: 643737 - DNA, 25 bp, Homo sapien
gccacctggaacaaatctatatgaa

SEQ ID NO: 643738 - DNA, 25 bp, Homo sapien
acctggaacaaatctatatgaaaag

SEQ ID NO: 643739 - DNA, 25 bp, Homo sapien
gagacagtagtctatatagaataca

SEQ ID NO: 643740 - DNA, 25 bp, Homo sapien
cagctttatactgttttaactattt

SEQ ID NO: 643741 - DNA, 25 bp, Homo sapien
gggaggagtcgtatttcagccccac

SEQ ID NO: 643742 - DNA, 25 bp, Homo sapien
aaagcgggcggctggtcaggcccag

SEQ ID NO: 643743 - DNA, 25 bp, Homo sapien
gctgcctgactcagacaaagccagg

SEQ ID NO: 643744 - DNA, 25 bp, Homo sapien
tgactcagacaaagccaggccgctc

SEQ ID NO: 643745 - DNA, 25 bp, Homo sapien
tgttgtggcctctgtgattttatat

SEQ ID NO: 643746 - DNA, 25 bp, Homo sapien
ggcctctgtgattttatatggtttg

SEQ ID NO: 643747 - DNA, 25 bp, Homo sapien
atatggtttggcctgtgacatcaga

SEQ ID NO: 643748 - DNA, 25 bp, Homo sapien
gtttggcctgtgacatcagacacca

SEQ ID NO: 643749 - DNA, 25 bp, Homo sapien
gtgacatcagacaccacgcgaccat

SEQ ID NO: 643750 - DNA, 25 bp, Homo sapien
gacaccacgcgaccatggtaaccaa

SEQ ID NO: 643751 - DNA, 25 bp, Homo sapien
cacgcgaccatggtaaccaaagtat

SEQ ID NO: 643752 - DNA, 25 bp, Homo sapien
gaggcgaccacggagtcgtccataa

SEQ ID NO: 643753 - DNA, 25 bp, Homo sapien
ggagtcgtccataagcctccagcct

SEQ ID NO: 643754 - DNA, 25 bp, Homo sapien
ctgcagcccgagaaaatgctggcaa

SEQ ID NO: 643755 - DNA, 25 bp, Homo sapien
gggctgctgatctgcggctccctag

SEQ ID NO: 643756 - DNA, 25 bp, Homo sapien
atctgcggctccctagcactgataa

SEQ ID NO: 643757 - DNA, 25 bp, Homo sapien
tagcactgataaccggccttacctt

SEQ ID NO: 643758 - DNA, 25 bp, Homo sapien
taaccggccttacctttgcgatatt

SEQ ID NO: 643759 - DNA, 25 bp, Homo sapien
ggtgatcgatttcatcaaatcctca

SEQ ID NO: 643760 - DNA, 25 bp, Homo sapien
aaatcctcactgtttggccttggca

SEQ ID NO: 643761 - DNA, 25 bp, Homo sapien
ggcagtggagttgccgagcaaaccc

SEQ ID NO: 643762 - DNA, 25 bp, Homo sapien
aaaggccacagattcgaggcaacaa

SEQ ID NO: 643763 - DNA, 25 bp, Homo sapien
aagctgccatgtaatcaactgccct

SEQ ID NO: 643764 - DNA, 25 bp, Homo sapien
gccctaataccaccaggttgctgaa

SEQ ID NO: 643765 - DNA, 25 bp, Homo sapien
tgaaaccatgttcaggagctctgtt

SEQ ID NO: 643766 - DNA, 25 bp, Homo sapien
gagctctgtttgtggtcctagctga

SEQ ID NO: 643767 - DNA, 25 bp, Homo sapien
accagccaatgtcaccagacatgta

SEQ ID NO: 643768 - DNA, 25 bp, Homo sapien
gtgaagccatcctgggatctctaga

SEQ ID NO: 643769 - DNA, 25 bp, Homo sapien
agcacacctacaggctgattaccat

SEQ ID NO: 643770 - DNA, 25 bp, Homo sapien
taccatggagtgacctccgttggca

SEQ ID NO: 643771 - DNA, 25 bp, Homo sapien
gttggcaccacattcatcaagagaa

SEQ ID NO: 643772 - DNA, 25 bp, Homo sapien
gagaatcaaccagctgagtcctgca

SEQ ID NO: 643773 - DNA, 25 bp, Homo sapien
tgagtcctgcaaatccaaatccaca

SEQ ID NO: 643774 - DNA, 25 bp, Homo sapien
tattgttgatcgctctgctattaat

SEQ ID NO: 643775 - DNA, 25 bp, Homo sapien
gttgatcgctctgctattaatatga

SEQ ID NO: 643776 - DNA, 25 bp, Homo sapien
gatcgctctgctattaatatgaaaa

SEQ ID NO: 643777 - DNA, 25 bp, Homo sapien
cgctctgctattaatatgaaaattg

SEQ ID NO: 643778 - DNA, 25 bp, Homo sapien
caatgaaatatttgcctgtgaaata

SEQ ID NO: 643779 - DNA, 25 bp, Homo sapien
atttgcctgtgaaataagctcactt

SEQ ID NO: 643780 - DNA, 25 bp, Homo sapien
gcctgtgaaataagctcacttaatt

SEQ ID NO: 643781 - DNA, 25 bp, Homo sapien
aacgagtaagatttctcttggctgt

SEQ ID NO: 643782 - DNA, 25 bp, Homo sapien
tttctcttggctgtataattatcta

SEQ ID NO: 643783 - DNA, 25 bp, Homo sapien
gtataattatctaacaactgcattt

SEQ ID NO: 643784 - DNA, 25 bp, Homo sapien
atctaacaactgcatttgttttcag

SEQ ID NO: 643785 - DNA, 25 bp, Homo sapien
atttttatacttgggagtgctcctt

SEQ ID NO: 643786 - DNA, 25 bp, Homo sapien
agtgctccttgcacagagctgtcat

SEQ ID NO: 643787 - DNA, 25 bp, Homo sapien
gagctgtcatttgccagtgagagcc

SEQ ID NO: 643788 - DNA, 25 bp, Homo sapien
tttgccagtgagagcctccgacggg

SEQ ID NO: 643789 - DNA, 25 bp, Homo sapien
gggcagctctgaaattatggatatt

SEQ ID NO: 643790 - DNA, 25 bp, Homo sapien
acaccactttgttatgaagacctta

SEQ ID NO: 643791 - DNA, 25 bp, Homo sapien
tgaagaccttacaaacctcttctta

SEQ ID NO: 643792 - DNA, 25 bp, Homo sapien
acaaacctcttcttaagacattctt

SEQ ID NO: 643793 - DNA, 25 bp, Homo sapien
agacattcttactctgatccaggca

SEQ ID NO: 643794 - DNA, 25 bp, Homo sapien
ttactctgatccaggcaaaaacact

SEQ ID NO: 643795 - DNA, 25 bp, Homo sapien
gtaaatgactctttcctgacataaa

SEQ ID NO: 643796 - DNA, 25 bp, Homo sapien
tgacctccagacctctggtgatccg

SEQ ID NO: 643797 - DNA, 25 bp, Homo sapien
accgcggccggccagtgtttattct

SEQ ID NO: 643798 - DNA, 25 bp, Homo sapien
cgcggccggccagtgtttattcttc

SEQ ID NO: 643799 - DNA, 25 bp, Homo sapien
gcggccggccagtgtttattcttcc

SEQ ID NO: 643800 - DNA, 25 bp, Homo sapien
ggccggccagtgtttattcttcctt

SEQ ID NO: 643801 - DNA, 25 bp, Homo sapien
ttcctgtcttcctagaatcatcttg

SEQ ID NO: 643802 - DNA, 25 bp, Homo sapien
tcctgtcttcctagaatcatcttgc

SEQ ID NO: 643803 - DNA, 25 bp, Homo sapien
cctgtcttcctagaatcatcttgct

SEQ ID NO: 643804 - DNA, 25 bp, Homo sapien
ctgtcttcctagaatcatcttgctg

SEQ ID NO: 643805 - DNA, 25 bp, Homo sapien
tcttcctagaatcatcttgctgctt

SEQ ID NO: 643806 - DNA, 25 bp, Homo sapien
cttcctagaatcatcttgctgcttc

SEQ ID NO: 643807 - DNA, 25 bp, Homo sapien
catctctagcttttcctcaacttag

SEQ ID NO: 643808 - DNA, 25 bp, Homo sapien
atctctagcttttcctcaacttagg

SEQ ID NO: 643809 - DNA, 25 bp, Homo sapien
tctctagcttttcctcaacttaggc

SEQ ID NO: 643810 - DNA, 25 bp, Homo sapien
tctagcttttcctcaacttaggctt

SEQ ID NO: 643811 - DNA, 25 bp, Homo sapien
tagcttttcctcaacttaggcttta

SEQ ID NO: 643812 - DNA, 25 bp, Homo sapien
agcttttcctcaacttaggctttat

SEQ ID NO: 643813 - DNA, 25 bp, Homo sapien
gcttttcctcaacttaggctttata

SEQ ID NO: 643814 - DNA, 25 bp, Homo sapien
tcaacttaggctttataaacccttg

SEQ ID NO: 643815 - DNA, 25 bp, Homo sapien
ttataaacccttgcatcaaaaaata

SEQ ID NO: 643816 - DNA, 25 bp, Homo sapien
attatggcatgtaacatgctggcaa

SEQ ID NO: 643817 - DNA, 25 bp, Homo sapien
gaaagcaagggcaggtctctgtgcc

SEQ ID NO: 643818 - DNA, 25 bp, Homo sapien
acgggtttcagctgcggggatccac

SEQ ID NO: 643819 - DNA, 25 bp, Homo sapien
gggatccacttctatgcagattttc

SEQ ID NO: 643820 - DNA, 25 bp, Homo sapien
gatccacttctatgcagattttctt

SEQ ID NO: 643821 - DNA, 25 bp, Homo sapien
tgccacccctgagatgctagaccac

SEQ ID NO: 643822 - DNA, 25 bp, Homo sapien
ttctcctactcacaggaagacggca

SEQ ID NO: 643823 - DNA, 25 bp, Homo sapien
gacggcaaggcctttatgatgacct

SEQ ID NO: 643824 - DNA, 25 bp, Homo sapien
ggcctttatgatgacctgcttctac

SEQ ID NO: 643825 - DNA, 25 bp, Homo sapien
gatgacctgcttctacttaatgtaa

SEQ ID NO: 643826 - DNA, 25 bp, Homo sapien
gacctgcttctacttaatgtaaata

SEQ ID NO: 643827 - DNA, 25 bp, Homo sapien
cttctctctagttccctttattgta

SEQ ID NO: 643828 - DNA, 25 bp, Homo sapien
agttccctttattgtaggaatacag

SEQ ID NO: 643829 - DNA, 25 bp, Homo sapien
ctttcaattacattaggagaggcac

SEQ ID NO: 643830 - DNA, 25 bp, Homo sapien
ttacattaggagaggcacggtggct

SEQ ID NO: 643831 - DNA, 25 bp, Homo sapien
aggagttttagatcaacccagacaa

SEQ ID NO: 643832 - DNA, 25 bp, Homo sapien
gagttttagatcaacccagacaaca

SEQ ID NO: 643833 - DNA, 25 bp, Homo sapien
ggtgcacatgtgtagtcccgactaa

SEQ ID NO: 643834 - DNA, 25 bp, Homo sapien
gcacatgtgtagtcccgactaatga

SEQ ID NO: 643835 - DNA, 25 bp, Homo sapien
tgtagtcccgactaatgaggtggct

SEQ ID NO: 643836 - DNA, 25 bp, Homo sapien
agtcccgactaatgaggtggctgag

SEQ ID NO: 643837 - DNA, 25 bp, Homo sapien
tcccgactaatgaggtggctgaggc

SEQ ID NO: 643838 - DNA, 25 bp, Homo sapien
gaggcaagaggctcatttgagccaa

SEQ ID NO: 643839 - DNA, 25 bp, Homo sapien
agaggctcatttgagccaaggaggt

SEQ ID NO: 643840 - DNA, 25 bp, Homo sapien
tttttaatgacacatttcccagagt

SEQ ID NO: 643841 - DNA, 25 bp, Homo sapien
ttactgccctaggtaagctgcctct

SEQ ID NO: 643842 - DNA, 25 bp, Homo sapien
tgccctaggtaagctgcctctcaga

SEQ ID NO: 643843 - DNA, 25 bp, Homo sapien
agctttacctgcttcctagacctgt

SEQ ID NO: 643844 - DNA, 25 bp, Homo sapien
tgcttcctagacctgtatcctaaca

SEQ ID NO: 643845 - DNA, 25 bp, Homo sapien
tagacctgtatcctaacactcatcc

SEQ ID NO: 643846 - DNA, 25 bp, Homo sapien
aacactcatccccatagatactaag

SEQ ID NO: 643847 - DNA, 25 bp, Homo sapien
catccccatagatactaagctgtaa

SEQ ID NO: 643848 - DNA, 25 bp, Homo sapien
taaatgctaatgtggaatttcatcc

SEQ ID NO: 643849 - DNA, 25 bp, Homo sapien
gattgcagactagtaaggttagcta

SEQ ID NO: 643850 - DNA, 25 bp, Homo sapien
agctagacttttaaacccttgctct

SEQ ID NO: 643851 - DNA, 25 bp, Homo sapien
gccgagactcgccactgcatactcc

SEQ ID NO: 643852 - DNA, 25 bp, Homo sapien
catgattggagagggagcatctgca

SEQ ID NO: 643853 - DNA, 25 bp, Homo sapien
tgcaaagatggagccctgcagtgcc

SEQ ID NO: 643854 - DNA, 25 bp, Homo sapien
ccctgcagtgcctgcgttagaaaag

SEQ ID NO: 643855 - DNA, 25 bp, Homo sapien
tgcagtgcctgcgttagaaaagcat

SEQ ID NO: 643856 - DNA, 25 bp, Homo sapien
gcagtgcctgcgttagaaaagcatt

SEQ ID NO: 643857 - DNA, 25 bp, Homo sapien
cagtgcctgcgttagaaaagcattc

SEQ ID NO: 643858 - DNA, 25 bp, Homo sapien
agtgcctgcgttagaaaagcattct

SEQ ID NO: 643859 - DNA, 25 bp, Homo sapien
gtgcctgcgttagaaaagcattcta

SEQ ID NO: 643860 - DNA, 25 bp, Homo sapien
gcctgcgttagaaaagcattctaag

SEQ ID NO: 643861 - DNA, 25 bp, Homo sapien
aaagcattctaaggctgaggtgggc

SEQ ID NO: 643862 - DNA, 25 bp, Homo sapien
tggaatccattcaaaatctgtactg

SEQ ID NO: 643863 - DNA, 25 bp, Homo sapien
agcattgattgtatcgcactcctgt

SEQ ID NO: 643864 - DNA, 25 bp, Homo sapien
tgtgtctaggccctttgcatatgca

SEQ ID NO: 643865 - DNA, 25 bp, Homo sapien
ttgcatatgcactcactcattcaac

SEQ ID NO: 643866 - DNA, 25 bp, Homo sapien
attcaacagactttgaccctgcctg

SEQ ID NO: 643867 - DNA, 25 bp, Homo sapien
tgtgctaagggcctgcgatcccaag

SEQ ID NO: 643868 - DNA, 25 bp, Homo sapien
gcgatcccaagataaatccctgtct

SEQ ID NO: 643869 - DNA, 25 bp, Homo sapien
tgtctccaagccaagcatgtgactt

SEQ ID NO: 643870 - DNA, 25 bp, Homo sapien
gtaacttggtgaggaacgtcttatt

SEQ ID NO: 643871 - DNA, 25 bp, Homo sapien
ttttatctctttaccacatcaacag

SEQ ID NO: 643872 - DNA, 25 bp, Homo sapien
acagaaacacttccccttccaaatg

SEQ ID NO: 643873 - DNA, 25 bp, Homo sapien
caagttacccttaatttaatacatg

SEQ ID NO: 643874 - DNA, 25 bp, Homo sapien
tttaatacatgatcttagcagcagt

SEQ ID NO: 643875 - DNA, 25 bp, Homo sapien
acatgatcttagcagcagtttcaag

SEQ ID NO: 643876 - DNA, 25 bp, Homo sapien
gcagtttcaagtgagttctttgttt

SEQ ID NO: 643877 - DNA, 25 bp, Homo sapien
ggccaggaagcttgaactcttgtct

SEQ ID NO: 643878 - DNA, 25 bp, Homo sapien
ccaggaagcttgaactcttgtctca

SEQ ID NO: 643879 - DNA, 25 bp, Homo sapien
tgtgggcgactgcacccggctacaa

SEQ ID NO: 643880 - DNA, 25 bp, Homo sapien
tgcacccggctacaagtgaattttt

SEQ ID NO: 643881 - DNA, 25 bp, Homo sapien
agaagaggcccttgctaaattgtat

SEQ ID NO: 643882 - DNA, 25 bp, Homo sapien
gaggcccttgctaaattgtattcca

SEQ ID NO: 643883 - DNA, 25 bp, Homo sapien
gcccttgctaaattgtattccaaga

SEQ ID NO: 643884 - DNA, 25 bp, Homo sapien
ataggcgattctagcctttctctgc

SEQ ID NO: 643885 - DNA, 25 bp, Homo sapien
ctcacactctttaccgtgcagataa

SEQ ID NO: 643886 - DNA, 25 bp, Homo sapien
tttaccgtgcagataattcacagca

SEQ ID NO: 643887 - DNA, 25 bp, Homo sapien
tcctcatctatagccatgaaaataa

SEQ ID NO: 643888 - DNA, 25 bp, Homo sapien
gttatttctggtaaaggttcaattg

SEQ ID NO: 643889 - DNA, 25 bp, Homo sapien
aagtttcatgtctttctgcatcatt

SEQ ID NO: 643890 - DNA, 25 bp, Homo sapien
gtctttctgcatcatttcaactatt

SEQ ID NO: 643891 - DNA, 25 bp, Homo sapien
gcatcatttcaactattccttacta

SEQ ID NO: 643892 - DNA, 25 bp, Homo sapien
ttccttactacatataaatctgcac

SEQ ID NO: 643893 - DNA, 25 bp, Homo sapien
aaatctgcacttgttaacttctatt

SEQ ID NO: 643894 - DNA, 25 bp, Homo sapien
aattgattgtggcatctgcctgctt

SEQ ID NO: 643895 - DNA, 25 bp, Homo sapien
ctccccttgactcactaattgaaaa

SEQ ID NO: 643896 - DNA, 25 bp, Homo sapien
tccccttgactcactaattgaaaag

SEQ ID NO: 643897 - DNA, 25 bp, Homo sapien
ccccttgactcactaattgaaaagc

SEQ ID NO: 643898 - DNA, 25 bp, Homo sapien
cccttgactcactaattgaaaagca

SEQ ID NO: 643899 - DNA, 25 bp, Homo sapien
ccttgactcactaattgaaaagcaa

SEQ ID NO: 643900 - DNA, 25 bp, Homo sapien
cttgactcactaattgaaaagcaaa

SEQ ID NO: 643901 - DNA, 25 bp, Homo sapien
ttgactcactaattgaaaagcaaaa

SEQ ID NO: 643902 - DNA, 25 bp, Homo sapien
tgactcactaattgaaaagcaaaaa

SEQ ID NO: 643903 - DNA, 25 bp, Homo sapien
catgttcacaccactataccccagc

SEQ ID NO: 643904 - DNA, 25 bp, Homo sapien
tgttcacaccactataccccagcct

SEQ ID NO: 643905 - DNA, 25 bp, Homo sapien
ttcacaccactataccccagcctag

SEQ ID NO: 643906 - DNA, 25 bp, Homo sapien
gatgtcagcaagaattccccataca

SEQ ID NO: 643907 - DNA, 25 bp, Homo sapien
atgtcagcaagaattccccatacag

SEQ ID NO: 643908 - DNA, 25 bp, Homo sapien
tgtcagcaagaattccccatacagc

SEQ ID NO: 643909 - DNA, 25 bp, Homo sapien
gtcagcaagaattccccatacagct

SEQ ID NO: 643910 - DNA, 25 bp, Homo sapien
tcagcaagaattccccatacagctc

SEQ ID NO: 643911 - DNA, 25 bp, Homo sapien
gcaagaattccccatacagctcaca

SEQ ID NO: 643912 - DNA, 25 bp, Homo sapien
aagaattccccatacagctcacagc

SEQ ID NO: 643913 - DNA, 25 bp, Homo sapien
atacagctcacagccctaccccgag

SEQ ID NO: 643914 - DNA, 25 bp, Homo sapien
gagcacgcctccctcttgggtatgc

SEQ ID NO: 643915 - DNA, 25 bp, Homo sapien
tccctcttgggtatgctctctgcag

SEQ ID NO: 643916 - DNA, 25 bp, Homo sapien
cctcttgggtatgctctctgcaggc

SEQ ID NO: 643917 - DNA, 25 bp, Homo sapien
gtctgctgcactgtgctggaatttt

SEQ ID NO: 643918 - DNA, 25 bp, Homo sapien
gctgcactgtgctggaattttgaac

SEQ ID NO: 643919 - DNA, 25 bp, Homo sapien
tgcactgtgctggaattttgaactc

SEQ ID NO: 643920 - DNA, 25 bp, Homo sapien
ctgtgctggaattttgaactcccca

SEQ ID NO: 643921 - DNA, 25 bp, Homo sapien
gtgctggaattttgaactccccaga

SEQ ID NO: 643922 - DNA, 25 bp, Homo sapien
ctggaattttgaactccccagagta

SEQ ID NO: 643923 - DNA, 25 bp, Homo sapien
caacatcttctcaagggtatacaag

SEQ ID NO: 643924 - DNA, 25 bp, Homo sapien
ttctcaagggtatacaagtcatcag

SEQ ID NO: 643925 - DNA, 25 bp, Homo sapien
ctcaagggtatacaagtcatcagat

SEQ ID NO: 643926 - DNA, 25 bp, Homo sapien
ggtatcaatgaacgaacaaataaat

SEQ ID NO: 643927 - DNA, 25 bp, Homo sapien
gaatttacttctttcagatttactt

SEQ ID NO: 643928 - DNA, 25 bp, Homo sapien
gtcatcagggcaatacacgggcttc

SEQ ID NO: 643929 - DNA, 25 bp, Homo sapien
atacacgggcttcaatgaccacaag

SEQ ID NO: 643930 - DNA, 25 bp, Homo sapien
ttcaatgaccacaagccactggacc

SEQ ID NO: 643931 - DNA, 25 bp, Homo sapien
ggacccagagacaattgctcaggat

SEQ ID NO: 643932 - DNA, 25 bp, Homo sapien
acacagctttgaatgaactccgaga

SEQ ID NO: 643933 - DNA, 25 bp, Homo sapien
agagcacagcaaagcatgcccctga

SEQ ID NO: 643934 - DNA, 25 bp, Homo sapien
aaagcatgcccctgatgtggtgctg

SEQ ID NO: 643935 - DNA, 25 bp, Homo sapien
gagcaagtgaaaaactctcccaccc

SEQ ID NO: 643936 - DNA, 25 bp, Homo sapien
tttgcacaacgttgccctcaggagc

SEQ ID NO: 643937 - DNA, 25 bp, Homo sapien
ggagctccgagcctcagattcgacg

SEQ ID NO: 643938 - DNA, 25 bp, Homo sapien
agattcgacgtagcacgagctcctc

SEQ ID NO: 643939 - DNA, 25 bp, Homo sapien
attccctcatgattcctctgagtga

SEQ ID NO: 643940 - DNA, 25 bp, Homo sapien
gacaatgtgatgttggccgactgtg

SEQ ID NO: 643941 - DNA, 25 bp, Homo sapien
gccgactgtgtcttcttcagaatat

SEQ ID NO: 643942 - DNA, 25 bp, Homo sapien
atacacttgaggtctccaggagcct

SEQ ID NO: 643943 - DNA, 25 bp, Homo sapien
aggagcctccaattacattattttc

SEQ ID NO: 643944 - DNA, 25 bp, Homo sapien
tattttcctggctcatacagtgaca

SEQ ID NO: 643945 - DNA, 25 bp, Homo sapien
attcttatcctggattcctcgttac

SEQ ID NO: 643946 - DNA, 25 bp, Homo sapien
ctcgttactgagacttttcttgcct

SEQ ID NO: 643947 - DNA, 25 bp, Homo sapien
tatgatttattctaggacttcctcc

SEQ ID NO: 643948 - DNA, 25 bp, Homo sapien
ggacttcctccaacaggttatactt

SEQ ID NO: 643949 - DNA, 25 bp, Homo sapien
taactgtctacctcagtctctggaa

SEQ ID NO: 643950 - DNA, 25 bp, Homo sapien
cctggttctcagtccacatggaaga

SEQ ID NO: 643951 - DNA, 25 bp, Homo sapien
ggttctcagtccacatggaagaata

SEQ ID NO: 643952 - DNA, 25 bp, Homo sapien
atccatgagagggtatgcagtcttc

SEQ ID NO: 643953 - DNA, 25 bp, Homo sapien
gagggtatgcagtcttctgacatcc

SEQ ID NO: 643954 - DNA, 25 bp, Homo sapien
gggtatgcagtcttctgacatccca

SEQ ID NO: 643955 - DNA, 25 bp, Homo sapien
ttctgacatcccacagagcacagct

SEQ ID NO: 643956 - DNA, 25 bp, Homo sapien
attgaaagaccaagctaccctctga

SEQ ID NO: 643957 - DNA, 25 bp, Homo sapien
gaaagaccaagctaccctctgaaga

SEQ ID NO: 643958 - DNA, 25 bp, Homo sapien
gaccaagctaccctctgaagaaata

SEQ ID NO: 643959 - DNA, 25 bp, Homo sapien
gctaccctctgaagaaatactcact

SEQ ID NO: 643960 - DNA, 25 bp, Homo sapien
ctctgaagaaatactcactgcatga

SEQ ID NO: 643961 - DNA, 25 bp, Homo sapien
ttcctcccacagagaattgaagttt

SEQ ID NO: 643962 - DNA, 25 bp, Homo sapien
aattgaagtttccacctttgcttgc

SEQ ID NO: 643963 - DNA, 25 bp, Homo sapien
cctttgcttgcccttttaggctggg

SEQ ID NO: 643964 - DNA, 25 bp, Homo sapien
tgggatctcccctctgactttgcct

SEQ ID NO: 643965 - DNA, 25 bp, Homo sapien
gcctctttgaatgtcagtttcccca

SEQ ID NO: 643966 - DNA, 25 bp, Homo sapien
tccccacctatcaaatacaggcatg

SEQ ID NO: 643967 - DNA, 25 bp, Homo sapien
gagctctcctgtgacagagggatct

SEQ ID NO: 643968 - DNA, 25 bp, Homo sapien
gatctgatcacgcagagagagccta

SEQ ID NO: 643969 - DNA, 25 bp, Homo sapien
agagagagcctatggcccaaccatg

SEQ ID NO: 643970 - DNA, 25 bp, Homo sapien
ggcccaaccatggtgcagtcaaagt

SEQ ID NO: 643971 - DNA, 25 bp, Homo sapien
accatggtgcagtcaaagtcaccca

SEQ ID NO: 643972 - DNA, 25 bp, Homo sapien
agcttccttttacctattgtcatcg

SEQ ID NO: 643973 - DNA, 25 bp, Homo sapien
cttccttttacctattgtcatcgtg

SEQ ID NO: 643974 - DNA, 25 bp, Homo sapien
tccttttacctattgtcatcgtgaa

SEQ ID NO: 643975 - DNA, 25 bp, Homo sapien
ccttttacctattgtcatcgtgaaa

SEQ ID NO: 643976 - DNA, 25 bp, Homo sapien
ttacctattgtcatcgtgaaaatat

SEQ ID NO: 643977 - DNA, 25 bp, Homo sapien
tttctttaagatgagttcccataac

SEQ ID NO: 643978 - DNA, 25 bp, Homo sapien
aagatgagttcccataacttgctta

SEQ ID NO: 643979 - DNA, 25 bp, Homo sapien
gatgagttcccataacttgcttata

SEQ ID NO: 643980 - DNA, 25 bp, Homo sapien
tgagttcccataacttgcttatatt

SEQ ID NO: 643981 - DNA, 25 bp, Homo sapien
ttgtatattttatttctagggaagt

SEQ ID NO: 643982 - DNA, 25 bp, Homo sapien
ttatttctagggaagtgaatcgtat

SEQ ID NO: 643983 - DNA, 25 bp, Homo sapien
catggtgtacatatcactctgcagc

SEQ ID NO: 643984 - DNA, 25 bp, Homo sapien
atcactctgcagcttgtttttatgc

SEQ ID NO: 643985 - DNA, 25 bp, Homo sapien
gaaagtagacatctcctcgggttca

SEQ ID NO: 643986 - DNA, 25 bp, Homo sapien
tctcctcgggttcatagatatggct

SEQ ID NO: 643987 - DNA, 25 bp, Homo sapien
gaagtgcagtgcagttctttcacac

SEQ ID NO: 643988 - DNA, 25 bp, Homo sapien
gtgcagttctttcacacctgtaatt

SEQ ID NO: 643989 - DNA, 25 bp, Homo sapien
gtagatcccatttttgcagtaacca

SEQ ID NO: 643990 - DNA, 25 bp, Homo sapien
aatggtgcagtgaaagtccttatat

SEQ ID NO: 643991 - DNA, 25 bp, Homo sapien
gtccttatatactcgccttttttat

SEQ ID NO: 643992 - DNA, 25 bp, Homo sapien
aggatataatctcaagtccgagttt

SEQ ID NO: 643993 - DNA, 25 bp, Homo sapien
gtccgagttttggtcatagcctgta

SEQ ID NO: 643994 - DNA, 25 bp, Homo sapien
gaagttactgaagatccacagaagt

SEQ ID NO: 643995 - DNA, 25 bp, Homo sapien
gacattgcaccattgtgatatgtta

SEQ ID NO: 643996 - DNA, 25 bp, Homo sapien
cattgcaccattgtgatatgttact

SEQ ID NO: 643997 - DNA, 25 bp, Homo sapien
ttgcaccattgtgatatgttactgc

SEQ ID NO: 643998 - DNA, 25 bp, Homo sapien
gcaccattgtgatatgttactgccc

SEQ ID NO: 643999 - DNA, 25 bp, Homo sapien
tgcccgcaaaacattgctccaaact

SEQ ID NO: 644000 - DNA, 25 bp, Homo sapien
gcccgcaaaacattgctccaaactc

SEQ ID NO: 644001 - DNA, 25 bp, Homo sapien
cccgcaaaacattgctccaaactcc

SEQ ID NO: 644002 - DNA, 25 bp, Homo sapien
ccgcaaaacattgctccaaactcca

SEQ ID NO: 644003 - DNA, 25 bp, Homo sapien
caaaacattgctccaaactccacca

SEQ ID NO: 644004 - DNA, 25 bp, Homo sapien
tccaccacctatccccaaacctgta

SEQ ID NO: 644005 - DNA, 25 bp, Homo sapien
caaatgttagctggatcttaagaat

SEQ ID NO: 644006 - DNA, 25 bp, Homo sapien
tcagaagtcctaggtgactctgccc

SEQ ID NO: 644007 - DNA, 25 bp, Homo sapien
catggcctcagttttcacatgtgag

SEQ ID NO: 644008 - DNA, 25 bp, Homo sapien
agtgtggtagaaagtgccccgagta

SEQ ID NO: 644009 - DNA, 25 bp, Homo sapien
gagtagaaggcaggtgtcagtccct

SEQ ID NO: 644010 - DNA, 25 bp, Homo sapien
ggtgtcagtccctgttcattcacct

SEQ ID NO: 644011 - DNA, 25 bp, Homo sapien
cattcacctctgtggctttaaccca

SEQ ID NO: 644012 - DNA, 25 bp, Homo sapien
gtggctttaacccacagctcactgc

SEQ ID NO: 644013 - DNA, 25 bp, Homo sapien
agctcactgctttctctatatctgt

SEQ ID NO: 644014 - DNA, 25 bp, Homo sapien
gctttctctatatctgtatctcaca

SEQ ID NO: 644015 - DNA, 25 bp, Homo sapien
tctgtatctcacacagatacccctt

SEQ ID NO: 644016 - DNA, 25 bp, Homo sapien
attagtgcactttgaaacagcacta

SEQ ID NO: 644017 - DNA, 25 bp, Homo sapien
agtgcactttgaaacagcactagag

SEQ ID NO: 644018 - DNA, 25 bp, Homo sapien
gtgcactttgaaacagcactagagg

SEQ ID NO: 644019 - DNA, 25 bp, Homo sapien
tgcactttgaaacagcactagaggc

SEQ ID NO: 644020 - DNA, 25 bp, Homo sapien
gcactttgaaacagcactagaggct

SEQ ID NO: 644021 - DNA, 25 bp, Homo sapien
cactttgaaacagcactagaggctg

SEQ ID NO: 644022 - DNA, 25 bp, Homo sapien
actttgaaacagcactagaggctgg

SEQ ID NO: 644023 - DNA, 25 bp, Homo sapien
ttgaaacagcactagaggctgggct

SEQ ID NO: 644024 - DNA, 25 bp, Homo sapien
tgaaacagcactagaggctgggctg

SEQ ID NO: 644025 - DNA, 25 bp, Homo sapien
taattctagctcttgggagacagag

SEQ ID NO: 644026 - DNA, 25 bp, Homo sapien
aattctagctcttgggagacagagg

SEQ ID NO: 644027 - DNA, 25 bp, Homo sapien
aaggctaagaggttaactcatttct

SEQ ID NO: 644028 - DNA, 25 bp, Homo sapien
gaggttaactcatttctattttgaa

SEQ ID NO: 644029 - DNA, 25 bp, Homo sapien
ccttgctccaaattttacttactat

SEQ ID NO: 644030 - DNA, 25 bp, Homo sapien
tttaaatgtcatcctgctagagtgt

SEQ ID NO: 644031 - DNA, 25 bp, Homo sapien
catcctgctagagtgtaagtcttta

SEQ ID NO: 644032 - DNA, 25 bp, Homo sapien
agaattcttcttgggattagccaaa

SEQ ID NO: 644033 - DNA, 25 bp, Homo sapien
gtgagagattacatatttccttaga

SEQ ID NO: 644034 - DNA, 25 bp, Homo sapien
gatgaaaaatcctacaggcaaactt

SEQ ID NO: 644035 - DNA, 25 bp, Homo sapien
caggcaaacttttaatgtcagggag

SEQ ID NO: 644036 - DNA, 25 bp, Homo sapien
ggagaggaatactttattacctaat

SEQ ID NO: 644037 - DNA, 25 bp, Homo sapien
aatagctaagcattcttttttaaag

SEQ ID NO: 644038 - DNA, 25 bp, Homo sapien
gacagcggccagcaagatgagcatt

SEQ ID NO: 644039 - DNA, 25 bp, Homo sapien
gcaagatgagcattggccggcaaat

SEQ ID NO: 644040 - DNA, 25 bp, Homo sapien
aagatgagcattggccggcaaatag

SEQ ID NO: 644041 - DNA, 25 bp, Homo sapien
aaatagagcacgaccagccatggcc

SEQ ID NO: 644042 - DNA, 25 bp, Homo sapien
tagagcacgaccagccatggccctt

SEQ ID NO: 644043 - DNA, 25 bp, Homo sapien
agctctctgcttgggtggctcccat

SEQ ID NO: 644044 - DNA, 25 bp, Homo sapien
ttgggtggctcccatctgccactgg

SEQ ID NO: 644045 - DNA, 25 bp, Homo sapien
cactggccgtatgggctgtgtgctt

SEQ ID NO: 644046 - DNA, 25 bp, Homo sapien
gtatgggctgtgtgcttcacctgcc

SEQ ID NO: 644047 - DNA, 25 bp, Homo sapien
gggcgggatgtccaagccagctccc

SEQ ID NO: 644048 - DNA, 25 bp, Homo sapien
gccgtgtcagggtatgagtcagaaa

SEQ ID NO: 644049 - DNA, 25 bp, Homo sapien
tggaaagaagagtcccaagtccttg

SEQ ID NO: 644050 - DNA, 25 bp, Homo sapien
gaagagtcccaagtccttgggagtt

SEQ ID NO: 644051 - DNA, 25 bp, Homo sapien
tccttgggagtttgacccctatcag

SEQ ID NO: 644052 - DNA, 25 bp, Homo sapien
ggagtttgacccctatcaggtactg

SEQ ID NO: 644053 - DNA, 25 bp, Homo sapien
gtttgacccctatcaggtactgtga

SEQ ID NO: 644054 - DNA, 25 bp, Homo sapien
gacccctatcaggtactgtgagcta

SEQ ID NO: 644055 - DNA, 25 bp, Homo sapien
cctatcaggtactgtgagctagaga

SEQ ID NO: 644056 - DNA, 25 bp, Homo sapien
gagagactcaaatgagacctagtca

SEQ ID NO: 644057 - DNA, 25 bp, Homo sapien
aatgagacctagtcatatttttatt

SEQ ID NO: 644058 - DNA, 25 bp, Homo sapien
tatttctaaaatgctccaaggttat

SEQ ID NO: 644059 - DNA, 25 bp, Homo sapien
taaaatgctccaaggttattttttg

SEQ ID NO: 644060 - DNA, 25 bp, Homo sapien
tgaaaagaaatttgtcaggctgggt

SEQ ID NO: 644061 - DNA, 25 bp, Homo sapien
aaaagaaatttgtcaggctgggtgc

SEQ ID NO: 644062 - DNA, 25 bp, Homo sapien
aaagaaatttgtcaggctgggtgca

SEQ ID NO: 644063 - DNA, 25 bp, Homo sapien
aagaaatttgtcaggctgggtgcag

SEQ ID NO: 644064 - DNA, 25 bp, Homo sapien
agaaatttgtcaggctgggtgcagt

SEQ ID NO: 644065 - DNA, 25 bp, Homo sapien
gaaatttgtcaggctgggtgcagtg

SEQ ID NO: 644066 - DNA, 25 bp, Homo sapien
aaatttgtcaggctgggtgcagtgg

SEQ ID NO: 644067 - DNA, 25 bp, Homo sapien
aatttgtcaggctgggtgcagtggc

SEQ ID NO: 644068 - DNA, 25 bp, Homo sapien
tgggaggcagaggtgagctgagatc

SEQ ID NO: 644069 - DNA, 25 bp, Homo sapien
gggaggcagaggtgagctgagatcg

SEQ ID NO: 644070 - DNA, 25 bp, Homo sapien
ggaggcagaggtgagctgagatcgc

SEQ ID NO: 644071 - DNA, 25 bp, Homo sapien
tttatgcctttgctaaaacctcatt

SEQ ID NO: 644072 - DNA, 25 bp, Homo sapien
gcctttgctaaaacctcattagtaa

SEQ ID NO: 644073 - DNA, 25 bp, Homo sapien
aaaaggagacctgcctactaagcat

SEQ ID NO: 644074 - DNA, 25 bp, Homo sapien
aggagacctgcctactaagcataag

SEQ ID NO: 644075 - DNA, 25 bp, Homo sapien
gacctgcctactaagcataaggtta

SEQ ID NO: 644076 - DNA, 25 bp, Homo sapien
gcataaggttaaggctttaatggac

SEQ ID NO: 644077 - DNA, 25 bp, Homo sapien
aggctttaatggactttagaaatca

SEQ ID NO: 644078 - DNA, 25 bp, Homo sapien
agcactgaagtgcaaattcttttta

SEQ ID NO: 644079 - DNA, 25 bp, Homo sapien
tttatttgaatatttgagggcatta

SEQ ID NO: 644080 - DNA, 25 bp, Homo sapien
ttgagggcattaaatgagcattttt

SEQ ID NO: 644081 - DNA, 25 bp, Homo sapien
aatggatttcaattgtcaggataaa

SEQ ID NO: 644082 - DNA, 25 bp, Homo sapien
gtggcaacgccagtgtgagggtgga

SEQ ID NO: 644083 - DNA, 25 bp, Homo sapien
tccggttgctgctccactttctaat

SEQ ID NO: 644084 - DNA, 25 bp, Homo sapien
cactttctaatcctgagaggcagct

SEQ ID NO: 644085 - DNA, 25 bp, Homo sapien
ttctaatcctgagaggcagctgcgt

SEQ ID NO: 644086 - DNA, 25 bp, Homo sapien
aatcctgagaggcagctgcgtttct

SEQ ID NO: 644087 - DNA, 25 bp, Homo sapien
tgagaggcagctgcgtttctgcaac

SEQ ID NO: 644088 - DNA, 25 bp, Homo sapien
gaggcagctgcgtttctgcaaccta

SEQ ID NO: 644089 - DNA, 25 bp, Homo sapien
agctgcgtttctgcaacctatgggc

SEQ ID NO: 644090 - DNA, 25 bp, Homo sapien
acatgtttgaaagagctgaagctga

SEQ ID NO: 644091 - DNA, 25 bp, Homo sapien
agagctgaagctgattaaatgcttt

SEQ ID NO: 644092 - DNA, 25 bp, Homo sapien
tttccagtggtttcgccacgagcct

SEQ ID NO: 644093 - DNA, 25 bp, Homo sapien
aggtaagaatcatcagtggctgatc

SEQ ID NO: 644094 - DNA, 25 bp, Homo sapien
gtggctgatcatccctcaaagacaa

SEQ ID NO: 644095 - DNA, 25 bp, Homo sapien
aaacaactagacaagatgtggctcc

SEQ ID NO: 644096 - DNA, 25 bp, Homo sapien
gatggaagaacgcaggccaccacct

SEQ ID NO: 644097 - DNA, 25 bp, Homo sapien
aacctctcctttctggttgatgatg

SEQ ID NO: 644098 - DNA, 25 bp, Homo sapien
tcctttctggttgatgatgggaaca

SEQ ID NO: 644099 - DNA, 25 bp, Homo sapien
ggaacagcgtattgtaacttcacat

SEQ ID NO: 644100 - DNA, 25 bp, Homo sapien
tcgaggaagacattggccaccccaa

SEQ ID NO: 644101 - DNA, 25 bp, Homo sapien
ttggttcaatcttctgctcgagtgg

SEQ ID NO: 644102 - DNA, 25 bp, Homo sapien
caatcttctgctcgagtggcagtgg

SEQ ID NO: 644103 - DNA, 25 bp, Homo sapien
gagccgaccaaggagaggttatcta

SEQ ID NO: 644104 - DNA, 25 bp, Homo sapien
atacctggaattctcatattcatag

SEQ ID NO: 644105 - DNA, 25 bp, Homo sapien
ctcatattcatagagacagacagta

SEQ ID NO: 644106 - DNA, 25 bp, Homo sapien
gacagtagaatagtggtttccagga

SEQ ID NO: 644107 - DNA, 25 bp, Homo sapien
agtagaatagtggtttccaggatgg

SEQ ID NO: 644108 - DNA, 25 bp, Homo sapien
acaggaagtgattgttcatagatat

SEQ ID NO: 644109 - DNA, 25 bp, Homo sapien
ttcatagatatggagtttcgcttgg

SEQ ID NO: 644110 - DNA, 25 bp, Homo sapien
catagatatggagtttcgcttggga

SEQ ID NO: 644111 - DNA, 25 bp, Homo sapien
atagatatggagtttcgcttgggat

SEQ ID NO: 644112 - DNA, 25 bp, Homo sapien
agatatggagtttcgcttgggatga

SEQ ID NO: 644113 - DNA, 25 bp, Homo sapien
atggagtttcgcttgggatgatgaa

SEQ ID NO: 644114 - DNA, 25 bp, Homo sapien
ggagtttcgcttgggatgatgaaaa

SEQ ID NO: 644115 - DNA, 25 bp, Homo sapien
aacaagagcagggtgcccttgccct

SEQ ID NO: 644116 - DNA, 25 bp, Homo sapien
tgcctccagtatgtttccaagtcct

SEQ ID NO: 644117 - DNA, 25 bp, Homo sapien
agtcctgacctctcagaccaaactg

SEQ ID NO: 644118 - DNA, 25 bp, Homo sapien
accaaactgattccagggactggaa

SEQ ID NO: 644119 - DNA, 25 bp, Homo sapien
gagactccatagatggcctcacaac

SEQ ID NO: 644120 - DNA, 25 bp, Homo sapien
aaagccagacctgtcactgaacatt

SEQ ID NO: 644121 - DNA, 25 bp, Homo sapien
gtcactgaacattgaacagccattc

SEQ ID NO: 644122 - DNA, 25 bp, Homo sapien
gaacagccattcaaggaagtcatta

SEQ ID NO: 644123 - DNA, 25 bp, Homo sapien
ggaagtcattaaactctagtgggat

SEQ ID NO: 644124 - DNA, 25 bp, Homo sapien
taatgctgagccactacacaggttt

SEQ ID NO: 644125 - DNA, 25 bp, Homo sapien
gccactacacaggtttcttcgtttt

SEQ ID NO: 644126 - DNA, 25 bp, Homo sapien
cctcctcctaaatttgctgtggtgt

SEQ ID NO: 644127 - DNA, 25 bp, Homo sapien
tgtggtgtttagtcccatccaacta

SEQ ID NO: 644128 - DNA, 25 bp, Homo sapien
aactatctagtctcaccagtgctca

SEQ ID NO: 644129 - DNA, 25 bp, Homo sapien
agtgctcaggctgtggctgtcactc

SEQ ID NO: 644130 - DNA, 25 bp, Homo sapien
tgtcactcctgagcaaatggccttt

SEQ ID NO: 644131 - DNA, 25 bp, Homo sapien
aaatggcctttctgagtcctgagca

SEQ ID NO: 644132 - DNA, 25 bp, Homo sapien
gagtcctgagcagcgacgagcagtt

SEQ ID NO: 644133 - DNA, 25 bp, Homo sapien
acgagcagttgcatgggcccaacat

SEQ ID NO: 644134 - DNA, 25 bp, Homo sapien
aggactggtcacgaccttcctggtc

SEQ ID NO: 644135 - DNA, 25 bp, Homo sapien
tcctggtccctggtattgactatca

SEQ ID NO: 644136 - DNA, 25 bp, Homo sapien
tattgactatcagcttccttggcca

SEQ ID NO: 644137 - DNA, 25 bp, Homo sapien
gcagataatctataagcctgtcttt

SEQ ID NO: 644138 - DNA, 25 bp, Homo sapien
tctataagcctgtctttcttcatgg

SEQ ID NO: 644139 - DNA, 25 bp, Homo sapien
acaatcttcttgtgtccagctatta

SEQ ID NO: 644140 - DNA, 25 bp, Homo sapien
ttgtgtccagctattaccaaaccct

SEQ ID NO: 644141 - DNA, 25 bp, Homo sapien
attaccaaaccctcgtctgatagaa

SEQ ID NO: 644142 - DNA, 25 bp, Homo sapien
aaaccctcgtctgatagaaaaatgc

SEQ ID NO: 644143 - DNA, 25 bp, Homo sapien
tccagcacaagcaccgtcctaaaaa

SEQ ID NO: 644144 - DNA, 25 bp, Homo sapien
caccgtcctaaaaaatcgccagcaa

SEQ ID NO: 644145 - DNA, 25 bp, Homo sapien
tcctctcttcctgatttgcttgttg

SEQ ID NO: 644146 - DNA, 25 bp, Homo sapien
ctgatttgcttgttgctttcttgca

SEQ ID NO: 644147 - DNA, 25 bp, Homo sapien
gcttgttgctttcttgcagcatatt

SEQ ID NO: 644148 - DNA, 25 bp, Homo sapien
tcaagttttcccgcctttccaaatg

SEQ ID NO: 644149 - DNA, 25 bp, Homo sapien
ttccaaatggaaccaaagtacttct

SEQ ID NO: 644150 - DNA, 25 bp, Homo sapien
gaaccaaagtacttcttacatacag

SEQ ID NO: 644151 - DNA, 25 bp, Homo sapien
accaaagtacttcttacatacagtg

SEQ ID NO: 644152 - DNA, 25 bp, Homo sapien
ttcttacatacagtgactcatgtct

SEQ ID NO: 644153 - DNA, 25 bp, Homo sapien
agtgactcatgtctcaagtctccct

SEQ ID NO: 644154 - DNA, 25 bp, Homo sapien
gtgactcatgtctcaagtctcccta

SEQ ID NO: 644155 - DNA, 25 bp, Homo sapien
caaccacgctgaccatgtcatcagg

SEQ ID NO: 644156 - DNA, 25 bp, Homo sapien
acgctgaccatgtcatcaggacctc

SEQ ID NO: 644157 - DNA, 25 bp, Homo sapien
gaccatgtcatcaggacctcctgag

SEQ ID NO: 644158 - DNA, 25 bp, Homo sapien
gaggctgtgtcacggcctgtgtcct

SEQ ID NO: 644159 - DNA, 25 bp, Homo sapien
tactaggtgattacccctggtgcag

SEQ ID NO: 644160 - DNA, 25 bp, Homo sapien
acccctggtgcagtctgtacagaaa

SEQ ID NO: 644161 - DNA, 25 bp, Homo sapien
gaaatgctagattctgtacttctat

SEQ ID NO: 644162 - DNA, 25 bp, Homo sapien
gcattgattccctattatatgttga

SEQ ID NO: 644163 - DNA, 25 bp, Homo sapien
gaatgtggtcaattagtttgttatt

SEQ ID NO: 644164 - DNA, 25 bp, Homo sapien
tcattgactactctgggacaaaaag

SEQ ID NO: 644165 - DNA, 25 bp, Homo sapien
agtttattgctgtctgatactttta

SEQ ID NO: 644166 - DNA, 25 bp, Homo sapien
gatacttttaggcacccaacataca

SEQ ID NO: 644167 - DNA, 25 bp, Homo sapien
ttaggcacccaacatacatgactcc

SEQ ID NO: 644168 - DNA, 25 bp, Homo sapien
tgactcccgccattagctgaagtaa

SEQ ID NO: 644169 - DNA, 25 bp, Homo sapien
gaggataattgttgttttcaccttg

SEQ ID NO: 644170 - DNA, 25 bp, Homo sapien
tcagacatcttcacctgcttgaaca

SEQ ID NO: 644171 - DNA, 25 bp, Homo sapien
gacatcttcacctgcttgaacagtg

SEQ ID NO: 644172 - DNA, 25 bp, Homo sapien
cacctgcttgaacagtgaactttga

SEQ ID NO: 644173 - DNA, 25 bp, Homo sapien
gaacagtgaactttgaattagtttc

SEQ ID NO: 644174 - DNA, 25 bp, Homo sapien
gaacattgaaattaactagccttta

SEQ ID NO: 644175 - DNA, 25 bp, Homo sapien
tttttctgaaaaactagacatctca

SEQ ID NO: 644176 - DNA, 25 bp, Homo sapien
aactagacatctcaattcacagcat

SEQ ID NO: 644177 - DNA, 25 bp, Homo sapien
gacatctcaattcacagcatatgct

SEQ ID NO: 644178 - DNA, 25 bp, Homo sapien
acagcatatgctgtttatagcaaga

SEQ ID NO: 644179 - DNA, 25 bp, Homo sapien
agtaaatcatgacattgcattcttt

SEQ ID NO: 644180 - DNA, 25 bp, Homo sapien
atgacattgcattctttaaatttca

SEQ ID NO: 644181 - DNA, 25 bp, Homo sapien
tcggtggtttgggagtcaacggagg

SEQ ID NO: 644182 - DNA, 25 bp, Homo sapien
gagtcaacggaggtgggatgagaga

SEQ ID NO: 644183 - DNA, 25 bp, Homo sapien
tagatgagcggggtttgatttcctt

SEQ ID NO: 644184 - DNA, 25 bp, Homo sapien
tcctttggagattgtgggaaatgat

SEQ ID NO: 644185 - DNA, 25 bp, Homo sapien
tgaggggcatgttctggatccagga

SEQ ID NO: 644186 - DNA, 25 bp, Homo sapien
gataaaagcaagtgtttggaaggaa

SEQ ID NO: 644187 - DNA, 25 bp, Homo sapien
ttggaaggaagggtcttagttctca

SEQ ID NO: 644188 - DNA, 25 bp, Homo sapien
gaaggaagggtcttagttctcagag

SEQ ID NO: 644189 - DNA, 25 bp, Homo sapien
aggaagggtcttagttctcagaggc

SEQ ID NO: 644190 - DNA, 25 bp, Homo sapien
gaagggtcttagttctcagaggcga

SEQ ID NO: 644191 - DNA, 25 bp, Homo sapien
aagggtcttagttctcagaggcgaa

SEQ ID NO: 644192 - DNA, 25 bp, Homo sapien
gggattaacgatttaggctatagct

SEQ ID NO: 644193 - DNA, 25 bp, Homo sapien
gattaacgatttaggctatagctgt

SEQ ID NO: 644194 - DNA, 25 bp, Homo sapien
attaacgatttaggctatagctgta

SEQ ID NO: 644195 - DNA, 25 bp, Homo sapien
gtagctataaaaacaagagcacagt

SEQ ID NO: 644196 - DNA, 25 bp, Homo sapien
ataaaaacaagagcacagtagaatg

SEQ ID NO: 644197 - DNA, 25 bp, Homo sapien
gcagccacctggaacaaatctatat

SEQ ID NO: 644198 - DNA, 25 bp, Homo sapien
cagccacctggaacaaatctatatg

SEQ ID NO: 644199 - DNA, 25 bp, Homo sapien
agccacctggaacaaatctatatga

SEQ ID NO: 644200 - DNA, 25 bp, Homo sapien
gccacctggaacaaatctatatgaa

SEQ ID NO: 644201 - DNA, 25 bp, Homo sapien
acctggaacaaatctatatgaaaag

SEQ ID NO: 644202 - DNA, 25 bp, Homo sapien
gagacagtagtctatatagaataca

SEQ ID NO: 644203 - DNA, 25 bp, Homo sapien
ttagccaaaatatcatttatagagg

SEQ ID NO: 644204 - DNA, 25 bp, Homo sapien
tatcatttatagaggagggcaaaac

SEQ ID NO: 644205 - DNA, 25 bp, Homo sapien
attaagactatgaatatacccattc

SEQ ID NO: 644206 - DNA, 25 bp, Homo sapien
gactatgaatatacccattcattct

SEQ ID NO: 644207 - DNA, 25 bp, Homo sapien
aaacattgtataagaatcagtggaa

SEQ ID NO: 644208 - DNA, 25 bp, Homo sapien
agaatcagtggaaggtagtctatct

SEQ ID NO: 644209 - DNA, 25 bp, Homo sapien
gtggaaggtagtctatctgaaaatt

SEQ ID NO: 644210 - DNA, 25 bp, Homo sapien
gcagtgataactttaattgtgatgt

SEQ ID NO: 644211 - DNA, 25 bp, Homo sapien
ataactttaattgtgatgtgtgcta

SEQ ID NO: 644212 - DNA, 25 bp, Homo sapien
actttaattgtgatgtgtgctaagg

SEQ ID NO: 644213 - DNA, 25 bp, Homo sapien
aattgtgatgtgtgctaaggaagag

SEQ ID NO: 644214 - DNA, 25 bp, Homo sapien
gtcttctatgccgagttatgtgcca

SEQ ID NO: 644215 - DNA, 25 bp, Homo sapien
ttctatgccgagttatgtgccatgg

SEQ ID NO: 644216 - DNA, 25 bp, Homo sapien
aagaaggaatgggactctgacactt

SEQ ID NO: 644217 - DNA, 25 bp, Homo sapien
aatgggactctgacacttggaatgg

SEQ ID NO: 644218 - DNA, 25 bp, Homo sapien
ttgagaagtgtcctactcctcccta

SEQ ID NO: 644219 - DNA, 25 bp, Homo sapien
ggcactccatcttgcttcaatatat

SEQ ID NO: 644220 - DNA, 25 bp, Homo sapien
atatatggaatcctttcccctgtaa

SEQ ID NO: 644221 - DNA, 25 bp, Homo sapien
tcctttcccctgtaagataacctgg

SEQ ID NO: 644222 - DNA, 25 bp, Homo sapien
cactgggcctataactagggttaag

SEQ ID NO: 644223 - DNA, 25 bp, Homo sapien
taactagggttaagccacgcataat

SEQ ID NO: 644224 - DNA, 25 bp, Homo sapien
gccacgcataatctagctggtgatg

SEQ ID NO: 644225 - DNA, 25 bp, Homo sapien
gggctctaatttgataggacctgtt

SEQ ID NO: 644226 - DNA, 25 bp, Homo sapien
tgataggacctgtttccttataaga

SEQ ID NO: 644227 - DNA, 25 bp, Homo sapien
aaggagagacaccagtgctatccca

SEQ ID NO: 644228 - DNA, 25 bp, Homo sapien
gagagacaccagtgctatcccactt

SEQ ID NO: 644229 - DNA, 25 bp, Homo sapien
tatcccacttcatgcgcagatgcac

SEQ ID NO: 644230 - DNA, 25 bp, Homo sapien
cttcatgcgcagatgcacagaggaa

SEQ ID NO: 644231 - DNA, 25 bp, Homo sapien
ggaaagagagccctaaccagaaact

SEQ ID NO: 644232 - DNA, 25 bp, Homo sapien
agagagccctaaccagaaactgaat

SEQ ID NO: 644233 - DNA, 25 bp, Homo sapien
gaaactgaatttgctggcaccttaa

SEQ ID NO: 644234 - DNA, 25 bp, Homo sapien
gaatttgctggcaccttaattgtgg

SEQ ID NO: 644235 - DNA, 25 bp, Homo sapien
tttgctggcaccttaattgtggact

SEQ ID NO: 644236 - DNA, 25 bp, Homo sapien
gcctatagcagcgtttaacaggaga

SEQ ID NO: 644237 - DNA, 25 bp, Homo sapien
cctatagcagcgtttaacaggagac

SEQ ID NO: 644238 - DNA, 25 bp, Homo sapien
ctatagcagcgtttaacaggagaca

SEQ ID NO: 644239 - DNA, 25 bp, Homo sapien
tatagcagcgtttaacaggagacaa

SEQ ID NO: 644240 - DNA, 25 bp, Homo sapien
atagcagcgtttaacaggagacaat

SEQ ID NO: 644241 - DNA, 25 bp, Homo sapien
tagcagcgtttaacaggagacaatt

SEQ ID NO: 644242 - DNA, 25 bp, Homo sapien
agcagcgtttaacaggagacaattg

SEQ ID NO: 644243 - DNA, 25 bp, Homo sapien
gcagcgtttaacaggagacaattgg

SEQ ID NO: 644244 - DNA, 25 bp, Homo sapien
agcgtttaacaggagacaattggtc

SEQ ID NO: 644245 - DNA, 25 bp, Homo sapien
gcgtttaacaggagacaattggtca

SEQ ID NO: 644246 - DNA, 25 bp, Homo sapien
gtttaacaggagacaattggtcaag

SEQ ID NO: 644247 - DNA, 25 bp, Homo sapien
gaaattaccttccagcaagagaact

SEQ ID NO: 644248 - DNA, 25 bp, Homo sapien
gaagcaagtcatgttctaatagtta

SEQ ID NO: 644249 - DNA, 25 bp, Homo sapien
gggcagagtatattggtcatcctga

SEQ ID NO: 644250 - DNA, 25 bp, Homo sapien
ggtcatcctgaaaatgcagtgcatg

SEQ ID NO: 644251 - DNA, 25 bp, Homo sapien
gtgcatgccaagcaatttctggatt

SEQ ID NO: 644252 - DNA, 25 bp, Homo sapien
gattatccatggttcagtttatttg

SEQ ID NO: 644253 - DNA, 25 bp, Homo sapien
tgtactgtactccagttattgggaa

SEQ ID NO: 644254 - DNA, 25 bp, Homo sapien
ttattgggaaggataacctacactg

SEQ ID NO: 644255 - DNA, 25 bp, Homo sapien
acctacactgtatatcgtctgctta

SEQ ID NO: 644256 - DNA, 25 bp, Homo sapien
tgtatatcgtctgcttatttatcta

SEQ ID NO: 644257 - DNA, 25 bp, Homo sapien
tgtctcctcactagaaagaacactt

SEQ ID NO: 644258 - DNA, 25 bp, Homo sapien
taaattcttgatagcaccagttctc

SEQ ID NO: 644259 - DNA, 25 bp, Homo sapien
gatagcaccagttctcaaatatgag

SEQ ID NO: 644260 - DNA, 25 bp, Homo sapien
gaatttaaccctgtccttagccctg

SEQ ID NO: 644261 - DNA, 25 bp, Homo sapien
tgtccttagccctgttatataacct

SEQ ID NO: 644262 - DNA, 25 bp, Homo sapien
gagaaaggctggctgcaactccggg

SEQ ID NO: 644263 - DNA, 25 bp, Homo sapien
ccaagctccccactgatggaaagat

SEQ ID NO: 644264 - DNA, 25 bp, Homo sapien
aagaaactacttgccagaagccagg

SEQ ID NO: 644265 - DNA, 25 bp, Homo sapien
tacttgccagaagccaggaccaatt

SEQ ID NO: 644266 - DNA, 25 bp, Homo sapien
ggaccaatttggcagagtctactca

SEQ ID NO: 644267 - DNA, 25 bp, Homo sapien
gaacagttttcattagacataccag

SEQ ID NO: 644268 - DNA, 25 bp, Homo sapien
attagacataccagtgtactaagtc

SEQ ID NO: 644269 - DNA, 25 bp, Homo sapien
tcagtattctttgtcttgaatagag

SEQ ID NO: 644270 - DNA, 25 bp, Homo sapien
cagtattctttgtcttgaatagaga

SEQ ID NO: 644271 - DNA, 25 bp, Homo sapien
tctttgtcttgaatagagaagtcta

SEQ ID NO: 644272 - DNA, 25 bp, Homo sapien
agagaagtctatgttcgtaaagtca

SEQ ID NO: 644273 - DNA, 25 bp, Homo sapien
gagaagtctatgttcgtaaagtcat

SEQ ID NO: 644274 - DNA, 25 bp, Homo sapien
agaagtctatgttcgtaaagtcata

SEQ ID NO: 644275 - DNA, 25 bp, Homo sapien
gaagtctatgttcgtaaagtcatat

SEQ ID NO: 644276 - DNA, 25 bp, Homo sapien
aagtctatgttcgtaaagtcatata

SEQ ID NO: 644277 - DNA, 25 bp, Homo sapien
gtctatgttcgtaaagtcatataaa

SEQ ID NO: 644278 - DNA, 25 bp, Homo sapien
gtcatataaaaggttataccactat

SEQ ID NO: 644279 - DNA, 25 bp, Homo sapien
tataaaaggttataccactatttag

SEQ ID NO: 644280 - DNA, 25 bp, Homo sapien
gaggtgagacggtctctccagcagc

SEQ ID NO: 644281 - DNA, 25 bp, Homo sapien
ggtctctccagcagccatagcagat

SEQ ID NO: 644282 - DNA, 25 bp, Homo sapien
ggaaactgcccggtgacagcagtga

SEQ ID NO: 644283 - DNA, 25 bp, Homo sapien
agcagtgagtgagtttgctgtcctg

SEQ ID NO: 644284 - DNA, 25 bp, Homo sapien
gggtttggcatttggctctgaattg

SEQ ID NO: 644285 - DNA, 25 bp, Homo sapien
ttggctctgaattggttctcactgg

SEQ ID NO: 644286 - DNA, 25 bp, Homo sapien
attggttctcactgggctggtgcat

SEQ ID NO: 644287 - DNA, 25 bp, Homo sapien
tgggctggtgcatgactctctgtgt

SEQ ID NO: 644288 - DNA, 25 bp, Homo sapien
gctccgggccaagatacaggtgctc

SEQ ID NO: 644289 - DNA, 25 bp, Homo sapien
gggccaagatacaggtgctctcagc

SEQ ID NO: 644290 - DNA, 25 bp, Homo sapien
tgctgggtgagtttgcagtcctgaa

SEQ ID NO: 644291 - DNA, 25 bp, Homo sapien
atcacttggagtcctttattgctga

SEQ ID NO: 644292 - DNA, 25 bp, Homo sapien
acttggagtcctttattgctgaatg

SEQ ID NO: 644293 - DNA, 25 bp, Homo sapien
gagtcctttattgctgaatgtgatc

SEQ ID NO: 644294 - DNA, 25 bp, Homo sapien
cctttattgctgaatgtgatcggag

SEQ ID NO: 644295 - DNA, 25 bp, Homo sapien
gtgatcggagaactgagctcgccaa

SEQ ID NO: 644296 - DNA, 25 bp, Homo sapien
atcggagaactgagctcgccaagaa

SEQ ID NO: 644297 - DNA, 25 bp, Homo sapien
gaaatcagtgcggaagtttctgcaa

SEQ ID NO: 644298 - DNA, 25 bp, Homo sapien
agtgcggaagtttctgcaaaggcag

SEQ ID NO: 644299 - DNA, 25 bp, Homo sapien
taggaaaactccttgctaaagccga

SEQ ID NO: 644300 - DNA, 25 bp, Homo sapien
ctccttgctaaagccgaacagctag

SEQ ID NO: 644301 - DNA, 25 bp, Homo sapien
ggctgaaggtaatgtggatgaatcc

SEQ ID NO: 644302 - DNA, 25 bp, Homo sapien
ttcttgcttcaggtaacggtaggct

SEQ ID NO: 644303 - DNA, 25 bp, Homo sapien
tcttgcttcaggtaacggtaggcta

SEQ ID NO: 644304 - DNA, 25 bp, Homo sapien
cttgcttcaggtaacggtaggctag

SEQ ID NO: 644305 - DNA, 25 bp, Homo sapien
ttgcttcaggtaacggtaggctagg

SEQ ID NO: 644306 - DNA, 25 bp, Homo sapien
tgcttcaggtaacggtaggctagga

SEQ ID NO: 644307 - DNA, 25 bp, Homo sapien
cttcaggtaacggtaggctaggaca

SEQ ID NO: 644308 - DNA, 25 bp, Homo sapien
ttcaggtaacggtaggctaggacat

SEQ ID NO: 644309 - DNA, 25 bp, Homo sapien
tcaggtaacggtaggctaggacatt

SEQ ID NO: 644310 - DNA, 25 bp, Homo sapien
caggtaacggtaggctaggacattt

SEQ ID NO: 644311 - DNA, 25 bp, Homo sapien
gtaacggtaggctaggacatttgga

SEQ ID NO: 644312 - DNA, 25 bp, Homo sapien
taacggtaggctaggacatttggac

SEQ ID NO: 644313 - DNA, 25 bp, Homo sapien
tgtcatcattgcctcaccaggtagc

SEQ ID NO: 644314 - DNA, 25 bp, Homo sapien
accaggtagcactctcaaggctaga

SEQ ID NO: 644315 - DNA, 25 bp, Homo sapien
tctcaaggctagacctttggaggcg

SEQ ID NO: 644316 - DNA, 25 bp, Homo sapien
aatggcatggcctaggaaacaatct

SEQ ID NO: 644317 - DNA, 25 bp, Homo sapien
aatctaatgtctcgttagtctccta

SEQ ID NO: 644318 - DNA, 25 bp, Homo sapien
gttagtctcctaagacagcccttcg

SEQ ID NO: 644319 - DNA, 25 bp, Homo sapien
gcctcatccttgtgccaagcttgtg

SEQ ID NO: 644320 - DNA, 25 bp, Homo sapien
tgccaagcttgtgttgggcacaaag

SEQ ID NO: 644321 - DNA, 25 bp, Homo sapien
gggcacaaagcactcaggcatccaa

SEQ ID NO: 644322 - DNA, 25 bp, Homo sapien
gacaccgggagcagggtcctaacat

SEQ ID NO: 644323 - DNA, 25 bp, Homo sapien
gtcctaacatccacacaatttcgtt

SEQ ID NO: 644324 - DNA, 25 bp, Homo sapien
tcagcttcagaaaaccaatatgcaa

SEQ ID NO: 644325 - DNA, 25 bp, Homo sapien
cagaaaaccaatatgcaaggctggg

SEQ ID NO: 644326 - DNA, 25 bp, Homo sapien
aggagttcctgaccatagtgagatc

SEQ ID NO: 644327 - DNA, 25 bp, Homo sapien
ggagttcctgaccatagtgagatct

SEQ ID NO: 644328 - DNA, 25 bp, Homo sapien
agttcctgaccatagtgagatctcg

SEQ ID NO: 644329 - DNA, 25 bp, Homo sapien
ctgaccatagtgagatctcgtctct

SEQ ID NO: 644330 - DNA, 25 bp, Homo sapien
ctactcaagaggctagcatgggaag

SEQ ID NO: 644331 - DNA, 25 bp, Homo sapien
ctcaagaggctagcatgggaagatc

SEQ ID NO: 644332 - DNA, 25 bp, Homo sapien
agccgtgatcacacaatggcagtgc

SEQ ID NO: 644333 - DNA, 25 bp, Homo sapien
gtgatcacacaatggcagtgcagcc

SEQ ID NO: 644334 - DNA, 25 bp, Homo sapien
tgatcacacaatggcagtgcagcct

SEQ ID NO: 644335 - DNA, 25 bp, Homo sapien
aggagttcctgaccatagtgagatc

SEQ ID NO: 644336 - DNA, 25 bp, Homo sapien
ggagttcctgaccatagtgagatct

SEQ ID NO: 644337 - DNA, 25 bp, Homo sapien
gagttcctgaccatagtgagatctc

SEQ ID NO: 644338 - DNA, 25 bp, Homo sapien
agttcctgaccatagtgagatctcg

SEQ ID NO: 644339 - DNA, 25 bp, Homo sapien
ctactcaagaggctagcatgggaag

SEQ ID NO: 644340 - DNA, 25 bp, Homo sapien
ctcaagaggctagcatgggaagatc

SEQ ID NO: 644341 - DNA, 25 bp, Homo sapien
agccgtgatcacacaatggcagtgc

SEQ ID NO: 644342 - DNA, 25 bp, Homo sapien
gccgtgatcacacaatggcagtgca

SEQ ID NO: 644343 - DNA, 25 bp, Homo sapien
ccgtgatcacacaatggcagtgcag

SEQ ID NO: 644344 - DNA, 25 bp, Homo sapien
gtgatcacacaatggcagtgcagcc

SEQ ID NO: 644345 - DNA, 25 bp, Homo sapien
tgatcacacaatggcagtgcagcct

SEQ ID NO: 644346 - DNA, 25 bp, Homo sapien
tggagctgttcctgccgccgcagct

SEQ ID NO: 644347 - DNA, 25 bp, Homo sapien
gccgcagctgaagcccgcgcggatc

SEQ ID NO: 644348 - DNA, 25 bp, Homo sapien
cctggaccgccaagaggtgcagaca

SEQ ID NO: 644349 - DNA, 25 bp, Homo sapien
gaccgccaagaggtgcagacaagcc

SEQ ID NO: 644350 - DNA, 25 bp, Homo sapien
caagaggtgcagacaagccccggta

SEQ ID NO: 644351 - DNA, 25 bp, Homo sapien
gaggtgcagacaagccccggtaggg

SEQ ID NO: 644352 - DNA, 25 bp, Homo sapien
tccccggcagcggaggcgcgtggag

SEQ ID NO: 644353 - DNA, 25 bp, Homo sapien
gactgagagtgtgcgacgcgcccca

SEQ ID NO: 644354 - DNA, 25 bp, Homo sapien
tgagagtgtgcgacgcgccccagcc

SEQ ID NO: 644355 - DNA, 25 bp, Homo sapien
cccagcctcccacataaagttataa

SEQ ID NO: 644356 - DNA, 25 bp, Homo sapien
gcctcccacataaagttataattct

SEQ ID NO: 644357 - DNA, 25 bp, Homo sapien
tcagatggatgtcttgccttttcct

SEQ ID NO: 644358 - DNA, 25 bp, Homo sapien
gccttttcctctacacactacagga

SEQ ID NO: 644359 - DNA, 25 bp, Homo sapien
gccaagggcctagtatagtacccta

SEQ ID NO: 644360 - DNA, 25 bp, Homo sapien
ccctatacatgtagctgatcagttg

SEQ ID NO: 644361 - DNA, 25 bp, Homo sapien
gttactgatcatatgtatcctgcat

SEQ ID NO: 644362 - DNA, 25 bp, Homo sapien
catatgtatcctgcatcatgttata

SEQ ID NO: 644363 - DNA, 25 bp, Homo sapien
tttcacaagccccatgaagtctatc

SEQ ID NO: 644364 - DNA, 25 bp, Homo sapien
gaagtctatctggattttcggtaat

SEQ ID NO: 644365 - DNA, 25 bp, Homo sapien
ttcggtaatgtttcctgtctctgaa

SEQ ID NO: 644366 - DNA, 25 bp, Homo sapien
gacatttatgtctgtatcagccatt

SEQ ID NO: 644367 - DNA, 25 bp, Homo sapien
atcagccatttgatgcttgattatc

SEQ ID NO: 644368 - DNA, 25 bp, Homo sapien
cactcaataacacttcgcactgatt

SEQ ID NO: 644369 - DNA, 25 bp, Homo sapien
actcaataacacttcgcactgattc

SEQ ID NO: 644370 - DNA, 25 bp, Homo sapien
ctcaataacacttcgcactgattct

SEQ ID NO: 644371 - DNA, 25 bp, Homo sapien
tcaataacacttcgcactgattctc

SEQ ID NO: 644372 - DNA, 25 bp, Homo sapien
aataacacttcgcactgattctcca

SEQ ID NO: 644373 - DNA, 25 bp, Homo sapien
ataacacttcgcactgattctccaa

SEQ ID NO: 644374 - DNA, 25 bp, Homo sapien
taacacttcgcactgattctccaag

SEQ ID NO: 644375 - DNA, 25 bp, Homo sapien
aacacttcgcactgattctccaagc

SEQ ID NO: 644376 - DNA, 25 bp, Homo sapien
cttcgcactgattctccaagcccag

SEQ ID NO: 644377 - DNA, 25 bp, Homo sapien
gtagcggcaggccaaggcggagttt

SEQ ID NO: 644378 - DNA, 25 bp, Homo sapien
tagcggcaggccaaggcggagtttg

SEQ ID NO: 644379 - DNA, 25 bp, Homo sapien
aagatgggtaagttggccgggtgca

SEQ ID NO: 644380 - DNA, 25 bp, Homo sapien
gctcatacttgcaatcccaatcttt

SEQ ID NO: 644381 - DNA, 25 bp, Homo sapien
tcatacttgcaatcccaatctttgg

SEQ ID NO: 644382 - DNA, 25 bp, Homo sapien
catacttgcaatcccaatctttggg

SEQ ID NO: 644383 - DNA, 25 bp, Homo sapien
cattgtggcgtgtgctcgtaatttc

SEQ ID NO: 644384 - DNA, 25 bp, Homo sapien
attgtggcgtgtgctcgtaatttca

SEQ ID NO: 644385 - DNA, 25 bp, Homo sapien
tgtggcgtgtgctcgtaatttcagc

SEQ ID NO: 644386 - DNA, 25 bp, Homo sapien
tggcgtgtgctcgtaatttcagcta

SEQ ID NO: 644387 - DNA, 25 bp, Homo sapien
ggcgtgtgctcgtaatttcagctac

SEQ ID NO: 644388 - DNA, 25 bp, Homo sapien
gcgtgtgctcgtaatttcagctact

SEQ ID NO: 644389 - DNA, 25 bp, Homo sapien
gacaagaagactgagcgcaggaggt

SEQ ID NO: 644390 - DNA, 25 bp, Homo sapien
taacagtagagggcttaagtaacac

SEQ ID NO: 644391 - DNA, 25 bp, Homo sapien
tagagggcttaagtaacacccctct

SEQ ID NO: 644392 - DNA, 25 bp, Homo sapien
ggcttaagtaacacccctctaagca

SEQ ID NO: 644393 - DNA, 25 bp, Homo sapien
gcttaagtaacacccctctaagcat

SEQ ID NO: 644394 - DNA, 25 bp, Homo sapien
cttaagtaacacccctctaagcatt

SEQ ID NO: 644395 - DNA, 25 bp, Homo sapien
gtacttcctaggagtggttgcattg

SEQ ID NO: 644396 - DNA, 25 bp, Homo sapien
tacttcctaggagtggttgcattgg

SEQ ID NO: 644397 - DNA, 25 bp, Homo sapien
acttcctaggagtggttgcattggg

SEQ ID NO: 644398 - DNA, 25 bp, Homo sapien
ctaggagtggttgcattggggaatg

SEQ ID NO: 644399 - DNA, 25 bp, Homo sapien
gttaaaacttgatgcttaggagcga

SEQ ID NO: 644400 - DNA, 25 bp, Homo sapien
ttaggagcgaatgcagactattcat

SEQ ID NO: 644401 - DNA, 25 bp, Homo sapien
gaaagacatgatttctttgcttaca

SEQ ID NO: 644402 - DNA, 25 bp, Homo sapien
gacatgatttctttgcttacattat

SEQ ID NO: 644403 - DNA, 25 bp, Homo sapien
tgcttacattattttcacaaacaat

SEQ ID NO: 644404 - DNA, 25 bp, Homo sapien
atacatttgcatatgtctggagagc

SEQ ID NO: 644405 - DNA, 25 bp, Homo sapien
atttgcatatgtctggagagcaggc

SEQ ID NO: 644406 - DNA, 25 bp, Homo sapien
cctttatttgccaaacagcactctc

SEQ ID NO: 644407 - DNA, 25 bp, Homo sapien
atttgccaaacagcactctctagta

SEQ ID NO: 644408 - DNA, 25 bp, Homo sapien
gccaaacagcactctctagtagggt

SEQ ID NO: 644409 - DNA, 25 bp, Homo sapien
acagcactctctagtagggttccat

SEQ ID NO: 644410 - DNA, 25 bp, Homo sapien
agcactctctagtagggttccatcc

SEQ ID NO: 644411 - DNA, 25 bp, Homo sapien
tctctagtagggttccatcctggtt

SEQ ID NO: 644412 - DNA, 25 bp, Homo sapien
ctccccttgactcactaattgaaaa

SEQ ID NO: 644413 - DNA, 25 bp, Homo sapien
tccccttgactcactaattgaaaag

SEQ ID NO: 644414 - DNA, 25 bp, Homo sapien
ccccttgactcactaattgaaaagc

SEQ ID NO: 644415 - DNA, 25 bp, Homo sapien
cccttgactcactaattgaaaagca

SEQ ID NO: 644416 - DNA, 25 bp, Homo sapien
ccttgactcactaattgaaaagcaa

SEQ ID NO: 644417 - DNA, 25 bp, Homo sapien
cttgactcactaattgaaaagcaaa

SEQ ID NO: 644418 - DNA, 25 bp, Homo sapien
ttgactcactaattgaaaagcaaaa

SEQ ID NO: 644419 - DNA, 25 bp, Homo sapien
tgactcactaattgaaaagcaaaaa

SEQ ID NO: 644420 - DNA, 25 bp, Homo sapien
gtggtgtttcgcacctgtattccca

SEQ ID NO: 644421 - DNA, 25 bp, Homo sapien
catgttcacaccactataccccagc

SEQ ID NO: 644422 - DNA, 25 bp, Homo sapien
ttcacaccactataccccagcctag

SEQ ID NO: 644423 - DNA, 25 bp, Homo sapien
gaggacatcctgagatgctccccga

SEQ ID NO: 644424 - DNA, 25 bp, Homo sapien
agatgctccccgactagggtgggca

SEQ ID NO: 644425 - DNA, 25 bp, Homo sapien
atgctccccgactagggtgggcacc

SEQ ID NO: 644426 - DNA, 25 bp, Homo sapien
acttccacactccaaatgcctattt

SEQ ID NO: 644427 - DNA, 25 bp, Homo sapien
aaatgcctatttgacctgtgtatcg

SEQ ID NO: 644428 - DNA, 25 bp, Homo sapien
tgcctatttgacctgtgtatcgctg

SEQ ID NO: 644429 - DNA, 25 bp, Homo sapien
ctatttgacctgtgtatcgctgcat

SEQ ID NO: 644430 - DNA, 25 bp, Homo sapien
atttgacctgtgtatcgctgcatcc

SEQ ID NO: 644431 - DNA, 25 bp, Homo sapien
tgacctgtgtatcgctgcatcccca

SEQ ID NO: 644432 - DNA, 25 bp, Homo sapien
ctggcagatagcaggcccctaataa

SEQ ID NO: 644433 - DNA, 25 bp, Homo sapien
gcaggcccctaataaatatgatttg

SEQ ID NO: 644434 - DNA, 25 bp, Homo sapien
gaaaaggtaactgtggtccaggcca

SEQ ID NO: 644435 - DNA, 25 bp, Homo sapien
aaggtaactgtggtccaggccaggc

SEQ ID NO: 644436 - DNA, 25 bp, Homo sapien
gctgctggggcataagctgcttcat

SEQ ID NO: 644437 - DNA, 25 bp, Homo sapien
aagctgcttcattcaaaattgttgg

SEQ ID NO: 644438 - DNA, 25 bp, Homo sapien
ttcaaaattgttgggcctgccttca

SEQ ID NO: 644439 - DNA, 25 bp, Homo sapien
aaattgttgggcctgccttcaggaa

SEQ ID NO: 644440 - DNA, 25 bp, Homo sapien
tgttaggaaggttcacagcctttcc

SEQ ID NO: 644441 - DNA, 25 bp, Homo sapien
tttcccctcttgaggcagtatcagt

SEQ ID NO: 644442 - DNA, 25 bp, Homo sapien
ccctcttgaggcagtatcagtggta

SEQ ID NO: 644443 - DNA, 25 bp, Homo sapien
ggcagtatcagtggtatgtatacac

SEQ ID NO: 644444 - DNA, 25 bp, Homo sapien
gtatgtatacactccaggttgtccc

SEQ ID NO: 644445 - DNA, 25 bp, Homo sapien
tcacttaatgctttgattcatccat

SEQ ID NO: 644446 - DNA, 25 bp, Homo sapien
atgtttgttgatgcttggttgtttt

SEQ ID NO: 644447 - DNA, 25 bp, Homo sapien
ttggttgttttttacagctgagtag

SEQ ID NO: 644448 - DNA, 25 bp, Homo sapien
agtatgtttattcgccatttgatga

SEQ ID NO: 644449 - DNA, 25 bp, Homo sapien
tgaacaatttttggcatttaggaat

SEQ ID NO: 644450 - DNA, 25 bp, Homo sapien
gtaaacattcatgtgctgttctttg

SEQ ID NO: 644451 - DNA, 25 bp, Homo sapien
gctgttctttgtacattaaggtgca

SEQ ID NO: 644452 - DNA, 25 bp, Homo sapien
aaggtgcaagtctttgtgtagacat

SEQ ID NO: 644453 - DNA, 25 bp, Homo sapien
catttcttttggttacacatctagg

SEQ ID NO: 644454 - DNA, 25 bp, Homo sapien
aatggaattcttgggccgtgtgcaa

SEQ ID NO: 644455 - DNA, 25 bp, Homo sapien
gtgtgcaagtgcatgtttaacctta

SEQ ID NO: 644456 - DNA, 25 bp, Homo sapien
tttttaaatagctgcagtaatcccg

SEQ ID NO: 644457 - DNA, 25 bp, Homo sapien
ttttaaatagctgcagtaatcccgg

SEQ ID NO: 644458 - DNA, 25 bp, Homo sapien
tttaaatagctgcagtaatcccggc

SEQ ID NO: 644459 - DNA, 25 bp, Homo sapien
ttaaatagctgcagtaatcccggct

SEQ ID NO: 644460 - DNA, 25 bp, Homo sapien
taaatagctgcagtaatcccggctt

SEQ ID NO: 644461 - DNA, 25 bp, Homo sapien
aaatagctgcagtaatcccggcttt

SEQ ID NO: 644462 - DNA, 25 bp, Homo sapien
aatagctgcagtaatcccggcttta

SEQ ID NO: 644463 - DNA, 25 bp, Homo sapien
atagctgcagtaatcccggctttag

SEQ ID NO: 644464 - DNA, 25 bp, Homo sapien
tagctgcagtaatcccggctttaga

SEQ ID NO: 644465 - DNA, 25 bp, Homo sapien
agctgcagtaatcccggctttagat

SEQ ID NO: 644466 - DNA, 25 bp, Homo sapien
gaactaataatatcactagtgttca

SEQ ID NO: 644467 - DNA, 25 bp, Homo sapien
taaagccttagttttaactggacag

SEQ ID NO: 644468 - DNA, 25 bp, Homo sapien
tggacaggtaagtaccttgcccagt

SEQ ID NO: 644469 - DNA, 25 bp, Homo sapien
aggtaagtaccttgcccagtcacag

SEQ ID NO: 644470 - DNA, 25 bp, Homo sapien
ttgcccagtcacagatgtaatacat

SEQ ID NO: 644471 - DNA, 25 bp, Homo sapien
gttgactgtatagccacggttcact

SEQ ID NO: 644472 - DNA, 25 bp, Homo sapien
tgtatagccacggttcactcttctc

SEQ ID NO: 644473 - DNA, 25 bp, Homo sapien
ggcctctgccagagaaactagtgca

SEQ ID NO: 644474 - DNA, 25 bp, Homo sapien
gccagagaaactagtgcaaatgcca

SEQ ID NO: 644475 - DNA, 25 bp, Homo sapien
cagcaagtgagggtgggaatcttat

SEQ ID NO: 644476 - DNA, 25 bp, Homo sapien
gtgagggtgggaatcttattagaaa

SEQ ID NO: 644477 - DNA, 25 bp, Homo sapien
ctatgtctatatatgaacttacaga

SEQ ID NO: 644478 - DNA, 25 bp, Homo sapien
cattgagggcatgggcagaatctgc

SEQ ID NO: 644479 - DNA, 25 bp, Homo sapien
agcattgaaagccaatatgaggcca

SEQ ID NO: 644480 - DNA, 25 bp, Homo sapien
gcattgaaagccaatatgaggccag

SEQ ID NO: 644481 - DNA, 25 bp, Homo sapien
cattgaaagccaatatgaggccagg

SEQ ID NO: 644482 - DNA, 25 bp, Homo sapien
attgaaagccaatatgaggccaggt

SEQ ID NO: 644483 - DNA, 25 bp, Homo sapien
ttgaaagccaatatgaggccaggtg

SEQ ID NO: 644484 - DNA, 25 bp, Homo sapien
tgaaagccaatatgaggccaggtgg

SEQ ID NO: 644485 - DNA, 25 bp, Homo sapien
gaaagccaatatgaggccaggtggt

SEQ ID NO: 644486 - DNA, 25 bp, Homo sapien
aaagccaatatgaggccaggtggtg

SEQ ID NO: 644487 - DNA, 25 bp, Homo sapien
aagccaatatgaggccaggtggtgg

SEQ ID NO: 644488 - DNA, 25 bp, Homo sapien
actacagccctgaccatagacccag

SEQ ID NO: 644489 - DNA, 25 bp, Homo sapien
tgaccatagacccagccaggtagct

SEQ ID NO: 644490 - DNA, 25 bp, Homo sapien
gccaggtagctcttggggtctctag

SEQ ID NO: 644491 - DNA, 25 bp, Homo sapien
ttggggtctctagcgtcccagggcc

SEQ ID NO: 644492 - DNA, 25 bp, Homo sapien
tcgccccacagggacctggacacgc

SEQ ID NO: 644493 - DNA, 25 bp, Homo sapien
ggttggatgggccattttctgtcct

SEQ ID NO: 644494 - DNA, 25 bp, Homo sapien
ttggatgggccattttctgtcctat

SEQ ID NO: 644495 - DNA, 25 bp, Homo sapien
tggatgggccattttctgtcctatc

SEQ ID NO: 644496 - DNA, 25 bp, Homo sapien
ggatgggccattttctgtcctatcc

SEQ ID NO: 644497 - DNA, 25 bp, Homo sapien
atgggccattttctgtcctatccct

SEQ ID NO: 644498 - DNA, 25 bp, Homo sapien
tgggccattttctgtcctatccctc

SEQ ID NO: 644499 - DNA, 25 bp, Homo sapien
attcacttctaagcccacctatgtt

SEQ ID NO: 644500 - DNA, 25 bp, Homo sapien
cacctatgttgcttttggccagaaa

SEQ ID NO: 644501 - DNA, 25 bp, Homo sapien
ttttggccagaaacatcagttcctt

SEQ ID NO: 644502 - DNA, 25 bp, Homo sapien
agaaacatcagttccttgtcatggg

SEQ ID NO: 644503 - DNA, 25 bp, Homo sapien
tccgcacagggctgctcacaacagg

SEQ ID NO: 644504 - DNA, 25 bp, Homo sapien
agcagctgcagtctttggtgaccag

SEQ ID NO: 644505 - DNA, 25 bp, Homo sapien
agattgtgaaagtgacactccgtct

SEQ ID NO: 644506 - DNA, 25 bp, Homo sapien
acactccgtctcttttgctgtgtca

SEQ ID NO: 644507 - DNA, 25 bp, Homo sapien
tgctgtgtcagaagtcagtcaccag

SEQ ID NO: 644508 - DNA, 25 bp, Homo sapien
caccaggcatggtccacactcaagg

SEQ ID NO: 644509 - DNA, 25 bp, Homo sapien
caaggaaatgaactgggttttgctt

SEQ ID NO: 644510 - DNA, 25 bp, Homo sapien
ctcgagtggcagtggccaaaggcct

SEQ ID NO: 644511 - DNA, 25 bp, Homo sapien
tcgagtggcagtggccaaaggcctg

SEQ ID NO: 644512 - DNA, 25 bp, Homo sapien
cgagtggcagtggccaaaggcctgg

SEQ ID NO: 644513 - DNA, 25 bp, Homo sapien
gagtggcagtggccaaaggcctgga

SEQ ID NO: 644514 - DNA, 25 bp, Homo sapien
agtggcagtggccaaaggcctggag

SEQ ID NO: 644515 - DNA, 25 bp, Homo sapien
gtggcagtggccaaaggcctggagc

SEQ ID NO: 644516 - DNA, 25 bp, Homo sapien
tggccaaaggcctggagccgaccaa

SEQ ID NO: 644517 - DNA, 25 bp, Homo sapien
ggccaaaggcctggagccgaccaag

SEQ ID NO: 644518 - DNA, 25 bp, Homo sapien
gccaaaggcctggagccgaccaagg

SEQ ID NO: 644519 - DNA, 25 bp, Homo sapien
ccaaaggcctggagccgaccaagga

SEQ ID NO: 644520 - DNA, 25 bp, Homo sapien
caaaggcctggagccgaccaaggag

SEQ ID NO: 644521 - DNA, 25 bp, Homo sapien
gcagtttcaggttcaaaattgagca

SEQ ID NO: 644522 - DNA, 25 bp, Homo sapien
tcaggttcaaaattgagcagaggct

SEQ ID NO: 644523 - DNA, 25 bp, Homo sapien
gactggcctaggcaatatggcgaaa

SEQ ID NO: 644524 - DNA, 25 bp, Homo sapien
gcccaggaggcaaagattgcgatga

SEQ ID NO: 644525 - DNA, 25 bp, Homo sapien
aggaggcaaagattgcgatgagccc

SEQ ID NO: 644526 - DNA, 25 bp, Homo sapien
gcaaagattgcgatgagcccagact

SEQ ID NO: 644527 - DNA, 25 bp, Homo sapien
caaagattgcgatgagcccagactg

SEQ ID NO: 644528 - DNA, 25 bp, Homo sapien
aaagattgcgatgagcccagactgc

SEQ ID NO: 644529 - DNA, 25 bp, Homo sapien
aagattgcgatgagcccagactgca

SEQ ID NO: 644530 - DNA, 25 bp, Homo sapien
gatgagcccagactgcaccactgga

SEQ ID NO: 644531 - DNA, 25 bp, Homo sapien
gcccagactgcaccactggacttca

SEQ ID NO: 644532 - DNA, 25 bp, Homo sapien
gaaaagctgacattccctgggactt

SEQ ID NO: 644533 - DNA, 25 bp, Homo sapien
gggacttgaaatgttaactctggat

SEQ ID NO: 644534 - DNA, 25 bp, Homo sapien
ctctggatttccttaatagctataa

SEQ ID NO: 644535 - DNA, 25 bp, Homo sapien
ctttcctactgtggcaattgttgtg

SEQ ID NO: 644536 - DNA, 25 bp, Homo sapien
tgtggcaattgttgtgagctagaac

SEQ ID NO: 644537 - DNA, 25 bp, Homo sapien
gagctagaacatgtttatacctttt

SEQ ID NO: 644538 - DNA, 25 bp, Homo sapien
aaatattttatctgagactcctgct

SEQ ID NO: 644539 - DNA, 25 bp, Homo sapien
tatctgagactcctgctactattgc

SEQ ID NO: 644540 - DNA, 25 bp, Homo sapien
tgctactattgccacccgatgcatc

SEQ ID NO: 644541 - DNA, 25 bp, Homo sapien
cccgatgcatcttccaaaaggtaaa

SEQ ID NO: 644542 - DNA, 25 bp, Homo sapien
ctcagaaatctgaattggtcccatt

SEQ ID NO: 644543 - DNA, 25 bp, Homo sapien
aacctcctgagctcacttttaagca

SEQ ID NO: 644544 - DNA, 25 bp, Homo sapien
cctcctgagctcacttttaagcaat

SEQ ID NO: 644545 - DNA, 25 bp, Homo sapien
tgagctcacttttaagcaatcctct

SEQ ID NO: 644546 - DNA, 25 bp, Homo sapien
agctcacttttaagcaatcctctca

SEQ ID NO: 644547 - DNA, 25 bp, Homo sapien
aggcatgtaccaacactcccagcaa

SEQ ID NO: 644548 - DNA, 25 bp, Homo sapien
cactcccagcaagtttttcttattt

SEQ ID NO: 644549 - DNA, 25 bp, Homo sapien
gaagacagagtcttgcagtattgcc

SEQ ID NO: 644550 - DNA, 25 bp, Homo sapien
agccactgtgccaagcaacacttgc

SEQ ID NO: 644551 - DNA, 25 bp, Homo sapien
actgtgccaagcaacacttgcagtt

SEQ ID NO: 644552 - DNA, 25 bp, Homo sapien
gtgccaagcaacacttgcagttttt

SEQ ID NO: 644553 - DNA, 25 bp, Homo sapien
gccaagcaacacttgcagtttttaa

SEQ ID NO: 644554 - DNA, 25 bp, Homo sapien
ggggacagtgcaaccacatgttcta

SEQ ID NO: 644555 - DNA, 25 bp, Homo sapien
ttctaggtgttcagtagaacttcaa

SEQ ID NO: 644556 - DNA, 25 bp, Homo sapien
gttcagtagaacttcaaacatcaaa

SEQ ID NO: 644557 - DNA, 25 bp, Homo sapien
aaacatcaaaaaattactggccagg

SEQ ID NO: 644558 - DNA, 25 bp, Homo sapien
aaaacctgcagaagactgacagtaa

SEQ ID NO: 644559 - DNA, 25 bp, Homo sapien
aaagtgaggatatttgcagattgaa

SEQ ID NO: 644560 - DNA, 25 bp, Homo sapien
aaattgtctcaggaggatttcccag

SEQ ID NO: 644561 - DNA, 25 bp, Homo sapien
gtctcaggaggatttcccagcatca

SEQ ID NO: 644562 - DNA, 25 bp, Homo sapien
ggatttcccagcatcataatcttcc

SEQ ID NO: 644563 - DNA, 25 bp, Homo sapien
cccagcatcataatcttcctgaaca

SEQ ID NO: 644564 - DNA, 25 bp, Homo sapien
cactgaattctctagttaactacag

SEQ ID NO: 644565 - DNA, 25 bp, Homo sapien
ggttataaactcttgtcccaaacag

SEQ ID NO: 644566 - DNA, 25 bp, Homo sapien
tcccaaacagtactgaaggccagct

SEQ ID NO: 644567 - DNA, 25 bp, Homo sapien
gccagctgtgcttgtatattaccat

SEQ ID NO: 644568 - DNA, 25 bp, Homo sapien
gaagctttatatccctacctcttaa

SEQ ID NO: 644569 - DNA, 25 bp, Homo sapien
taacatcccttgcatccaaaaccaa

SEQ ID NO: 644570 - DNA, 25 bp, Homo sapien
gggattggttcacccactaaatgat

SEQ ID NO: 644571 - DNA, 25 bp, Homo sapien
actaaatgatcttgtcatccttgag

SEQ ID NO: 644572 - DNA, 25 bp, Homo sapien
ccagcctacttgagactattttaaa

SEQ ID NO: 644573 - DNA, 25 bp, Homo sapien
taaactaagttatcagcctgaggat

SEQ ID NO: 644574 - DNA, 25 bp, Homo sapien
tcagcctgaggattttccagaccac

SEQ ID NO: 644575 - DNA, 25 bp, Homo sapien
ggattttccagaccacatgggttat

SEQ ID NO: 644576 - DNA, 25 bp, Homo sapien
actgaaccatctgctggaggacctc

SEQ ID NO: 644577 - DNA, 25 bp, Homo sapien
ttgtgtccaacacagtccttctgtt

SEQ ID NO: 644578 - DNA, 25 bp, Homo sapien
acacagtccttctgttgaatgtcat

SEQ ID NO: 644579 - DNA, 25 bp, Homo sapien
cagtgaggagaagaccgtgctcatc

SEQ ID NO: 644580 - DNA, 25 bp, Homo sapien
tcatctttcagtttttgagccacat

SEQ ID NO: 644581 - DNA, 25 bp, Homo sapien
gtttttgagccacatctacctaatt

SEQ ID NO: 644582 - DNA, 25 bp, Homo sapien
tagtcaggtttggtagcctcagcac

SEQ ID NO: 644583 - DNA, 25 bp, Homo sapien
ggtagcctcagcactactgatattt

SEQ ID NO: 644584 - DNA, 25 bp, Homo sapien
aaggtattgaatagcatccccagtt

SEQ ID NO: 644585 - DNA, 25 bp, Homo sapien
cacacccaccagataccagtatata

SEQ ID NO: 644586 - DNA, 25 bp, Homo sapien
atacgcatggtacactgaaccatct

SEQ ID NO: 644587 - DNA, 25 bp, Homo sapien
cactagattagttttgccagtttag

SEQ ID NO: 644588 - DNA, 25 bp, Homo sapien
ggaattgtatatgtcctttaatata

SEQ ID NO: 644589 - DNA, 25 bp, Homo sapien
atatttggcttctttgactcaacat

SEQ ID NO: 644590 - DNA, 25 bp, Homo sapien
tttggcttctttgactcaacatgtt

SEQ ID NO: 644591 - DNA, 25 bp, Homo sapien
ttgagattcatttatttggttgcat

SEQ ID NO: 644592 - DNA, 25 bp, Homo sapien
atttggttgcatgtaccggtagatt

SEQ ID NO: 644593 - DNA, 25 bp, Homo sapien
tgcatgtaccggtagattgatctat

SEQ ID NO: 644594 - DNA, 25 bp, Homo sapien
agattgatctattttattgctaagt

SEQ ID NO: 644595 - DNA, 25 bp, Homo sapien
attgctaagtactattttcattata

SEQ ID NO: 644596 - DNA, 25 bp, Homo sapien
attttcattatagggctataccatg

SEQ ID NO: 644597 - DNA, 25 bp, Homo sapien
gttcatgtagtcatttttggacatt

SEQ ID NO: 644598 - DNA, 25 bp, Homo sapien
aaatgtgcattagctattgacttag

SEQ ID NO: 644599 - DNA, 25 bp, Homo sapien
gagtgaattgccttttgtatcctga

SEQ ID NO: 644600 - DNA, 25 bp, Homo sapien
gtatcctgattcacaacacctattc

SEQ ID NO: 644601 - DNA, 25 bp, Homo sapien
cacaacacctattcctgttcagtat

SEQ ID NO: 644602 - DNA, 25 bp, Homo sapien
tcagtattctttgtcttgaatagag

SEQ ID NO: 644603 - DNA, 25 bp, Homo sapien
tctttgtcttgaatagagaagtcta

SEQ ID NO: 644604 - DNA, 25 bp, Homo sapien
gagaagtctatgttcgtaaagtcat

SEQ ID NO: 644605 - DNA, 25 bp, Homo sapien
gaagtctatgttcgtaaagtcatat

SEQ ID NO: 644606 - DNA, 25 bp, Homo sapien
gtctatgttcgtaaagtcatataaa

SEQ ID NO: 644607 - DNA, 25 bp, Homo sapien
gtcatataaaaggttataccactat

SEQ ID NO: 644608 - DNA, 25 bp, Homo sapien
tataaaaggttataccactatttag

SEQ ID NO: 644609 - DNA, 25 bp, Homo sapien
caagaaaaaacactgggtcgagtgc

SEQ ID NO: 644610 - DNA, 25 bp, Homo sapien
aagaaaaaacactgggtcgagtgcg

SEQ ID NO: 644611 - DNA, 25 bp, Homo sapien
agaaaaaacactgggtcgagtgcgg

SEQ ID NO: 644612 - DNA, 25 bp, Homo sapien
aaaaaacactgggtcgagtgcggct

SEQ ID NO: 644613 - DNA, 25 bp, Homo sapien
aaaaacactgggtcgagtgcggctc

SEQ ID NO: 644614 - DNA, 25 bp, Homo sapien
aaaacactgggtcgagtgcggctca

SEQ ID NO: 644615 - DNA, 25 bp, Homo sapien
aaacactgggtcgagtgcggctcaa

SEQ ID NO: 644616 - DNA, 25 bp, Homo sapien
aacactgggtcgagtgcggctcaag

SEQ ID NO: 644617 - DNA, 25 bp, Homo sapien
acactgggtcgagtgcggctcaagc

SEQ ID NO: 644618 - DNA, 25 bp, Homo sapien
actgggtcgagtgcggctcaagcct

SEQ ID NO: 644619 - DNA, 25 bp, Homo sapien
ggtcgagtgcggctcaagcctgtaa

SEQ ID NO: 644620 - DNA, 25 bp, Homo sapien
gaaaccaggttatccagaatagtgt

SEQ ID NO: 644621 - DNA, 25 bp, Homo sapien
tgttcctaccttgtaaccacaatgg

SEQ ID NO: 644622 - DNA, 25 bp, Homo sapien
accacaatggatttccagctcttac

SEQ ID NO: 644623 - DNA, 25 bp, Homo sapien
ttcaagctgtggacctctgctttct

SEQ ID NO: 644624 - DNA, 25 bp, Homo sapien
gacctctgctttctgcaaactgcaa

SEQ ID NO: 644625 - DNA, 25 bp, Homo sapien
gcaaactgcaatctcttaccagtct

SEQ ID NO: 644626 - DNA, 25 bp, Homo sapien
ctcttaccagtctcttctagttgaa

SEQ ID NO: 644627 - DNA, 25 bp, Homo sapien
agttgaactgtcatcttctcattta

SEQ ID NO: 644628 - DNA, 25 bp, Homo sapien
ctaaattattctttgctatccgtaa

SEQ ID NO: 644629 - DNA, 25 bp, Homo sapien
atccgtaatttctctgcagcatcag

SEQ ID NO: 644630 - DNA, 25 bp, Homo sapien
ctgcagcatcagtttcctatcatta

SEQ ID NO: 644631 - DNA, 25 bp, Homo sapien
aagtaacaacagcaacccatgatta

SEQ ID NO: 644632 - DNA, 25 bp, Homo sapien
gcaacccatgattacaggctgccat

SEQ ID NO: 644633 - DNA, 25 bp, Homo sapien
aggctgccatgacattacctgaccc

SEQ ID NO: 644634 - DNA, 25 bp, Homo sapien
tgggccctcgtgagatttgtgatct

SEQ ID NO: 644635 - DNA, 25 bp, Homo sapien
agatttgtgatcttaatcccacggg

SEQ ID NO: 644636 - DNA, 25 bp, Homo sapien
gggcaagagcacacgctgtcattag

SEQ ID NO: 644637 - DNA, 25 bp, Homo sapien
gagcacacgctgtcattagttgcct

SEQ ID NO: 644638 - DNA, 25 bp, Homo sapien
acacgctgtcattagttgccttcac

SEQ ID NO: 644639 - DNA, 25 bp, Homo sapien
attagttgccttcaccttgttgtat

SEQ ID NO: 644640 - DNA, 25 bp, Homo sapien
ttgccttcaccttgttgtatttctg

SEQ ID NO: 644641 - DNA, 25 bp, Homo sapien
caccttgttgtatttctgctggatt

SEQ ID NO: 644642 - DNA, 25 bp, Homo sapien
catcggtacagagaggtaggcctct

SEQ ID NO: 644643 - DNA, 25 bp, Homo sapien
tctgccttctgccaagactttcaat

SEQ ID NO: 644644 - DNA, 25 bp, Homo sapien
gactttcaatcaagaatctcccaga

SEQ ID NO: 644645 - DNA, 25 bp, Homo sapien
gtttggttgctggatgtcctcaaca

SEQ ID NO: 644646 - DNA, 25 bp, Homo sapien
accaatacccataaagacctgcact

SEQ ID NO: 644647 - DNA, 25 bp, Homo sapien
aaagacctgcactattttgtagaaa

SEQ ID NO: 644648 - DNA, 25 bp, Homo sapien
gagacgtgagcaacttatcaatgtc

SEQ ID NO: 644649 - DNA, 25 bp, Homo sapien
gtgtatatgtagaccatggccttga

SEQ ID NO: 644650 - DNA, 25 bp, Homo sapien
ggccttgaatgtccatgatctctgt

SEQ ID NO: 644651 - DNA, 25 bp, Homo sapien
atgtccatgatctctgtatagcagc

SEQ ID NO: 644652 - DNA, 25 bp, Homo sapien
gtatagcagcacaggacaattaaca

SEQ ID NO: 644653 - DNA, 25 bp, Homo sapien
ctcttccacaggtcctatgactgca

SEQ ID NO: 644654 - DNA, 25 bp, Homo sapien
tcttccacaggtcctatgactgcaa

SEQ ID NO: 644655 - DNA, 25 bp, Homo sapien
cttccacaggtcctatgactgcaac

SEQ ID NO: 644656 - DNA, 25 bp, Homo sapien
ttccacaggtcctatgactgcaaca

SEQ ID NO: 644657 - DNA, 25 bp, Homo sapien
tccacaggtcctatgactgcaacat

SEQ ID NO: 644658 - DNA, 25 bp, Homo sapien
ccacaggtcctatgactgcaacatc

SEQ ID NO: 644659 - DNA, 25 bp, Homo sapien
cacaggtcctatgactgcaacatcc

SEQ ID NO: 644660 - DNA, 25 bp, Homo sapien
caggtcctatgactgcaacatcctt

SEQ ID NO: 644661 - DNA, 25 bp, Homo sapien
aggtcctatgactgcaacatccttc

SEQ ID NO: 644662 - DNA, 25 bp, Homo sapien
ggtcctatgactgcaacatccttcc

SEQ ID NO: 644663 - DNA, 25 bp, Homo sapien
gtcctatgactgcaacatccttcca

SEQ ID NO: 644664 - DNA, 25 bp, Homo sapien
agccaaaacctctacatccctacat

SEQ ID NO: 644665 - DNA, 25 bp, Homo sapien
tctacatccctacattcacacactt

SEQ ID NO: 644666 - DNA, 25 bp, Homo sapien
tacattcacacacttcctccacaca

SEQ ID NO: 644667 - DNA, 25 bp, Homo sapien
accagtataggaagcagcacaccca

SEQ ID NO: 644668 - DNA, 25 bp, Homo sapien
ccagtataggaagcagcacacccat

SEQ ID NO: 644669 - DNA, 25 bp, Homo sapien
cagtataggaagcagcacacccatg

SEQ ID NO: 644670 - DNA, 25 bp, Homo sapien
agtataggaagcagcacacccatgg

SEQ ID NO: 644671 - DNA, 25 bp, Homo sapien
gtataggaagcagcacacccatggc

SEQ ID NO: 644672 - DNA, 25 bp, Homo sapien
tataggaagcagcacacccatggcc

SEQ ID NO: 644673 - DNA, 25 bp, Homo sapien
ataggaagcagcacacccatggccc

SEQ ID NO: 644674 - DNA, 25 bp, Homo sapien
taggaagcagcacacccatggccca

SEQ ID NO: 644675 - DNA, 25 bp, Homo sapien
ggacgacctgtttgagaccatcttc

SEQ ID NO: 644676 - DNA, 25 bp, Homo sapien
gacgacctgtttgagaccatcttca

SEQ ID NO: 644677 - DNA, 25 bp, Homo sapien
acgacctgtttgagaccatcttcag

SEQ ID NO: 644678 - DNA, 25 bp, Homo sapien
gacctgtttgagaccatcttcagca

SEQ ID NO: 644679 - DNA, 25 bp, Homo sapien
accatcttcagcacggcacaccggg

SEQ ID NO: 644680 - DNA, 25 bp, Homo sapien
gacaagcaccagatccacgatgctg

SEQ ID NO: 644681 - DNA, 25 bp, Homo sapien
aagcaccagatccacgatgctgacg

SEQ ID NO: 644682 - DNA, 25 bp, Homo sapien
agcaccagatccacgatgctgacgt

SEQ ID NO: 644683 - DNA, 25 bp, Homo sapien
accagatccacgatgctgacgtgcg

SEQ ID NO: 644684 - DNA, 25 bp, Homo sapien
agatccacgatgctgacgtgcgcca

SEQ ID NO: 644685 - DNA, 25 bp, Homo sapien
gatccacgatgctgacgtgcgccac

SEQ ID NO: 644686 - DNA, 25 bp, Homo sapien
attaccaaggtcatataactagcaa

SEQ ID NO: 644687 - DNA, 25 bp, Homo sapien
aatttgatagccaggattgcagtct

SEQ ID NO: 644688 - DNA, 25 bp, Homo sapien
ggattgcagtctatgtctcctgaat

SEQ ID NO: 644689 - DNA, 25 bp, Homo sapien
tatgtctcctgaattccagatccca

SEQ ID NO: 644690 - DNA, 25 bp, Homo sapien
cacattcctatccagtacaccatat

SEQ ID NO: 644691 - DNA, 25 bp, Homo sapien
accatatttatgcaaactgtgcgga

SEQ ID NO: 644692 - DNA, 25 bp, Homo sapien
gcaaactgtgcggaactctcaacct

SEQ ID NO: 644693 - DNA, 25 bp, Homo sapien
actctcaacctcctgattacttaag

SEQ ID NO: 644694 - DNA, 25 bp, Homo sapien
aagtccagtggttacatatatgcat

SEQ ID NO: 644695 - DNA, 25 bp, Homo sapien
ttcatttcttattcaactctatggg

SEQ ID NO: 644696 - DNA, 25 bp, Homo sapien
gggtaggtgttatagccactttata

SEQ ID NO: 644697 - DNA, 25 bp, Homo sapien
gaaggcgggcctgaaatccaacgac

SEQ ID NO: 644698 - DNA, 25 bp, Homo sapien
gcgggcctgaaatccaacgactggt

SEQ ID NO: 644699 - DNA, 25 bp, Homo sapien
gaaatccaacgactggtgaccttat

SEQ ID NO: 644700 - DNA, 25 bp, Homo sapien
ccaacgactggtgaccttataagga

SEQ ID NO: 644701 - DNA, 25 bp, Homo sapien
ttcaaagacccaggcagtcatagag

SEQ ID NO: 644702 - DNA, 25 bp, Homo sapien
agacccaggcagtcatagagggaag

SEQ ID NO: 644703 - DNA, 25 bp, Homo sapien
tgggtttctgttgccaccgaggctg

SEQ ID NO: 644704 - DNA, 25 bp, Homo sapien
tgttgccaccgaggctgccagaaga

SEQ ID NO: 644705 - DNA, 25 bp, Homo sapien
tgccaccgaggctgccagaagaggc

SEQ ID NO: 644706 - DNA, 25 bp, Homo sapien
tagagccttcagaggcagatgcctg

SEQ ID NO: 644707 - DNA, 25 bp, Homo sapien
gccctgctgacggtttggttttgaa

SEQ ID NO: 644708 - DNA, 25 bp, Homo sapien
tctcctcttttaaacatgtagctga

SEQ ID NO: 644709 - DNA, 25 bp, Homo sapien
gttaagtgaccttgctcaaacgttt

SEQ ID NO: 644710 - DNA, 25 bp, Homo sapien
gtgaccttgctcaaacgttttagtt

SEQ ID NO: 644711 - DNA, 25 bp, Homo sapien
cttgctcaaacgttttagttttgtg

SEQ ID NO: 644712 - DNA, 25 bp, Homo sapien
aatcaaacggaacatccaacccaag

SEQ ID NO: 644713 - DNA, 25 bp, Homo sapien
gaacatccaacccaagatcctgtag

SEQ ID NO: 644714 - DNA, 25 bp, Homo sapien
gatcctgtaggaacacctaccttaa

SEQ ID NO: 644715 - DNA, 25 bp, Homo sapien
gaacacctaccttaagcacatatct

SEQ ID NO: 644716 - DNA, 25 bp, Homo sapien
gcacatatctgaatgggtaacatga

SEQ ID NO: 644717 - DNA, 25 bp, Homo sapien
gtaacatgatgaggtacctgtaaaa

SEQ ID NO: 644718 - DNA, 25 bp, Homo sapien
tattaacaatatcatgacatagcat

SEQ ID NO: 644719 - DNA, 25 bp, Homo sapien
cacatgcggtgtcagccacagtggt

SEQ ID NO: 644720 - DNA, 25 bp, Homo sapien
agccccagaggtagtggattctgtg

SEQ ID NO: 644721 - DNA, 25 bp, Homo sapien
tctgtgctgacagggccagtggcct

SEQ ID NO: 644722 - DNA, 25 bp, Homo sapien
gaatgcctcctacagttgtgtgaat

SEQ ID NO: 644723 - DNA, 25 bp, Homo sapien
aatggaaagactttcactcagcact

SEQ ID NO: 644724 - DNA, 25 bp, Homo sapien
gcctggtggtgtctttgataccttc

SEQ ID NO: 644725 - DNA, 25 bp, Homo sapien
gtggtgtctttgataccttctgctc

SEQ ID NO: 644726 - DNA, 25 bp, Homo sapien
gtctttgataccttctgctcctgct

SEQ ID NO: 644727 - DNA, 25 bp, Homo sapien
ctgctgcagctggtgataacatttt

SEQ ID NO: 644728 - DNA, 25 bp, Homo sapien
taacatttttcagatatcacctcac

SEQ ID NO: 644729 - DNA, 25 bp, Homo sapien
acccagcctcagaagttgttgtgca

SEQ ID NO: 644730 - DNA, 25 bp, Homo sapien
attctttctttctatccatccctgg

SEQ ID NO: 644731 - DNA, 25 bp, Homo sapien
ctttctatccatccctggagagaga

SEQ ID NO: 644732 - DNA, 25 bp, Homo sapien
gggagaggaagcttcttccatgcca

SEQ ID NO: 644733 - DNA, 25 bp, Homo sapien
gaagcttcttccatgccacatggag

SEQ ID NO: 644734 - DNA, 25 bp, Homo sapien
ccacatggagacaaacgggcttcag

SEQ ID NO: 644735 - DNA, 25 bp, Homo sapien
gacaaacgggcttcagacatcttct

SEQ ID NO: 644736 - DNA, 25 bp, Homo sapien
acgggcttcagacatcttctagtga

SEQ ID NO: 644737 - DNA, 25 bp, Homo sapien
atcttctagtgaaagaccaacgtat

SEQ ID NO: 644738 - DNA, 25 bp, Homo sapien
agaccaacgtataggaagcatcatt

SEQ ID NO: 644739 - DNA, 25 bp, Homo sapien
aattatacacatatccttttgtgtt

SEQ ID NO: 644740 - DNA, 25 bp, Homo sapien
gagtaacactctattgatgagaatt

SEQ ID NO: 644741 - DNA, 25 bp, Homo sapien
atcaaagcgctttgaagagtccaaa

SEQ ID NO: 644742 - DNA, 25 bp, Homo sapien
aagagattactccaggcccagcaac

SEQ ID NO: 644743 - DNA, 25 bp, Homo sapien
ttactccaggcccagcaacatatga

SEQ ID NO: 644744 - DNA, 25 bp, Homo sapien
gcaacatatgagatatcccaggaga

SEQ ID NO: 644745 - DNA, 25 bp, Homo sapien
aaatctcattggtgaaatggctgct

SEQ ID NO: 644746 - DNA, 25 bp, Homo sapien
gaaatggctgctgatataatgtgac

SEQ ID NO: 644747 - DNA, 25 bp, Homo sapien
acttcatggaagtcagtttatttct

SEQ ID NO: 644748 - DNA, 25 bp, Homo sapien
attttcacttgttcaggcattcgct

SEQ ID NO: 644749 - DNA, 25 bp, Homo sapien
aggcattcgctcaggctttagtgac

SEQ ID NO: 644750 - DNA, 25 bp, Homo sapien
tgactatatgacacaaccacggaga

SEQ ID NO: 644751 - DNA, 25 bp, Homo sapien
cacggagaaataaaccttgaagact

SEQ ID NO: 644752 - DNA, 25 bp, Homo sapien
gtactccttagtgatatcctacatt

SEQ ID NO: 644753 - DNA, 25 bp, Homo sapien
gtgatatcctacattgatggcccta

SEQ ID NO: 644754 - DNA, 25 bp, Homo sapien
gatggccctaggtttttatttcaat

SEQ ID NO: 644755 - DNA, 25 bp, Homo sapien
ttgttaactggctttaggcatcatt

SEQ ID NO: 644756 - DNA, 25 bp, Homo sapien
gcatcattaaaactcattgtgtcaa

SEQ ID NO: 644757 - DNA, 25 bp, Homo sapien
tgctcgtcatttcctaagtttttaa

SEQ ID NO: 644758 - DNA, 25 bp, Homo sapien
aaagcattctagattttcccttata

SEQ ID NO: 644759 - DNA, 25 bp, Homo sapien
tttcccttatatctagattatcatc

SEQ ID NO: 644760 - DNA, 25 bp, Homo sapien
gggaagtctcctgatctccaatgtt

SEQ ID NO: 644761 - DNA, 25 bp, Homo sapien
gatctccaatgttccttaatgtagt

SEQ ID NO: 644762 - DNA, 25 bp, Homo sapien
ccttaatgtagtaactgtggctgcc

SEQ ID NO: 644763 - DNA, 25 bp, Homo sapien
attcaagtctacacaaactttcctg

SEQ ID NO: 644764 - DNA, 25 bp, Homo sapien
cccacctgtttcttactttatgaga

SEQ ID NO: 644765 - DNA, 25 bp, Homo sapien
ttatgagaccacacctaaaagatag

SEQ ID NO: 644766 - DNA, 25 bp, Homo sapien
gactgctttgcaaccaagaaatcct

SEQ ID NO: 644767 - DNA, 25 bp, Homo sapien
gaaatccttcatgaacacctcttta

SEQ ID NO: 644768 - DNA, 25 bp, Homo sapien
aacacctctttaatcacaagtcctc

SEQ ID NO: 644769 - DNA, 25 bp, Homo sapien
ttaatcacaagtcctcaactccaag

SEQ ID NO: 644770 - DNA, 25 bp, Homo sapien
caactccaaggttagctttatttca

SEQ ID NO: 644771 - DNA, 25 bp, Homo sapien
cttttcttgatagctttaccaccca

SEQ ID NO: 644772 - DNA, 25 bp, Homo sapien
ttaccacccatgtattcattcctaa

SEQ ID NO: 644773 - DNA, 25 bp, Homo sapien
aaatacacagttttgtctgattttg

SEQ ID NO: 644774 - DNA, 25 bp, Homo sapien
tgcccctgttgatctagccactaag

SEQ ID NO: 644775 - DNA, 25 bp, Homo sapien
atctagccactaagggaagagcgga

SEQ ID NO: 644776 - DNA, 25 bp, Homo sapien
gaagagactgatctgattcgccttt

SEQ ID NO: 644777 - DNA, 25 bp, Homo sapien
gatctgattcgcctttgtttcatta

SEQ ID NO: 644778 - DNA, 25 bp, Homo sapien
tgattcgcctttgtttcattaattt

SEQ ID NO: 644779 - DNA, 25 bp, Homo sapien
gtataaggaagactcatatatcccc

SEQ ID NO: 644780 - DNA, 25 bp, Homo sapien
aatttgaatcaaagcccaggcatcc

SEQ ID NO: 644781 - DNA, 25 bp, Homo sapien
aatcaaagcccaggcatcctcttat

SEQ ID NO: 644782 - DNA, 25 bp, Homo sapien
gcatcctcttattccatccataaat

SEQ ID NO: 644783 - DNA, 25 bp, Homo sapien
cagtatgtatccctggcagataagg

SEQ ID NO: 644784 - DNA, 25 bp, Homo sapien
gtatccctggcagataagggcttaa

SEQ ID NO: 644785 - DNA, 25 bp, Homo sapien
aattgggagtatttcagctgttgcc

SEQ ID NO: 644786 - DNA, 25 bp, Homo sapien
agtatttcagctgttgcctatgcgt

SEQ ID NO: 644787 - DNA, 25 bp, Homo sapien
agctgttgcctatgcgttcagtaac

SEQ ID NO: 644788 - DNA, 25 bp, Homo sapien
gttgcctatgcgttcagtaacactt

SEQ ID NO: 644789 - DNA, 25 bp, Homo sapien
tatgcgttcagtaacacttgatgtt

SEQ ID NO: 644790 - DNA, 25 bp, Homo sapien
gttattgtgtgttaaattacatgcc

SEQ ID NO: 644791 - DNA, 25 bp, Homo sapien
aaattacatgccttttggcctctta

SEQ ID NO: 644792 - DNA, 25 bp, Homo sapien
atgccttttggcctcttaaatcaaa

SEQ ID NO: 644793 - DNA, 25 bp, Homo sapien
ggcctcttaaatcaaaggtagcatt

SEQ ID NO: 644794 - DNA, 25 bp, Homo sapien
aggtagcattttcagagtatcttta

SEQ ID NO: 644795 - DNA, 25 bp, Homo sapien
taagaaaagattatcaggctgggct

SEQ ID NO: 644796 - DNA, 25 bp, Homo sapien
tgctttcttggttgaaagagaacta

SEQ ID NO: 644797 - DNA, 25 bp, Homo sapien
tcttggttgaaagagaactagtttt

SEQ ID NO: 644798 - DNA, 25 bp, Homo sapien
gaagatagttgtattttctcatttt

SEQ ID NO: 644799 - DNA, 25 bp, Homo sapien
ttttttctacatgagactaaatgac

SEQ ID NO: 644800 - DNA, 25 bp, Homo sapien
tttctacatgagactaaatgactat

SEQ ID NO: 644801 - DNA, 25 bp, Homo sapien
tgagactaaatgactatagtttcat

SEQ ID NO: 644802 - DNA, 25 bp, Homo sapien
gactatagtttcattaaaccttctt

SEQ ID NO: 644803 - DNA, 25 bp, Homo sapien
atagtttcattaaaccttctttgct

SEQ ID NO: 644804 - DNA, 25 bp, Homo sapien
tagtttcattaaaccttctttgctt

SEQ ID NO: 644805 - DNA, 25 bp, Homo sapien
cttttgaattcaatgtatgagtaga

SEQ ID NO: 644806 - DNA, 25 bp, Homo sapien
gtatgagtagaatattttgttcttt

SEQ ID NO: 644807 - DNA, 25 bp, Homo sapien
cattaacttcatttgtttggccttt

SEQ ID NO: 644808 - DNA, 25 bp, Homo sapien
gggctgatgttgaaaatccatgatg

SEQ ID NO: 644809 - DNA, 25 bp, Homo sapien
aatccatgatgtgttttgacagcat

SEQ ID NO: 644810 - DNA, 25 bp, Homo sapien
tgacagcattgcatagcctattctt

SEQ ID NO: 644811 - DNA, 25 bp, Homo sapien
tagcctattcttgctggatacttcc

SEQ ID NO: 644812 - DNA, 25 bp, Homo sapien
gatacttcccctactagctgggata

SEQ ID NO: 644813 - DNA, 25 bp, Homo sapien
actagctgggataatctgctgcaat

SEQ ID NO: 644814 - DNA, 25 bp, Homo sapien
agttatcttctagtgtgttctgcca

SEQ ID NO: 644815 - DNA, 25 bp, Homo sapien
tgttctgccacactcatttccattt

SEQ ID NO: 644816 - DNA, 25 bp, Homo sapien
gacacttgcaagaactagaacaaca

SEQ ID NO: 644817 - DNA, 25 bp, Homo sapien
tagaacaacacagttaacccattaa

SEQ ID NO: 644818 - DNA, 25 bp, Homo sapien
tgcccggcctgggatctattcttaa

SEQ ID NO: 644819 - DNA, 25 bp, Homo sapien
tgggatctattcttaacccttgccc

SEQ ID NO: 644820 - DNA, 25 bp, Homo sapien
taacccttgccctagtcagggtggt

SEQ ID NO: 644821 - DNA, 25 bp, Homo sapien
gggtggtcttcctgcaggattaaga

SEQ ID NO: 644822 - DNA, 25 bp, Homo sapien
ttaagagttagactctgagactctg

SEQ ID NO: 644823 - DNA, 25 bp, Homo sapien
gagactctgatatcacaccctggct

SEQ ID NO: 644824 - DNA, 25 bp, Homo sapien
tctgatatcacaccctggcttggcc

SEQ ID NO: 644825 - DNA, 25 bp, Homo sapien
gtttcttctggagatatttcctgat

SEQ ID NO: 644826 - DNA, 25 bp, Homo sapien
atttcctgatagactacagtagtcc

SEQ ID NO: 644827 - DNA, 25 bp, Homo sapien
cagtagtcctcccttacctgaggtt

SEQ ID NO: 644828 - DNA, 25 bp, Homo sapien
attggcagtcaacttaggtctgaaa

SEQ ID NO: 644829 - DNA, 25 bp, Homo sapien
atccataagaagctcttcccctaaa

SEQ ID NO: 644830 - DNA, 25 bp, Homo sapien
aaggcagcacagctaactctactct

SEQ ID NO: 644831 - DNA, 25 bp, Homo sapien
tacctgccacaactcagtcaagaat

SEQ ID NO: 644832 - DNA, 25 bp, Homo sapien
gtcaagaattggcacctgtagccat

SEQ ID NO: 644833 - DNA, 25 bp, Homo sapien
ctgtagccatctgggtaagcctcga

SEQ ID NO: 644834 - DNA, 25 bp, Homo sapien
taagcctcgatgcttctttcaggga

SEQ ID NO: 644835 - DNA, 25 bp, Homo sapien
acacaaatggcaactcggagctatt

SEQ ID NO: 644836 - DNA, 25 bp, Homo sapien
gctatttgttactgcttgtctgtca

SEQ ID NO: 644837 - DNA, 25 bp, Homo sapien
ttgtctgtcaagattgtagccaggt

SEQ ID NO: 644838 - DNA, 25 bp, Homo sapien
caggttaatgggtcattttccttct

SEQ ID NO: 644839 - DNA, 25 bp, Homo sapien
aggtagagaactccaaactgtccca

SEQ ID NO: 644840 - DNA, 25 bp, Homo sapien
agccaaaacctctacatccctacat

SEQ ID NO: 644841 - DNA, 25 bp, Homo sapien
tctacatccctacattcacacactt

SEQ ID NO: 644842 - DNA, 25 bp, Homo sapien
tacattcacacacttcctccacaca

SEQ ID NO: 644843 - DNA, 25 bp, Homo sapien
accagtataggaagcagcacaccca

SEQ ID NO: 644844 - DNA, 25 bp, Homo sapien
cagtataggaagcagcacacccatg

SEQ ID NO: 644845 - DNA, 25 bp, Homo sapien
gtataggaagcagcacacccatggc

SEQ ID NO: 644846 - DNA, 25 bp, Homo sapien
tataggaagcagcacacccatggcc

SEQ ID NO: 644847 - DNA, 25 bp, Homo sapien
taggaagcagcacacccatggccca

SEQ ID NO: 644848 - DNA, 25 bp, Homo sapien
acactccccatctacagggagcagt

SEQ ID NO: 644849 - DNA, 25 bp, Homo sapien
tcttccacaggtcctatgactgcaa

SEQ ID NO: 644850 - DNA, 25 bp, Homo sapien
aggtcctatgactgcaacatccttc

SEQ ID NO: 644851 - DNA, 25 bp, Homo sapien
gagatcatatgtcattactcatata

SEQ ID NO: 644852 - DNA, 25 bp, Homo sapien
tgaagtatgggtgatcatgatgaaa

SEQ ID NO: 644853 - DNA, 25 bp, Homo sapien
aaatttctacttagctcctgtgggt

SEQ ID NO: 644854 - DNA, 25 bp, Homo sapien
tttctacttagctcctgtgggtttc

SEQ ID NO: 644855 - DNA, 25 bp, Homo sapien
aggctagggattaagtggagaaaca

SEQ ID NO: 644856 - DNA, 25 bp, Homo sapien
aaattaggatttcttggcattatct

SEQ ID NO: 644857 - DNA, 25 bp, Homo sapien
ggatttcttggcattatctttccta

SEQ ID NO: 644858 - DNA, 25 bp, Homo sapien
ttcttggcattatctttcctatcaa

SEQ ID NO: 644859 - DNA, 25 bp, Homo sapien
ttggcattatctttcctatcaagat

SEQ ID NO: 644860 - DNA, 25 bp, Homo sapien
tcctatcaagatatatgttcattat

SEQ ID NO: 644861 - DNA, 25 bp, Homo sapien
ccttcagagatcatatgtcattact

SEQ ID NO: 644862 - DNA, 25 bp, Homo sapien
catctctagcttttcctcaacttag

SEQ ID NO: 644863 - DNA, 25 bp, Homo sapien
atctctagcttttcctcaacttagg

SEQ ID NO: 644864 - DNA, 25 bp, Homo sapien
tctctagcttttcctcaacttaggc

SEQ ID NO: 644865 - DNA, 25 bp, Homo sapien
ctctagcttttcctcaacttaggct

SEQ ID NO: 644866 - DNA, 25 bp, Homo sapien
tctagcttttcctcaacttaggctt

SEQ ID NO: 644867 - DNA, 25 bp, Homo sapien
ctagcttttcctcaacttaggcttt

SEQ ID NO: 644868 - DNA, 25 bp, Homo sapien
tagcttttcctcaacttaggcttta

SEQ ID NO: 644869 - DNA, 25 bp, Homo sapien
agcttttcctcaacttaggctttat

SEQ ID NO: 644870 - DNA, 25 bp, Homo sapien
gcttttcctcaacttaggctttata

SEQ ID NO: 644871 - DNA, 25 bp, Homo sapien
tcaacttaggctttataaacccttg

SEQ ID NO: 644872 - DNA, 25 bp, Homo sapien
ttataaacccttgcatcaaaaaata

SEQ ID NO: 644873 - DNA, 25 bp, Homo sapien
aaatgagctatgaatttaacaggct

SEQ ID NO: 644874 - DNA, 25 bp, Homo sapien
gaatttaacaggctaacatcccagc

SEQ ID NO: 644875 - DNA, 25 bp, Homo sapien
tttcaaagctgactccggattgctt

SEQ ID NO: 644876 - DNA, 25 bp, Homo sapien
gctgactccggattgcttagagaaa

SEQ ID NO: 644877 - DNA, 25 bp, Homo sapien
gagtcagaatgagaagtccttcctt

SEQ ID NO: 644878 - DNA, 25 bp, Homo sapien
gaatgagaagtccttccttccttct

SEQ ID NO: 644879 - DNA, 25 bp, Homo sapien
ttccttccttctcaggaggatgtcc

SEQ ID NO: 644880 - DNA, 25 bp, Homo sapien
gaggatgtcctgttagcaacttctt

SEQ ID NO: 644881 - DNA, 25 bp, Homo sapien
tcctgttagcaacttctttggacac

SEQ ID NO: 644882 - DNA, 25 bp, Homo sapien
tagcaacttctttggacacaaggag

SEQ ID NO: 644883 - DNA, 25 bp, Homo sapien
agaagcatcattactgttaatatca

SEQ ID NO: 644884 - DNA, 25 bp, Homo sapien
agctgcttccactcaataacacttc

SEQ ID NO: 644885 - DNA, 25 bp, Homo sapien
cactcaataacacttcgcactgatt

SEQ ID NO: 644886 - DNA, 25 bp, Homo sapien
taacacttcgcactgattctccaag

SEQ ID NO: 644887 - DNA, 25 bp, Homo sapien
ttcttctggtacacccaggcaagaa

SEQ ID NO: 644888 - DNA, 25 bp, Homo sapien
gtacacccaggcaagaacccaggat

SEQ ID NO: 644889 - DNA, 25 bp, Homo sapien
gcatgccggcggaagagcacaccca

SEQ ID NO: 644890 - DNA, 25 bp, Homo sapien
ccacgtagcggcaggccacgtagcg

SEQ ID NO: 644891 - DNA, 25 bp, Homo sapien
gtagcggcaggccaaggcggagttt

SEQ ID NO: 644892 - DNA, 25 bp, Homo sapien
cagtcggaggagagctaggccacta

SEQ ID NO: 644893 - DNA, 25 bp, Homo sapien
agctaggccactaagcagctcaact

SEQ ID NO: 644894 - DNA, 25 bp, Homo sapien
taagcagctcaactccaggagaaaa

SEQ ID NO: 644895 - DNA, 25 bp, Homo sapien
gatcgcccgtgttcttgggtaagca

SEQ ID NO: 644896 - DNA, 25 bp, Homo sapien
gtggagaggcacagaatggcttcct

SEQ ID NO: 644897 - DNA, 25 bp, Homo sapien
tgatctaccgcgtcaaatctgtata

SEQ ID NO: 644898 - DNA, 25 bp, Homo sapien
gtaagcaaaatgagtactacgtcaa

SEQ ID NO: 644899 - DNA, 25 bp, Homo sapien
aagctttctcagcacgaagatgttt

SEQ ID NO: 644900 - DNA, 25 bp, Homo sapien
cagcacgaagatgttttctcagata

SEQ ID NO: 644901 - DNA, 25 bp, Homo sapien
agcattctaagtcaacttttcatag

SEQ ID NO: 644902 - DNA, 25 bp, Homo sapien
gtattcaatgtctatttgttattct

SEQ ID NO: 644903 - DNA, 25 bp, Homo sapien
gttattcttcgaaagaactttgcac

SEQ ID NO: 644904 - DNA, 25 bp, Homo sapien
gaactttgcacttatgattgtccaa

SEQ ID NO: 644905 - DNA, 25 bp, Homo sapien
tgattgtccaaagtggtacagcttg

SEQ ID NO: 644906 - DNA, 25 bp, Homo sapien
tactgcaagattggaccaggcccac

SEQ ID NO: 644907 - DNA, 25 bp, Homo sapien
gcaagattggaccaggcccactccg

SEQ ID NO: 644908 - DNA, 25 bp, Homo sapien
aggcccactccgcatctcaagaata

SEQ ID NO: 644909 - DNA, 25 bp, Homo sapien
ctgcaatatggactcagctctggct

SEQ ID NO: 644910 - DNA, 25 bp, Homo sapien
gggaccaggttggaccacgtggcat

SEQ ID NO: 644911 - DNA, 25 bp, Homo sapien
tccaagagtccacgtaagcaggttt

SEQ ID NO: 644912 - DNA, 25 bp, Homo sapien
agagtccacgtaagcaggtttgcaa

SEQ ID NO: 644913 - DNA, 25 bp, Homo sapien
acgtaagcaggtttgcaaggctcta

SEQ ID NO: 644914 - DNA, 25 bp, Homo sapien
gcaggtttgcaaggctctaaagttc

SEQ ID NO: 644915 - DNA, 25 bp, Homo sapien
ggctctaaagttcctatagtcctga

SEQ ID NO: 644916 - DNA, 25 bp, Homo sapien
taaagttcctatagtcctgagaccc

SEQ ID NO: 644917 - DNA, 25 bp, Homo sapien
gactggcctaggcaatatggcgaaa

SEQ ID NO: 644918 - DNA, 25 bp, Homo sapien
gagcccaggaggcaaagattgcgat

SEQ ID NO: 644919 - DNA, 25 bp, Homo sapien
gcccaggaggcaaagattgcgatga

SEQ ID NO: 644920 - DNA, 25 bp, Homo sapien
aggaggcaaagattgcgatgagccc

SEQ ID NO: 644921 - DNA, 25 bp, Homo sapien
ggcaaagattgcgatgagcccagac

SEQ ID NO: 644922 - DNA, 25 bp, Homo sapien
gcaaagattgcgatgagcccagact

SEQ ID NO: 644923 - DNA, 25 bp, Homo sapien
caaagattgcgatgagcccagactg

SEQ ID NO: 644924 - DNA, 25 bp, Homo sapien
aaagattgcgatgagcccagactgc

SEQ ID NO: 644925 - DNA, 25 bp, Homo sapien
aagattgcgatgagcccagactgca

SEQ ID NO: 644926 - DNA, 25 bp, Homo sapien
tctctgcaggcccaaaccttgcaga

SEQ ID NO: 644927 - DNA, 25 bp, Homo sapien
aaaccttgcagaagccattccatgt

SEQ ID NO: 644928 - DNA, 25 bp, Homo sapien
cttgcagaagccattccatgtttcc

SEQ ID NO: 644929 - DNA, 25 bp, Homo sapien
agacaaactcagaccgacaaccttg

SEQ ID NO: 644930 - DNA, 25 bp, Homo sapien
gaccgacaaccttggacttcaaaag

SEQ ID NO: 644931 - DNA, 25 bp, Homo sapien
cttggacttcaaaagactgcacaca

SEQ ID NO: 644932 - DNA, 25 bp, Homo sapien
aaggactgagagtaccaaggcgtga

SEQ ID NO: 644933 - DNA, 25 bp, Homo sapien
gaattcagaatgctgctatctcatt

SEQ ID NO: 644934 - DNA, 25 bp, Homo sapien
gctgctatctcatttatttttacca

SEQ ID NO: 644935 - DNA, 25 bp, Homo sapien
gaaacgttttgatctgcattccttt

SEQ ID NO: 644936 - DNA, 25 bp, Homo sapien
acgttttgatctgcattccttttcc

SEQ ID NO: 644937 - DNA, 25 bp, Homo sapien
ccagaggaatggttagcaagcttgc

SEQ ID NO: 644938 - DNA, 25 bp, Homo sapien
ggttagcaagcttgccatcaactat

SEQ ID NO: 644939 - DNA, 25 bp, Homo sapien
aagcttgccatcaactatagtacaa

SEQ ID NO: 644940 - DNA, 25 bp, Homo sapien
tatagtacaatacaacttgcatgtt

SEQ ID NO: 644941 - DNA, 25 bp, Homo sapien
aacttgcatgttctacgattcctta

SEQ ID NO: 644942 - DNA, 25 bp, Homo sapien
gttctacgattccttagtaaacagg

SEQ ID NO: 644943 - DNA, 25 bp, Homo sapien
gtaaacaggactaagaatctcagaa

SEQ ID NO: 644944 - DNA, 25 bp, Homo sapien
cagaaattaatagagcacaaccaag

SEQ ID NO: 644945 - DNA, 25 bp, Homo sapien
acaaccaaggcagcagtagattagg

SEQ ID NO: 644946 - DNA, 25 bp, Homo sapien
ggcagcagtagattaggactcagaa

SEQ ID NO: 644947 - DNA, 25 bp, Homo sapien
ggactcagaaatgcgtcttcatctc

SEQ ID NO: 644948 - DNA, 25 bp, Homo sapien
ctcagagttgtgaaagctcattgtg

SEQ ID NO: 644949 - DNA, 25 bp, Homo sapien
gggaccctcagaaaactaacaggag

SEQ ID NO: 644950 - DNA, 25 bp, Homo sapien
aacaggagcttagtcgcttttcagt

SEQ ID NO: 644951 - DNA, 25 bp, Homo sapien
gcttagtcgcttttcagtatggctt

SEQ ID NO: 644952 - DNA, 25 bp, Homo sapien
cagtatggctttatgtttcttcacg

SEQ ID NO: 644953 - DNA, 25 bp, Homo sapien
atggctttatgtttcttcacgtata

SEQ ID NO: 644954 - DNA, 25 bp, Homo sapien
tgtttcttcacgtataaaagtccaa

SEQ ID NO: 644955 - DNA, 25 bp, Homo sapien
aaaagtccaacgttgagccgggcat

SEQ ID NO: 644956 - DNA, 25 bp, Homo sapien
agtccaacgttgagccgggcatggt

SEQ ID NO: 644957 - DNA, 25 bp, Homo sapien
gccaggagtttatgatcacacctgt

SEQ ID NO: 644958 - DNA, 25 bp, Homo sapien
taaaagtccaatgctgttttatgac

SEQ ID NO: 644959 - DNA, 25 bp, Homo sapien
gggcatgcagagatccaggttttgt

SEQ ID NO: 644960 - DNA, 25 bp, Homo sapien
gatccaggttttgtcctaagaaaca

SEQ ID NO: 644961 - DNA, 25 bp, Homo sapien
aacaaaagacagagtgccttccaca

SEQ ID NO: 644962 - DNA, 25 bp, Homo sapien
tgccttccacaaagtgcctttgcct

SEQ ID NO: 644963 - DNA, 25 bp, Homo sapien
agggctgcgttatctcggcatcatt

SEQ ID NO: 644964 - DNA, 25 bp, Homo sapien
aacgtttctctcagcctacctttat

SEQ ID NO: 644965 - DNA, 25 bp, Homo sapien
cctacctttatgactgcacacacaa

SEQ ID NO: 644966 - DNA, 25 bp, Homo sapien
tgcacacacaagcattcctgagtga

SEQ ID NO: 644967 - DNA, 25 bp, Homo sapien
attcctgagtgaatatgcgtgcagc

SEQ ID NO: 644968 - DNA, 25 bp, Homo sapien
tgcgtgcagcagttcctaattctaa

SEQ ID NO: 644969 - DNA, 25 bp, Homo sapien
attaacctatgctcacgttcttaag

SEQ ID NO: 644970 - DNA, 25 bp, Homo sapien
accccaccagacacaatgaagatga

SEQ ID NO: 644971 - DNA, 25 bp, Homo sapien
gatgaggtcattgtgtgggtccaaa

SEQ ID NO: 644972 - DNA, 25 bp, Homo sapien
gtgtgggtccaaatccaatataact

SEQ ID NO: 644973 - DNA, 25 bp, Homo sapien
gaaaagaccgagacacacagggaga

SEQ ID NO: 644974 - DNA, 25 bp, Homo sapien
aaactacgtgagtaccgggccagag

SEQ ID NO: 644975 - DNA, 25 bp, Homo sapien
agagattgggatgatgcagctgcaa

SEQ ID NO: 644976 - DNA, 25 bp, Homo sapien
agctgcaagctgcaaggattgccaa

SEQ ID NO: 644977 - DNA, 25 bp, Homo sapien
gccaacaacctccaaagttagaaag

SEQ ID NO: 644978 - DNA, 25 bp, Homo sapien
aagcagcaaggcaggatacttacta

SEQ ID NO: 644979 - DNA, 25 bp, Homo sapien
ggatacttactagagcctttagaga

SEQ ID NO: 644980 - DNA, 25 bp, Homo sapien
agaaatcatggccttgctcagacct

SEQ ID NO: 644981 - DNA, 25 bp, Homo sapien
tgaccacaaggacaattcggacaac

SEQ ID NO: 644982 - DNA, 25 bp, Homo sapien
ttcggacaacctgaaatggtgacgc

SEQ ID NO: 644983 - DNA, 25 bp, Homo sapien
gaaatggtgacgcattctacaaaat

SEQ ID NO: 644984 - DNA, 25 bp, Homo sapien
gactcaagattttctgcttaatgga

SEQ ID NO: 644985 - DNA, 25 bp, Homo sapien
gagactaaagagatgcgacaacaga

SEQ ID NO: 644986 - DNA, 25 bp, Homo sapien
tgcgacaacagaatgccaggcatga

SEQ ID NO: 644987 - DNA, 25 bp, Homo sapien
cttttggctcaaacagtcttaggac

SEQ ID NO: 644988 - DNA, 25 bp, Homo sapien
aaacgtgaatgaggtctgtagctaa

SEQ ID NO: 644989 - DNA, 25 bp, Homo sapien
aatagaattgtgtcaatgccacatc

SEQ ID NO: 644990 - DNA, 25 bp, Homo sapien
gttttgttaattgcattgtggttac

SEQ ID NO: 644991 - DNA, 25 bp, Homo sapien
ttgttttcaggaaatgcacacagca

SEQ ID NO: 644992 - DNA, 25 bp, Homo sapien
cattgagggcatgggcagaatctgc

SEQ ID NO: 644993 - DNA, 25 bp, Homo sapien
gggcagaatctgctcccaaaagcat

SEQ ID NO: 644994 - DNA, 25 bp, Homo sapien
agcattgaaagccaatatgaggcca

SEQ ID NO: 644995 - DNA, 25 bp, Homo sapien
gcattgaaagccaatatgaggccag

SEQ ID NO: 644996 - DNA, 25 bp, Homo sapien
cattgaaagccaatatgaggccagg

SEQ ID NO: 644997 - DNA, 25 bp, Homo sapien
attgaaagccaatatgaggccaggt

SEQ ID NO: 644998 - DNA, 25 bp, Homo sapien
ttgaaagccaatatgaggccaggtg

SEQ ID NO: 644999 - DNA, 25 bp, Homo sapien
tgaaagccaatatgaggccaggtgg

SEQ ID NO: 645000 - DNA, 25 bp, Homo sapien
gaaagccaatatgaggccaggtggt

SEQ ID NO: 645001 - DNA, 25 bp, Homo sapien
aaagccaatatgaggccaggtggtg

SEQ ID NO: 645002 - DNA, 25 bp, Homo sapien
aagccaatatgaggccaggtggtgg

SEQ ID NO: 645003 - DNA, 25 bp, Homo sapien
caattgatatgggtgcagcagtgca

SEQ ID NO: 645004 - DNA, 25 bp, Homo sapien
acgcaggctgaagagcacccttgtt

SEQ ID NO: 645005 - DNA, 25 bp, Homo sapien
ggctgaagagcacccttgtttgaga

SEQ ID NO: 645006 - DNA, 25 bp, Homo sapien
aagagcacccttgtttgagaagaag

SEQ ID NO: 645007 - DNA, 25 bp, Homo sapien
ggaacatagggattccctctttggg

SEQ ID NO: 645008 - DNA, 25 bp, Homo sapien
cctgttttcttcctgtagacaaatc

SEQ ID NO: 645009 - DNA, 25 bp, Homo sapien
ttcttcctgtagacaaatctcattg

SEQ ID NO: 645010 - DNA, 25 bp, Homo sapien
gtagacaaatctcattgtggtgaat

SEQ ID NO: 645011 - DNA, 25 bp, Homo sapien
tgttgaaacccctggtcccagctgt

SEQ ID NO: 645012 - DNA, 25 bp, Homo sapien
ccttctatagctgtattgctcaatc

SEQ ID NO: 645013 - DNA, 25 bp, Homo sapien
agctgtattgctcaatcctttcctg

SEQ ID NO: 645014 - DNA, 25 bp, Homo sapien
agggaggtcctcagtgagtgcacct

SEQ ID NO: 645015 - DNA, 25 bp, Homo sapien
cttcctttataaagacccagcctca

SEQ ID NO: 645016 - DNA, 25 bp, Homo sapien
tataaagacccagcctcaggtcttc

SEQ ID NO: 645017 - DNA, 25 bp, Homo sapien
aaagacccagcctcaggtcttctgt

SEQ ID NO: 645018 - DNA, 25 bp, Homo sapien
cctcaggtcttctgtcagagcaaca

SEQ ID NO: 645019 - DNA, 25 bp, Homo sapien
tcaggtcttctgtcagagcaacaca

SEQ ID NO: 645020 - DNA, 25 bp, Homo sapien
gtcttctgtcagagcaacacaaaat

SEQ ID NO: 645021 - DNA, 25 bp, Homo sapien
aaatggactcagcacggatcaaatt

SEQ ID NO: 645022 - DNA, 25 bp, Homo sapien
atggactcagcacggatcaaattgt

SEQ ID NO: 645023 - DNA, 25 bp, Homo sapien
gactcagcacggatcaaattgtgtc

SEQ ID NO: 645024 - DNA, 25 bp, Homo sapien
agcacggatcaaattgtgtctcccc

SEQ ID NO: 645025 - DNA, 25 bp, Homo sapien
aaagggtacctatttcctgcagatc

SEQ ID NO: 645026 - DNA, 25 bp, Homo sapien
tttcctgcagatcacgcttatgtta

SEQ ID NO: 645027 - DNA, 25 bp, Homo sapien
cacgcttatgttaatctcacttcaa

SEQ ID NO: 645028 - DNA, 25 bp, Homo sapien
ccgaggacattacagggtcagtcat

SEQ ID NO: 645029 - DNA, 25 bp, Homo sapien
agggtcagtcattcttatccacaaa

SEQ ID NO: 645030 - DNA, 25 bp, Homo sapien
acaaagctttagattccactacatt

SEQ ID NO: 645031 - DNA, 25 bp, Homo sapien
tcaaactggacaatggacttcccca

SEQ ID NO: 645032 - DNA, 25 bp, Homo sapien
tggacttccccattttgtgcccaga

SEQ ID NO: 645033 - DNA, 25 bp, Homo sapien
gtgcccagacttgctcactaataga

SEQ ID NO: 645034 - DNA, 25 bp, Homo sapien
agagtgacctccttgttatgggtga

SEQ ID NO: 645035 - DNA, 25 bp, Homo sapien
gactgtgaattactacatcctgcat

SEQ ID NO: 645036 - DNA, 25 bp, Homo sapien
aagatttcaaccatggagggtctga

SEQ ID NO: 645037 - DNA, 25 bp, Homo sapien
aggaagagcctcgatatgttatctg

SEQ ID NO: 645038 - DNA, 25 bp, Homo sapien
gagcctcgatatgttatctggtcta

SEQ ID NO: 645039 - DNA, 25 bp, Homo sapien
tatctggtctatcagtagagggctc

SEQ ID NO: 645040 - DNA, 25 bp, Homo sapien
agtagagggctcagagtccatgtcc

SEQ ID NO: 645041 - DNA, 25 bp, Homo sapien
agggctcagagtccatgtcccagga

SEQ ID NO: 645042 - DNA, 25 bp, Homo sapien
atgtcccaggacaaggttacactct

SEQ ID NO: 645043 - DNA, 25 bp, Homo sapien
ggacaaggttacactctagaaataa

SEQ ID NO: 645044 - DNA, 25 bp, Homo sapien
ttaggaataagtaccatgcactagg

SEQ ID NO: 645045 - DNA, 25 bp, Homo sapien
taccatgcactaggaatatacaaca

SEQ ID NO: 645046 - DNA, 25 bp, Homo sapien
gagtgtaacagaatactgaacttga

SEQ ID NO: 645047 - DNA, 25 bp, Homo sapien
aagaagagccagtgtgataatacat

SEQ ID NO: 645048 - DNA, 25 bp, Homo sapien
agaagagccagtgtgataatacatt

SEQ ID NO: 645049 - DNA, 25 bp, Homo sapien
gaagagccagtgtgataatacattg

SEQ ID NO: 645050 - DNA, 25 bp, Homo sapien
aagagccagtgtgataatacattga

SEQ ID NO: 645051 - DNA, 25 bp, Homo sapien
agagccagtgtgataatacattgag

SEQ ID NO: 645052 - DNA, 25 bp, Homo sapien
gagccagtgtgataatacattgagt

SEQ ID NO: 645053 - DNA, 25 bp, Homo sapien
gccagtgtgataatacattgagtga

SEQ ID NO: 645054 - DNA, 25 bp, Homo sapien
ccagtgtgataatacattgagtgat

SEQ ID NO: 645055 - DNA, 25 bp, Homo sapien
cagtgtgataatacattgagtgatt

SEQ ID NO: 645056 - DNA, 25 bp, Homo sapien
gtgataatacattgagtgatttttt

SEQ ID NO: 645057 - DNA, 25 bp, Homo sapien
aaaagtgcatatatgagcaaaaagt

SEQ ID NO: 645058 - DNA, 25 bp, Homo sapien
gaatcgtattaaacacagcaagcct

SEQ ID NO: 645059 - DNA, 25 bp, Homo sapien
atcgtattaaacacagcaagcctgg

SEQ ID NO: 645060 - DNA, 25 bp, Homo sapien
gcaagcctggatctgtgccacttgt

SEQ ID NO: 645061 - DNA, 25 bp, Homo sapien
aagcctggatctgtgccacttgtgt

SEQ ID NO: 645062 - DNA, 25 bp, Homo sapien
tggatctgtgccacttgtgtcagag

SEQ ID NO: 645063 - DNA, 25 bp, Homo sapien
gatctgtgccacttgtgtcagagaa

SEQ ID NO: 645064 - DNA, 25 bp, Homo sapien
gtgccacttgtgtcagagaagaaga

SEQ ID NO: 645065 - DNA, 25 bp, Homo sapien
gaagaaacacgtagtggcagttgta

SEQ ID NO: 645066 - DNA, 25 bp, Homo sapien
cacgtagtggcagttgtaaaataat

SEQ ID NO: 645067 - DNA, 25 bp, Homo sapien
ggtattcctaacaatcctgatgtat

SEQ ID NO: 645068 - DNA, 25 bp, Homo sapien
gttacttttgatttgagaactctac

SEQ ID NO: 645069 - DNA, 25 bp, Homo sapien
cagaacatgcccctcagaaatcatt

SEQ ID NO: 645070 - DNA, 25 bp, Homo sapien
gaacatgcccctcagaaatcatttc

SEQ ID NO: 645071 - DNA, 25 bp, Homo sapien
cagaaatcatttcccacaatctcca

SEQ ID NO: 645072 - DNA, 25 bp, Homo sapien
aaggaaatcaaaccccgctcatcta

SEQ ID NO: 645073 - DNA, 25 bp, Homo sapien
aatcaaaccccgctcatctaggagc

SEQ ID NO: 645074 - DNA, 25 bp, Homo sapien
ttcgcctctgagaactaagaccctt

SEQ ID NO: 645075 - DNA, 25 bp, Homo sapien
tgagaactaagacccttccttccaa

SEQ ID NO: 645076 - DNA, 25 bp, Homo sapien
taagacccttccttccaaacacttg

SEQ ID NO: 645077 - DNA, 25 bp, Homo sapien
cttccttccaaacacttgcttttat

SEQ ID NO: 645078 - DNA, 25 bp, Homo sapien
caaacacttgcttttatcctagacc

SEQ ID NO: 645079 - DNA, 25 bp, Homo sapien
cacttgcttttatcctagacccctt

SEQ ID NO: 645080 - DNA, 25 bp, Homo sapien
gaggccctggtcataggatgcagca

SEQ ID NO: 645081 - DNA, 25 bp, Homo sapien
ataggatgcagcacatggtggcctg

SEQ ID NO: 645082 - DNA, 25 bp, Homo sapien
cacatggtggcctgctggaatgctg

SEQ ID NO: 645083 - DNA, 25 bp, Homo sapien
tacaaacaacgggaaggtggccgtg

SEQ ID NO: 645084 - DNA, 25 bp, Homo sapien
tggacacctccatgcctagaagctg

SEQ ID NO: 645085 - DNA, 25 bp, Homo sapien
acctccatgcctagaagctggtcag

SEQ ID NO: 645086 - DNA, 25 bp, Homo sapien
gaagctggtcaggaagctgccctca

SEQ ID NO: 645087 - DNA, 25 bp, Homo sapien
tggtcaggaagctgccctcatcacc

SEQ ID NO: 645088 - DNA, 25 bp, Homo sapien
actcgagtgcacaagatgaggaagc

SEQ ID NO: 645089 - DNA, 25 bp, Homo sapien
tgcacaagatgaggaagcggcagac

SEQ ID NO: 645090 - DNA, 25 bp, Homo sapien
caacatccagatgagcagttttgca

SEQ ID NO: 645091 - DNA, 25 bp, Homo sapien
gcctctctctcagcatatgctttga

SEQ ID NO: 645092 - DNA, 25 bp, Homo sapien
tagattggagctatcagtcacttat

SEQ ID NO: 645093 - DNA, 25 bp, Homo sapien
tggagctatcagtcacttatttcta

SEQ ID NO: 645094 - DNA, 25 bp, Homo sapien
tcatagctgtgaagagggataccaa

SEQ ID NO: 645095 - DNA, 25 bp, Homo sapien
gaaagttctttctgctgtctttctc

SEQ ID NO: 645096 - DNA, 25 bp, Homo sapien
cttatcttatgaacactcaactgaa

SEQ ID NO: 645097 - DNA, 25 bp, Homo sapien
gaaaaaacactccacctaaaagcag

SEQ ID NO: 645098 - DNA, 25 bp, Homo sapien
aacactccacctaaaagcaggaaag

SEQ ID NO: 645099 - DNA, 25 bp, Homo sapien
agatggcaattctaaatagcagcta

SEQ ID NO: 645100 - DNA, 25 bp, Homo sapien
aaatagcagctattatccccgggta

SEQ ID NO: 645101 - DNA, 25 bp, Homo sapien
agcagctattatccccgggtataaa

SEQ ID NO: 645102 - DNA, 25 bp, Homo sapien
aatggcatgggatggatcctttcga

SEQ ID NO: 645103 - DNA, 25 bp, Homo sapien
tggcatgggatggatcctttcgaat

SEQ ID NO: 645104 - DNA, 25 bp, Homo sapien
atgggatggatcctttcgaatgcac

SEQ ID NO: 645105 - DNA, 25 bp, Homo sapien
ggatggatcctttcgaatgcacttg

SEQ ID NO: 645106 - DNA, 25 bp, Homo sapien
ggatcctttcgaatgcacttgagca

SEQ ID NO: 645107 - DNA, 25 bp, Homo sapien
gaatgcacttgagcagcggtctcca

SEQ ID NO: 645108 - DNA, 25 bp, Homo sapien
ggtctccaaccacagggccacagag

SEQ ID NO: 645109 - DNA, 25 bp, Homo sapien
gctggatctaccatgaaagacctct

SEQ ID NO: 645110 - DNA, 25 bp, Homo sapien
gagactgactgagcaacatgttatt

SEQ ID NO: 645111 - DNA, 25 bp, Homo sapien
catgttattcaggagatggggtctc

SEQ ID NO: 645112 - DNA, 25 bp, Homo sapien
ctgggctaaggatcctcctacctga

SEQ ID NO: 645113 - DNA, 25 bp, Homo sapien
ttgctctctgcatctcttccatttg

SEQ ID NO: 645114 - DNA, 25 bp, Homo sapien
tgctctctgcatctcttccatttgg

SEQ ID NO: 645115 - DNA, 25 bp, Homo sapien
gtgcctctcaacatccagcagaatg

SEQ ID NO: 645116 - DNA, 25 bp, Homo sapien
tgcctctcaacatccagcagaatgt

SEQ ID NO: 645117 - DNA, 25 bp, Homo sapien
gcctctcaacatccagcagaatgtg

SEQ ID NO: 645118 - DNA, 25 bp, Homo sapien
tctcaacatccagcagaatgtggga

SEQ ID NO: 645119 - DNA, 25 bp, Homo sapien
tcaacatccagcagaatgtgggaat

SEQ ID NO: 645120 - DNA, 25 bp, Homo sapien
aacatccagcagaatgtgggaatat

SEQ ID NO: 645121 - DNA, 25 bp, Homo sapien
tgctgagttgagtaaatatttcctt

SEQ ID NO: 645122 - DNA, 25 bp, Homo sapien
atttctgtaaaattgtgcaaccaag

SEQ ID NO: 645123 - DNA, 25 bp, Homo sapien
aaattgtgcaaccaagaattatgac

SEQ ID NO: 645124 - DNA, 25 bp, Homo sapien
gaacagggctaggagaaatctttct

SEQ ID NO: 645125 - DNA, 25 bp, Homo sapien
atccatctcttctgatttcagatta

SEQ ID NO: 645126 - DNA, 25 bp, Homo sapien
atttcagattattctctaggcggag

SEQ ID NO: 645127 - DNA, 25 bp, Homo sapien
cctgctccactccttattataaaat

SEQ ID NO: 645128 - DNA, 25 bp, Homo sapien
gaacagatgctgtcactgatgcctg

SEQ ID NO: 645129 - DNA, 25 bp, Homo sapien
gctgtcactgatgcctgatgagcca

SEQ ID NO: 645130 - DNA, 25 bp, Homo sapien
gatgcctgatgagccagtagtttaa

SEQ ID NO: 645131 - DNA, 25 bp, Homo sapien
gtagtttaagcttccttgtctcatc

SEQ ID NO: 645132 - DNA, 25 bp, Homo sapien
aagcttccttgtctcatcagtggta

SEQ ID NO: 645133 - DNA, 25 bp, Homo sapien
tcatcagtggtacagaatatctcat

SEQ ID NO: 645134 - DNA, 25 bp, Homo sapien
agaatatctcatggactacctccca

SEQ ID NO: 645135 - DNA, 25 bp, Homo sapien
gaaaatctcaacaaaattatccgta

SEQ ID NO: 645136 - DNA, 25 bp, Homo sapien
aattatccgtaaatccacctttcag

SEQ ID NO: 645137 - DNA, 25 bp, Homo sapien
tatccgtaaatccacctttcaggta

SEQ ID NO: 645138 - DNA, 25 bp, Homo sapien
aaatccacctttcaggtataattgt

SEQ ID NO: 645139 - DNA, 25 bp, Homo sapien
ctttggacttttctatgcataaatt

SEQ ID NO: 645140 - DNA, 25 bp, Homo sapien
ggacttttctatgcataaattatgt

SEQ ID NO: 645141 - DNA, 25 bp, Homo sapien
tttttcctgctcaatattatgcatg

SEQ ID NO: 645142 - DNA, 25 bp, Homo sapien
attatgcatgatcagttttccttta

SEQ ID NO: 645143 - DNA, 25 bp, Homo sapien
tatgcatgatcagttttcctttatt

SEQ ID NO: 645144 - DNA, 25 bp, Homo sapien
tgattgatatatacattgatgccaa

SEQ ID NO: 645145 - DNA, 25 bp, Homo sapien
acattgatgccaatgttttgttttt

SEQ ID NO: 645146 - DNA, 25 bp, Homo sapien
aagatgggtaagttggccgggtgca

SEQ ID NO: 645147 - DNA, 25 bp, Homo sapien
gctcatacttgcaatcccaatcttt

SEQ ID NO: 645148 - DNA, 25 bp, Homo sapien
catacttgcaatcccaatctttggg

SEQ ID NO: 645149 - DNA, 25 bp, Homo sapien
aggagttcacgacaagcccaggcaa

SEQ ID NO: 645150 - DNA, 25 bp, Homo sapien
acgacaagcccaggcaacataatga

SEQ ID NO: 645151 - DNA, 25 bp, Homo sapien
cattgtggcgtgtgctcgtaatttc

SEQ ID NO: 645152 - DNA, 25 bp, Homo sapien
ttgtggcgtgtgctcgtaatttcag

SEQ ID NO: 645153 - DNA, 25 bp, Homo sapien
tggcgtgtgctcgtaatttcagcta

SEQ ID NO: 645154 - DNA, 25 bp, Homo sapien
gcgtgtgctcgtaatttcagctact

SEQ ID NO: 645155 - DNA, 25 bp, Homo sapien
tgagacaagaagactgagcgcagga

SEQ ID NO: 645156 - DNA, 25 bp, Homo sapien
ctgcagtaggctgtgtgattgcacc

SEQ ID NO: 645157 - DNA, 25 bp, Homo sapien
tgatagactgccttgttgatgccca

SEQ ID NO: 645158 - DNA, 25 bp, Homo sapien
gttgatgcccagaacatcctgagtt

SEQ ID NO: 645159 - DNA, 25 bp, Homo sapien
cctgagttagaaccagtaaacctgt

SEQ ID NO: 645160 - DNA, 25 bp, Homo sapien
taaacctgttttcactttatggctg

SEQ ID NO: 645161 - DNA, 25 bp, Homo sapien
ttatggctgctaccacgtggactta

SEQ ID NO: 645162 - DNA, 25 bp, Homo sapien
tgctaccacgtggacttactggttt

SEQ ID NO: 645163 - DNA, 25 bp, Homo sapien
cttactggtttatatctgtctgtta

SEQ ID NO: 645164 - DNA, 25 bp, Homo sapien
ctgtctgttaggtttagcatacttt

SEQ ID NO: 645165 - DNA, 25 bp, Homo sapien
ccttaaattggctgaactttgcttc

SEQ ID NO: 645166 - DNA, 25 bp, Homo sapien
ttgcttcagaatctagtttcttctt

SEQ ID NO: 645167 - DNA, 25 bp, Homo sapien
tattgtcttcagttaatgttgttta

SEQ ID NO: 645168 - DNA, 25 bp, Homo sapien
accagatatgtactgctagcatagc

SEQ ID NO: 645169 - DNA, 25 bp, Homo sapien
caggagttctgcaggtgaaagccat

SEQ ID NO: 645170 - DNA, 25 bp, Homo sapien
tatggagacaaggacctacaaatgt

SEQ ID NO: 645171 - DNA, 25 bp, Homo sapien
ctacaaatgtatttccaagcagaga

SEQ ID NO: 645172 - DNA, 25 bp, Homo sapien
gaagagagactgacctgtgacgact

SEQ ID NO: 645173 - DNA, 25 bp, Homo sapien
gacctgtgacgactagtgaaccttc

SEQ ID NO: 645174 - DNA, 25 bp, Homo sapien
gtgaaccttcaaccagataactagg

SEQ ID NO: 645175 - DNA, 25 bp, Homo sapien
gggttcaaatcctgagtgtgcgtct

SEQ ID NO: 645176 - DNA, 25 bp, Homo sapien
gtgtgcgtcttacattctgcatgac

SEQ ID NO: 645177 - DNA, 25 bp, Homo sapien
gaccttgggtagttttcttgatctc

SEQ ID NO: 645178 - DNA, 25 bp, Homo sapien
ggtagttttcttgatctcttggata

SEQ ID NO: 645179 - DNA, 25 bp, Homo sapien
ttgaatcctattctatcacctgctt

SEQ ID NO: 645180 - DNA, 25 bp, Homo sapien
attctatcacctgcttagttgtata

SEQ ID NO: 645181 - DNA, 25 bp, Homo sapien
atcacctgcttagttgtatagatgc

SEQ ID NO: 645182 - DNA, 25 bp, Homo sapien
gcagataagcgattaactattcaga

SEQ ID NO: 645183 - DNA, 25 bp, Homo sapien
ttcagagtgcagatgtcctcaccta

SEQ ID NO: 645184 - DNA, 25 bp, Homo sapien
gatgtcctcacctatcgtatggaac

SEQ ID NO: 645185 - DNA, 25 bp, Homo sapien
ggaacgataataactgccttccagt

SEQ ID NO: 645186 - DNA, 25 bp, Homo sapien
actgccttccagtgttagtttgagg

SEQ ID NO: 645187 - DNA, 25 bp, Homo sapien
catcagaggtgcttggcagatacca

SEQ ID NO: 645188 - DNA, 25 bp, Homo sapien
ccaagtgctccataactgttagcta

SEQ ID NO: 645189 - DNA, 25 bp, Homo sapien
ttagctattatttttcctataacat

SEQ ID NO: 645190 - DNA, 25 bp, Homo sapien
caggtcgacctctgagttagttctc

SEQ ID NO: 645191 - DNA, 25 bp, Homo sapien
cgacctctgagttagttctccaggg

SEQ ID NO: 645192 - DNA, 25 bp, Homo sapien
gcgcagccaagcacttggaggcagt

SEQ ID NO: 645193 - DNA, 25 bp, Homo sapien
gcacttggaggcagtagagagcaat

SEQ ID NO: 645194 - DNA, 25 bp, Homo sapien
atggtgagcatgatcagggcagtca

SEQ ID NO: 645195 - DNA, 25 bp, Homo sapien
gcagtcagggcctgtgcagcatctc

SEQ ID NO: 645196 - DNA, 25 bp, Homo sapien
ttttatccccatcttacccatgagt

SEQ ID NO: 645197 - DNA, 25 bp, Homo sapien
tcttacccatgagtgaactgaggca

SEQ ID NO: 645198 - DNA, 25 bp, Homo sapien
aacttgcccaagtctcagaactagt

SEQ ID NO: 645199 - DNA, 25 bp, Homo sapien
gaactagtaagtgaccaaatgagaa

SEQ ID NO: 645200 - DNA, 25 bp, Homo sapien
aatgagaattcaatccctggctgtc

SEQ ID NO: 645201 - DNA, 25 bp, Homo sapien
ctttcaattacattaggagaggcac

SEQ ID NO: 645202 - DNA, 25 bp, Homo sapien
ttacattaggagaggcacggtggct

SEQ ID NO: 645203 - DNA, 25 bp, Homo sapien
aggagttttagatcaacccagacaa

SEQ ID NO: 645204 - DNA, 25 bp, Homo sapien
gagttttagatcaacccagacaaca

SEQ ID NO: 645205 - DNA, 25 bp, Homo sapien
ggtgcacatgtgtagtcccgactaa

SEQ ID NO: 645206 - DNA, 25 bp, Homo sapien
gtagtcccgactaatgaggtggctg

SEQ ID NO: 645207 - DNA, 25 bp, Homo sapien
tcccgactaatgaggtggctgaggc

SEQ ID NO: 645208 - DNA, 25 bp, Homo sapien
gaggcaagaggctcatttgagccaa

SEQ ID NO: 645209 - DNA, 25 bp, Homo sapien
ctcatttgagccaaggaggtcaaga

SEQ ID NO: 645210 - DNA, 25 bp, Homo sapien
caagactgcagtgggctaagatcgt

SEQ ID NO: 645211 - DNA, 25 bp, Homo sapien
gctaagatcgtgcatctggactcca

SEQ ID NO: 645212 - DNA, 25 bp, Homo sapien
tgctcacattgtgtacatattctgt

SEQ ID NO: 645213 - DNA, 25 bp, Homo sapien
gtgtacatattctgtggcttatata

SEQ ID NO: 645214 - DNA, 25 bp, Homo sapien
attctatgacttattcctcttcaga

SEQ ID NO: 645215 - DNA, 25 bp, Homo sapien
ccacagcatgacagggttagggaat

SEQ ID NO: 645216 - DNA, 25 bp, Homo sapien
taaagtctaagcagaaaccctttct

SEQ ID NO: 645217 - DNA, 25 bp, Homo sapien
agaaaccctttctggcggtctgcag

SEQ ID NO: 645218 - DNA, 25 bp, Homo sapien
tttctggcggtctgcagaagtctcc

SEQ ID NO: 645219 - DNA, 25 bp, Homo sapien
agaagtctcccatcttgctaaagtg

SEQ ID NO: 645220 - DNA, 25 bp, Homo sapien
tcccatcttgctaaagtgtcacatt

SEQ ID NO: 645221 - DNA, 25 bp, Homo sapien
gtcacatttggcacatattcctgga

SEQ ID NO: 645222 - DNA, 25 bp, Homo sapien
catattcctggaaaacgttttagtg

SEQ ID NO: 645223 - DNA, 25 bp, Homo sapien
ggctgaagacccaatggaagtaact

SEQ ID NO: 645224 - DNA, 25 bp, Homo sapien
ggaagtaactgatggatcgcaaatt

SEQ ID NO: 645225 - DNA, 25 bp, Homo sapien
attggaaatcgcaacgtggccgaca

SEQ ID NO: 645226 - DNA, 25 bp, Homo sapien
gtggccgacagacctgatcaggaaa

SEQ ID NO: 645227 - DNA, 25 bp, Homo sapien
gatcaggaaaactcgcgtccttata

SEQ ID NO: 645228 - DNA, 25 bp, Homo sapien
ctcgcgtccttatatgaaacagccc

SEQ ID NO: 645229 - DNA, 25 bp, Homo sapien
gcgaaagtagcctcaggagttgtca

SEQ ID NO: 645230 - DNA, 25 bp, Homo sapien
agcctcaggagttgtcagattcaaa

SEQ ID NO: 645231 - DNA, 25 bp, Homo sapien
gagggcaaatgtgaccactcgggtc

SEQ ID NO: 645232 - DNA, 25 bp, Homo sapien
accactcgggtcagccagtcagcag

SEQ ID NO: 645233 - DNA, 25 bp, Homo sapien
cagtcagcagtttggatccagacag

SEQ ID NO: 645234 - DNA, 25 bp, Homo sapien
gggcgtgctggtgtgcctgtattcc

SEQ ID NO: 645235 - DNA, 25 bp, Homo sapien
ggcgtgctggtgtgcctgtattccc

SEQ ID NO: 645236 - DNA, 25 bp, Homo sapien
gcgtgctggtgtgcctgtattccca

SEQ ID NO: 645237 - DNA, 25 bp, Homo sapien
aggattgcttcagctggggaggcgg

SEQ ID NO: 645238 - DNA, 25 bp, Homo sapien
ggattgcttcagctggggaggcgga

SEQ ID NO: 645239 - DNA, 25 bp, Homo sapien
gattgcttcagctggggaggcggag

SEQ ID NO: 645240 - DNA, 25 bp, Homo sapien
attgcttcagctggggaggcggagg

SEQ ID NO: 645241 - DNA, 25 bp, Homo sapien
ttgcttcagctggggaggcggaggc

SEQ ID NO: 645242 - DNA, 25 bp, Homo sapien
tgcagggagccaagactgagccatt

SEQ ID NO: 645243 - DNA, 25 bp, Homo sapien
gcagggagccaagactgagccattg

SEQ ID NO: 645244 - DNA, 25 bp, Homo sapien
cagggagccaagactgagccattgc

SEQ ID NO: 645245 - DNA, 25 bp, Homo sapien
cgggggacagccaggtttgaactca

SEQ ID NO: 645246 - DNA, 25 bp, Homo sapien
tttttcagccggcattttgcacaga

SEQ ID NO: 645247 - DNA, 25 bp, Homo sapien
tttcagccggcattttgcacagagg

SEQ ID NO: 645248 - DNA, 25 bp, Homo sapien
ggcattttgcacagaggccgtgtct

SEQ ID NO: 645249 - DNA, 25 bp, Homo sapien
attttgcacagaggccgtgtcttat

SEQ ID NO: 645250 - DNA, 25 bp, Homo sapien
acagaggccgtgtcttatgcggaat

SEQ ID NO: 645251 - DNA, 25 bp, Homo sapien
gtgtgcatggattcgggcatgaaga

SEQ ID NO: 645252 - DNA, 25 bp, Homo sapien
agactccccaacgtggagtgatgag

SEQ ID NO: 645253 - DNA, 25 bp, Homo sapien
gagtgatgagcctcgcttgtctaga

SEQ ID NO: 645254 - DNA, 25 bp, Homo sapien
atgagcctcgcttgtctagattgtc

SEQ ID NO: 645255 - DNA, 25 bp, Homo sapien
ctcgcttgtctagattgtcctcttt

SEQ ID NO: 645256 - DNA, 25 bp, Homo sapien
ttgcttgcatcttcctttgcatgtg

SEQ ID NO: 645257 - DNA, 25 bp, Homo sapien
tgcatcttcctttgcatgtgcaata

SEQ ID NO: 645258 - DNA, 25 bp, Homo sapien
gtgcaatatacaaataagcctttag

SEQ ID NO: 645259 - DNA, 25 bp, Homo sapien
gtgaaatgtatttatccctgccttt

SEQ ID NO: 645260 - DNA, 25 bp, Homo sapien
atttatccctgccttttgcaacgga

SEQ ID NO: 645261 - DNA, 25 bp, Homo sapien
tgccttttgcaacggacttacccta

SEQ ID NO: 645262 - DNA, 25 bp, Homo sapien
ggacttaccctaaaagtcatcatca

SEQ ID NO: 645263 - DNA, 25 bp, Homo sapien
catcatcaaaacactatgtcttttt

SEQ ID NO: 645264 - DNA, 25 bp, Homo sapien
atatgtgcacattctatgtttatgt

SEQ ID NO: 645265 - DNA, 25 bp, Homo sapien
aatgatttatgttttctgtatcaca

SEQ ID NO: 645266 - DNA, 25 bp, Homo sapien
ttctgtatcacaagttttcaaatta

SEQ ID NO: 645267 - DNA, 25 bp, Homo sapien
tttctacattctcacgttctagtga

SEQ ID NO: 645268 - DNA, 25 bp, Homo sapien
cattctcacgttctagtgatttggg

SEQ ID NO: 645269 - DNA, 25 bp, Homo sapien
ggcatgggcttaatagcagatgtac

SEQ ID NO: 645270 - DNA, 25 bp, Homo sapien
gatgtacagtgtattcctgcattat

SEQ ID NO: 645271 - DNA, 25 bp, Homo sapien
tgcattattgtgattccccttaaag

SEQ ID NO: 645272 - DNA, 25 bp, Homo sapien
gattccccttaaagcccagttcttg

SEQ ID NO: 645273 - DNA, 25 bp, Homo sapien
tgctgactccagttacccatggaat

SEQ ID NO: 645274 - DNA, 25 bp, Homo sapien
gggtctttcaaaactctttggatct

SEQ ID NO: 645275 - DNA, 25 bp, Homo sapien
ggatctaagcatttgtctctcctta

SEQ ID NO: 645276 - DNA, 25 bp, Homo sapien
tgtctctccttaagtgccaatcaca

SEQ ID NO: 645277 - DNA, 25 bp, Homo sapien
tatggaaggactgtgatttctgcaa

SEQ ID NO: 645278 - DNA, 25 bp, Homo sapien
ggcagcagagagagtatttacgaga

SEQ ID NO: 645279 - DNA, 25 bp, Homo sapien
agtatttacgagatgaggtagccaa

SEQ ID NO: 645280 - DNA, 25 bp, Homo sapien
gatgaggtagccaagtaccaccttt

SEQ ID NO: 645281 - DNA, 25 bp, Homo sapien
aggtagccaagtaccaccttttgtg

SEQ ID NO: 645282 - DNA, 25 bp, Homo sapien
ccaccttttgtggtctaattatgta

SEQ ID NO: 645283 - DNA, 25 bp, Homo sapien
ggtctaattatgtacaaaggctcag

SEQ ID NO: 645284 - DNA, 25 bp, Homo sapien
attatgtacaaaggctcagagaaac

SEQ ID NO: 645285 - DNA, 25 bp, Homo sapien
gctcagagaaacaactggatagaaa

SEQ ID NO: 645286 - DNA, 25 bp, Homo sapien
aagctaacagaataggctcttttca

SEQ ID NO: 645287 - DNA, 25 bp, Homo sapien
gaataggctcttttcagccagccag

SEQ ID NO: 645288 - DNA, 25 bp, Homo sapien
taggctcttttcagccagccaggca

SEQ ID NO: 645289 - DNA, 25 bp, Homo sapien
ctcctggtgtttgaacgtttaccat

SEQ ID NO: 645290 - DNA, 25 bp, Homo sapien
gaacgtttaccattccatgtgggac

SEQ ID NO: 645291 - DNA, 25 bp, Homo sapien
attccatgtgggaccattgtgccaa

SEQ ID NO: 645292 - DNA, 25 bp, Homo sapien
gaccattgtgccaatttgtccttac

SEQ ID NO: 645293 - DNA, 25 bp, Homo sapien
tgtgccaatttgtccttacgtaaat

SEQ ID NO: 645294 - DNA, 25 bp, Homo sapien
gtccttacgtaaatcacttgtgctg

SEQ ID NO: 645295 - DNA, 25 bp, Homo sapien
aaatcacttgtgctgtgtgcagtat

SEQ ID NO: 645296 - DNA, 25 bp, Homo sapien
tgtgctgtgtgcagtataagccttt

SEQ ID NO: 645297 - DNA, 25 bp, Homo sapien
gtaacacatgcctgtctgtcataaa

SEQ ID NO: 645298 - DNA, 25 bp, Homo sapien
atgcctgtctgtcataaacagtaca

SEQ ID NO: 645299 - DNA, 25 bp, Homo sapien
agtacaaacgtgagcaaacactgtc

SEQ ID NO: 645300 - DNA, 25 bp, Homo sapien
tgtaatatccttaatcatttcttgg

SEQ ID NO: 645301 - DNA, 25 bp, Homo sapien
atccctttacagcttagtatctatg

SEQ ID NO: 645302 - DNA, 25 bp, Homo sapien
ggatgagtgttaggatacaggtcta

SEQ ID NO: 645303 - DNA, 25 bp, Homo sapien
tacaggtctaggaagcaggtaaagc

SEQ ID NO: 645304 - DNA, 25 bp, Homo sapien
gtaaagctgctttgaggagtctgag

SEQ ID NO: 645305 - DNA, 25 bp, Homo sapien
aggagtctgagaggcagcttaccta

SEQ ID NO: 645306 - DNA, 25 bp, Homo sapien
agaggcagcttacctagggcagtaa

SEQ ID NO: 645307 - DNA, 25 bp, Homo sapien
cactgggcactctgggaaatgtgtc

SEQ ID NO: 645308 - DNA, 25 bp, Homo sapien
gagcaagggtttaaaagtctagcta

SEQ ID NO: 645309 - DNA, 25 bp, Homo sapien
gtctagctaaccttactagtctgca

SEQ ID NO: 645310 - DNA, 25 bp, Homo sapien
aaccttactagtctgcaatcactcc

SEQ ID NO: 645311 - DNA, 25 bp, Homo sapien
tctccaagctttaccacggactcat

SEQ ID NO: 645312 - DNA, 25 bp, Homo sapien
acggactcatgccttgatcaagaag

SEQ ID NO: 645313 - DNA, 25 bp, Homo sapien
tctgtgatgctatgacccttgtcaa

SEQ ID NO: 645314 - DNA, 25 bp, Homo sapien
gcggcgagtcaaggaacggcttttc

SEQ ID NO: 645315 - DNA, 25 bp, Homo sapien
caaggaacggcttttccagtgctac

SEQ ID NO: 645316 - DNA, 25 bp, Homo sapien
gctaccgacagccacgagaatctag

SEQ ID NO: 645317 - DNA, 25 bp, Homo sapien
atctaggtgtgctaggtgtctggca

SEQ ID NO: 645318 - DNA, 25 bp, Homo sapien
gtgtctggcatgtgtttagttcttc

SEQ ID NO: 645319 - DNA, 25 bp, Homo sapien
gtttagttcttcattattcctgaga

SEQ ID NO: 645320 - DNA, 25 bp, Homo sapien
attcctgagagtaaaagtcctcctt

SEQ ID NO: 645321 - DNA, 25 bp, Homo sapien
aaagtcctcctttagattaagaatg

SEQ ID NO: 645322 - DNA, 25 bp, Homo sapien
atcagccagtcccatggtgttagga

SEQ ID NO: 645323 - DNA, 25 bp, Homo sapien
ggattattacatgggacacctttca

SEQ ID NO: 645324 - DNA, 25 bp, Homo sapien
tacatgggacacctttcatcatcat

SEQ ID NO: 645325 - DNA, 25 bp, Homo sapien
agacacacatttaccttctttgctg

SEQ ID NO: 645326 - DNA, 25 bp, Homo sapien
accttctttgctgacaatgattctg

SEQ ID NO: 645327 - DNA, 25 bp, Homo sapien
gacaatgattctgtcatcaccatct

SEQ ID NO: 645328 - DNA, 25 bp, Homo sapien
tggacttccagaatgccttaatcat

SEQ ID NO: 645329 - DNA, 25 bp, Homo sapien
gccttaatcatcatcagagtatcct

SEQ ID NO: 645330 - DNA, 25 bp, Homo sapien
cagagtatcctacacaaagttgtct

SEQ ID NO: 645331 - DNA, 25 bp, Homo sapien
caaagttgtctctgaccaaggaact

SEQ ID NO: 645332 - DNA, 25 bp, Homo sapien
gaactcatttaatgggactgcatcc

SEQ ID NO: 645333 - DNA, 25 bp, Homo sapien
atctctgtgtctcagtatccagaac

SEQ ID NO: 645334 - DNA, 25 bp, Homo sapien
gtctgacacatagtagaagctcaat

SEQ ID NO: 645335 - DNA, 25 bp, Homo sapien
atcaatttccactgtactggtagag

SEQ ID NO: 645336 - DNA, 25 bp, Homo sapien
ggtagaatgacagcttgcatactat

SEQ ID NO: 645337 - DNA, 25 bp, Homo sapien
gacagcttgcatactataatggaaa

SEQ ID NO: 645338 - DNA, 25 bp, Homo sapien
ggaaccagaatacctggcttcaagt

SEQ ID NO: 645339 - DNA, 25 bp, Homo sapien
ggcttcaagtcccatttataccaca

SEQ ID NO: 645340 - DNA, 25 bp, Homo sapien
agtcccatttataccacactactag

SEQ ID NO: 645341 - DNA, 25 bp, Homo sapien
accacactactagctatagattggg

SEQ ID NO: 645342 - DNA, 25 bp, Homo sapien
ggaagatcattgaagccctcttgtt

SEQ ID NO: 645343 - DNA, 25 bp, Homo sapien
aagccctcttgttcctactttggtg

SEQ ID NO: 645344 - DNA, 25 bp, Homo sapien
atgcctggcccttttcattgtttat

SEQ ID NO: 645345 - DNA, 25 bp, Homo sapien
tgcctggcccttttcattgtttatt

SEQ ID NO: 645346 - DNA, 25 bp, Homo sapien
attgtttattaaccatttgcatatc

SEQ ID NO: 645347 - DNA, 25 bp, Homo sapien
ttgtttattaaccatttgcatatct

SEQ ID NO: 645348 - DNA, 25 bp, Homo sapien
tgtttattaaccatttgcatatctt

SEQ ID NO: 645349 - DNA, 25 bp, Homo sapien
gtttattaaccatttgcatatcttt

SEQ ID NO: 645350 - DNA, 25 bp, Homo sapien
ttattaaccatttgcatatcttttt

SEQ ID NO: 645351 - DNA, 25 bp, Homo sapien
gcatatcttttttagtaaaatgcct

SEQ ID NO: 645352 - DNA, 25 bp, Homo sapien
tagtaaaatgcctattcaattcttt

SEQ ID NO: 645353 - DNA, 25 bp, Homo sapien
agtaaaatgcctattcaattctttt

SEQ ID NO: 645354 - DNA, 25 bp, Homo sapien
gtaaaatgcctattcaattcttttc

SEQ ID NO: 645355 - DNA, 25 bp, Homo sapien
agagagacctgagcttgcacacagc

SEQ ID NO: 645356 - DNA, 25 bp, Homo sapien
gagacctgagcttgcacacagcctg

SEQ ID NO: 645357 - DNA, 25 bp, Homo sapien
acctgagcttgcacacagcctgcta

SEQ ID NO: 645358 - DNA, 25 bp, Homo sapien
gagcttgcacacagcctgctagcca

SEQ ID NO: 645359 - DNA, 25 bp, Homo sapien
cagcctgctagccatgtgatgccct

SEQ ID NO: 645360 - DNA, 25 bp, Homo sapien
tgccctgtgctacctcaagactctg

SEQ ID NO: 645361 - DNA, 25 bp, Homo sapien
tgtgctacctcaagactctgcagag

SEQ ID NO: 645362 - DNA, 25 bp, Homo sapien
tgctacctcaagactctgcagagtc

SEQ ID NO: 645363 - DNA, 25 bp, Homo sapien
aagaaggcccttgattttggatatc

SEQ ID NO: 645364 - DNA, 25 bp, Homo sapien
aaggcccttgattttggatatctca

SEQ ID NO: 645365 - DNA, 25 bp, Homo sapien
ggcccttgattttggatatctcagc

SEQ ID NO: 645366 - DNA, 25 bp, Homo sapien
agaagtggccaacaccctacccaag

SEQ ID NO: 645367 - DNA, 25 bp, Homo sapien
ggccaacaccctacccaagaggaga

SEQ ID NO: 645368 - DNA, 25 bp, Homo sapien
aagaggagaccgcacagccacggcc

SEQ ID NO: 645369 - DNA, 25 bp, Homo sapien
agccacggccaacgtggagctctaa

SEQ ID NO: 645370 - DNA, 25 bp, Homo sapien
caacgtggagctctaactcagggct

SEQ ID NO: 645371 - DNA, 25 bp, Homo sapien
gagctctaactcagggctccagcct

SEQ ID NO: 645372 - DNA, 25 bp, Homo sapien
cagtccttttccttgagtagggacg

SEQ ID NO: 645373 - DNA, 25 bp, Homo sapien
tgagtagggacgacccccacagcgg

SEQ ID NO: 645374 - DNA, 25 bp, Homo sapien
acagcggcctctctgcattgcttag

SEQ ID NO: 645375 - DNA, 25 bp, Homo sapien
cctgcaggtgcctgctacacgtggg

SEQ ID NO: 645376 - DNA, 25 bp, Homo sapien
acggccgacggaaagctcagtcatg

SEQ ID NO: 645377 - DNA, 25 bp, Homo sapien
aaaacagtgtccacgtcactgggaa

SEQ ID NO: 645378 - DNA, 25 bp, Homo sapien
acgtcactgggaaccgcaagattca

SEQ ID NO: 645379 - DNA, 25 bp, Homo sapien
attcaggaaggccaaccctctgggc

SEQ ID NO: 645380 - DNA, 25 bp, Homo sapien
ccctctgggcaactagaacacactg

SEQ ID NO: 645381 - DNA, 25 bp, Homo sapien
acactgcctttgtgtgaacctgcat

SEQ ID NO: 645382 - DNA, 25 bp, Homo sapien
gtgtgaacctgcatggacaggcaaa

SEQ ID NO: 645383 - DNA, 25 bp, Homo sapien
aggcaaatgcttctccctgggatat

SEQ ID NO: 645384 - DNA, 25 bp, Homo sapien
aaacatggcatggagatttcagaac

SEQ ID NO: 645385 - DNA, 25 bp, Homo sapien
gatttcagaacaaatcctggtctgc

SEQ ID NO: 645386 - DNA, 25 bp, Homo sapien
aatcctggtctgcagtgaagttcag

SEQ ID NO: 645387 - DNA, 25 bp, Homo sapien
aagttttccttatgaaaccagagat

SEQ ID NO: 645388 - DNA, 25 bp, Homo sapien
ttgttgagaatactgcgggccacca

SEQ ID NO: 645389 - DNA, 25 bp, Homo sapien
gaggacttcttggactgctccatca

SEQ ID NO: 645390 - DNA, 25 bp, Homo sapien
actgctccatcatgagctgcgggca

SEQ ID NO: 645391 - DNA, 25 bp, Homo sapien
tccatcatgagctgcgggcagggca

SEQ ID NO: 645392 - DNA, 25 bp, Homo sapien
gctgctctgagtgccctacaagttg

SEQ ID NO: 645393 - DNA, 25 bp, Homo sapien
tgagtgccctacaagttgctgcccc

SEQ ID NO: 645394 - DNA, 25 bp, Homo sapien
ggagggccactccacaagcatggaa

SEQ ID NO: 645395 - DNA, 25 bp, Homo sapien
agcatggaaccacaacctatctgat

SEQ ID NO: 645396 - DNA, 25 bp, Homo sapien
ggaaccacaacctatctgatctttg

SEQ ID NO: 645397 - DNA, 25 bp, Homo sapien
tgatctttgttcaaattccctctcc

SEQ ID NO: 645398 - DNA, 25 bp, Homo sapien
ttccacaccacacttactgtaggta

SEQ ID NO: 645399 - DNA, 25 bp, Homo sapien
gtgatctctgtgcacacagctgcat

SEQ ID NO: 645400 - DNA, 25 bp, Homo sapien
agggaggtcctcagtgagtgcacct

SEQ ID NO: 645401 - DNA, 25 bp, Homo sapien
gtgagtgcacctgcccagtcttgaa

SEQ ID NO: 645402 - DNA, 25 bp, Homo sapien
gaaccttccagccatcagaatctga

SEQ ID NO: 645403 - DNA, 25 bp, Homo sapien
cttcctttataaagacccagcctca

SEQ ID NO: 645404 - DNA, 25 bp, Homo sapien
aaagacccagcctcaggtcttctgt

SEQ ID NO: 645405 - DNA, 25 bp, Homo sapien
cctcaggtcttctgtcagagcaaca

SEQ ID NO: 645406 - DNA, 25 bp, Homo sapien
gtcttctgtcagagcaacacaaaat

SEQ ID NO: 645407 - DNA, 25 bp, Homo sapien
aaatggactcagcacggatcaaatt

SEQ ID NO: 645408 - DNA, 25 bp, Homo sapien
atggactcagcacggatcaaattgt

SEQ ID NO: 645409 - DNA, 25 bp, Homo sapien
agcacggatcaaattgtgtctcccc

SEQ ID NO: 645410 - DNA, 25 bp, Homo sapien
gggttatcttagtgcctctcatgaa

SEQ ID NO: 645411 - DNA, 25 bp, Homo sapien
agtgcctctcatgaatcgggtgttt

SEQ ID NO: 645412 - DNA, 25 bp, Homo sapien
tgaatcgggtgtttttcaaatttct

SEQ ID NO: 645413 - DNA, 25 bp, Homo sapien
tctcctgagtttccttgtggcactg

SEQ ID NO: 645414 - DNA, 25 bp, Homo sapien
gggactttgagtggtgatgcttttt

SEQ ID NO: 645415 - DNA, 25 bp, Homo sapien
tttacaccttcttccacattctcat

SEQ ID NO: 645416 - DNA, 25 bp, Homo sapien
attctcatgcaagtcaccaccatag

SEQ ID NO: 645417 - DNA, 25 bp, Homo sapien
gtcaccaccatagtcatagccatga

SEQ ID NO: 645418 - DNA, 25 bp, Homo sapien
ttccacgtggaagggtctaacagct

SEQ ID NO: 645419 - DNA, 25 bp, Homo sapien
aagggtctaacagctctaggaggcc

SEQ ID NO: 645420 - DNA, 25 bp, Homo sapien
acagctctaggaggcctgtatttca

SEQ ID NO: 645421 - DNA, 25 bp, Homo sapien
caattcatacgtgccatctctgttg

SEQ ID NO: 645422 - DNA, 25 bp, Homo sapien
gagttttcttgcaaagcctttctta

SEQ ID NO: 645423 - DNA, 25 bp, Homo sapien
agcctttcttaaaagctttctgtca

SEQ ID NO: 645424 - DNA, 25 bp, Homo sapien
ctttctgtcaaatagcttgtcctga

SEQ ID NO: 645425 - DNA, 25 bp, Homo sapien
ggaatgcattatctagatgtctttg

SEQ ID NO: 645426 - DNA, 25 bp, Homo sapien
gtctttgtccatttcagactgtcaa

SEQ ID NO: 645427 - DNA, 25 bp, Homo sapien
tttcagactgtcaatagcgatgaga

SEQ ID NO: 645428 - DNA, 25 bp, Homo sapien
aaacagtcaactagcagtccactcg

SEQ ID NO: 645429 - DNA, 25 bp, Homo sapien
agtccactcgtgaatgttcttctgt

SEQ ID NO: 645430 - DNA, 25 bp, Homo sapien
gtgttgccatggaaggatctgaaga

SEQ ID NO: 645431 - DNA, 25 bp, Homo sapien
atgtataccacatacctagtcctgg

SEQ ID NO: 645432 - DNA, 25 bp, Homo sapien
gttggagcatcaagttccagccggc

SEQ ID NO: 645433 - DNA, 25 bp, Homo sapien
tggagcatcaagttccagccggccc

SEQ ID NO: 645434 - DNA, 25 bp, Homo sapien
cttgcttttctgtggaacctcagag

SEQ ID NO: 645435 - DNA, 25 bp, Homo sapien
ttttctgtggaacctcagaggccag

SEQ ID NO: 645436 - DNA, 25 bp, Homo sapien
cccgctctctggagggaaggacatt

SEQ ID NO: 645437 - DNA, 25 bp, Homo sapien
gctctctggagggaaggacattact

SEQ ID NO: 645438 - DNA, 25 bp, Homo sapien
ggacattactgaacctgtcttgctg

SEQ ID NO: 645439 - DNA, 25 bp, Homo sapien
cattactgaacctgtcttgctgtgc

SEQ ID NO: 645440 - DNA, 25 bp, Homo sapien
tcttgctgtgcctcgaaactctgga

SEQ ID NO: 645441 - DNA, 25 bp, Homo sapien
gctgtgcctcgaaactctggaggtt

SEQ ID NO: 645442 - DNA, 25 bp, Homo sapien
aaactctggaggttggagcatcaag

SEQ ID NO: 645443 - DNA, 25 bp, Homo sapien
caatttatatatcatgacccagaga

SEQ ID NO: 645444 - DNA, 25 bp, Homo sapien
tatatatcatgacccagagatttta

SEQ ID NO: 645445 - DNA, 25 bp, Homo sapien
attctagtgatggaagacgggttta

SEQ ID NO: 645446 - DNA, 25 bp, Homo sapien
atttgataattacttgcaagctaac

SEQ ID NO: 645447 - DNA, 25 bp, Homo sapien
acttgcaagctaacacattaacagg

SEQ ID NO: 645448 - DNA, 25 bp, Homo sapien
gctaacacattaacaggctcaagaa

SEQ ID NO: 645449 - DNA, 25 bp, Homo sapien
aaaacattatcctctcaatttatgc

SEQ ID NO: 645450 - DNA, 25 bp, Homo sapien
acattatcctctcaatttatgcaaa

SEQ ID NO: 645451 - DNA, 25 bp, Homo sapien
gaatagaggagaacaccctaaacct

SEQ ID NO: 645452 - DNA, 25 bp, Homo sapien
tagaggagaacaccctaaacctaat

SEQ ID NO: 645453 - DNA, 25 bp, Homo sapien
aacctaattattaagaccatctaca

SEQ ID NO: 645454 - DNA, 25 bp, Homo sapien
ctccaggtcctgatgttgaaatgaa

SEQ ID NO: 645455 - DNA, 25 bp, Homo sapien
gacaaggtaaatgacccaacagaga

SEQ ID NO: 645456 - DNA, 25 bp, Homo sapien
acccaacagagagtcaacaagaaga

SEQ ID NO: 645457 - DNA, 25 bp, Homo sapien
atgacaatcctcagcatcgcaaggc

SEQ ID NO: 645458 - DNA, 25 bp, Homo sapien
ggagctcgggaagatagcagcacac

SEQ ID NO: 645459 - DNA, 25 bp, Homo sapien
agatagcagcacacgctgtggagga

SEQ ID NO: 645460 - DNA, 25 bp, Homo sapien
ggaatcctttactctaatttctcca

SEQ ID NO: 645461 - DNA, 25 bp, Homo sapien
tttactctaatttctccagctgcat

SEQ ID NO: 645462 - DNA, 25 bp, Homo sapien
taatttctccagctgcattttgttc

SEQ ID NO: 645463 - DNA, 25 bp, Homo sapien
tccagctgcattttgttccgtttat

SEQ ID NO: 645464 - DNA, 25 bp, Homo sapien
gctgcattttgttccgtttatctgc

SEQ ID NO: 645465 - DNA, 25 bp, Homo sapien
tgcctagcccctacagtgacttttt

SEQ ID NO: 645466 - DNA, 25 bp, Homo sapien
gttccttttgacagtttcttcagcc

SEQ ID NO: 645467 - DNA, 25 bp, Homo sapien
ttttgacagtttcttcagccccagt

SEQ ID NO: 645468 - DNA, 25 bp, Homo sapien
gacagtttcttcagccccagtagat

SEQ ID NO: 645469 - DNA, 25 bp, Homo sapien
tttcttcagccccagtagattctgt

SEQ ID NO: 645470 - DNA, 25 bp, Homo sapien
tcagccccagtagattctgttttaa

SEQ ID NO: 645471 - DNA, 25 bp, Homo sapien
gattctgttttaacctttgcttcac

SEQ ID NO: 645472 - DNA, 25 bp, Homo sapien
gttttaacctttgcttcacatttgg

SEQ ID NO: 645473 - DNA, 25 bp, Homo sapien
taacctttgcttcacatttggaaaa

SEQ ID NO: 645474 - DNA, 25 bp, Homo sapien
aaaccttgctttttcataattagat

SEQ ID NO: 645475 - DNA, 25 bp, Homo sapien
catttcaagaactagtaattatcca

SEQ ID NO: 645476 - DNA, 25 bp, Homo sapien
gcatgcgccatgacacttggctaat

SEQ ID NO: 645477 - DNA, 25 bp, Homo sapien
ttttaaatagctgcagtaatcccgg

SEQ ID NO: 645478 - DNA, 25 bp, Homo sapien
tttaaatagctgcagtaatcccggc

SEQ ID NO: 645479 - DNA, 25 bp, Homo sapien
ttaaatagctgcagtaatcccggct

SEQ ID NO: 645480 - DNA, 25 bp, Homo sapien
taaatagctgcagtaatcccggctt

SEQ ID NO: 645481 - DNA, 25 bp, Homo sapien
aaatagctgcagtaatcccggcttt

SEQ ID NO: 645482 - DNA, 25 bp, Homo sapien
aatagctgcagtaatcccggcttta

SEQ ID NO: 645483 - DNA, 25 bp, Homo sapien
atagctgcagtaatcccggctttag

SEQ ID NO: 645484 - DNA, 25 bp, Homo sapien
tagctgcagtaatcccggctttaga

SEQ ID NO: 645485 - DNA, 25 bp, Homo sapien
agctgcagtaatcccggctttagat

SEQ ID NO: 645486 - DNA, 25 bp, Homo sapien
gaactaataatatcactagtgttca

SEQ ID NO: 645487 - DNA, 25 bp, Homo sapien
gatgtagcgagatactttgtctctt

SEQ ID NO: 645488 - DNA, 25 bp, Homo sapien
atgtagcgagatactttgtctctta

SEQ ID NO: 645489 - DNA, 25 bp, Homo sapien
tgtagcgagatactttgtctcttaa

SEQ ID NO: 645490 - DNA, 25 bp, Homo sapien
gtagcgagatactttgtctcttaaa

SEQ ID NO: 645491 - DNA, 25 bp, Homo sapien
aaaatgaaatgtttggctgagagcg

SEQ ID NO: 645492 - DNA, 25 bp, Homo sapien
aaatgaaatgtttggctgagagcgg

SEQ ID NO: 645493 - DNA, 25 bp, Homo sapien
aatgaaatgtttggctgagagcggt

SEQ ID NO: 645494 - DNA, 25 bp, Homo sapien
aaatgtttggctgagagcggtggct

SEQ ID NO: 645495 - DNA, 25 bp, Homo sapien
aatgtttggctgagagcggtggctc

SEQ ID NO: 645496 - DNA, 25 bp, Homo sapien
tactaaaagaatgcaagaattggct

SEQ ID NO: 645497 - DNA, 25 bp, Homo sapien
actaaaagaatgcaagaattggctg

SEQ ID NO: 645498 - DNA, 25 bp, Homo sapien
gacagtagaatagtggtttccagga

SEQ ID NO: 645499 - DNA, 25 bp, Homo sapien
acagtagaatagtggtttccaggat

SEQ ID NO: 645500 - DNA, 25 bp, Homo sapien
agtagaatagtggtttccaggatgg

SEQ ID NO: 645501 - DNA, 25 bp, Homo sapien
acaggaagtgattgttcatagatat

SEQ ID NO: 645502 - DNA, 25 bp, Homo sapien
ttcatagatatggagtttcgcttgg

SEQ ID NO: 645503 - DNA, 25 bp, Homo sapien
catagatatggagtttcgcttggga

SEQ ID NO: 645504 - DNA, 25 bp, Homo sapien
atagatatggagtttcgcttgggat

SEQ ID NO: 645505 - DNA, 25 bp, Homo sapien
tagatatggagtttcgcttgggatg

SEQ ID NO: 645506 - DNA, 25 bp, Homo sapien
agatatggagtttcgcttgggatga

SEQ ID NO: 645507 - DNA, 25 bp, Homo sapien
atggagtttcgcttgggatgatgaa

SEQ ID NO: 645508 - DNA, 25 bp, Homo sapien
ggagtttcgcttgggatgatgaaaa

SEQ ID NO: 645509 - DNA, 25 bp, Homo sapien
gtcctcatagccacataagccaatt

SEQ ID NO: 645510 - DNA, 25 bp, Homo sapien
agccacataagccaattgcttgtaa

SEQ ID NO: 645511 - DNA, 25 bp, Homo sapien
ttgcttgtaataaatctcctagtgt

SEQ ID NO: 645512 - DNA, 25 bp, Homo sapien
ataaatctcctagtgttaatgatcc

SEQ ID NO: 645513 - DNA, 25 bp, Homo sapien
gtattaataaatcaatctccctctc

SEQ ID NO: 645514 - DNA, 25 bp, Homo sapien
cacacacgtcttactagttctactt

SEQ ID NO: 645515 - DNA, 25 bp, Homo sapien
acgtcttactagttctacttctctg

SEQ ID NO: 645516 - DNA, 25 bp, Homo sapien
tactagttctacttctctggtggaa

SEQ ID NO: 645517 - DNA, 25 bp, Homo sapien
acttctctggtggaaccttgactga

SEQ ID NO: 645518 - DNA, 25 bp, Homo sapien
ctggtggaaccttgactgatataga

SEQ ID NO: 645519 - DNA, 25 bp, Homo sapien
gaaccttgactgatatagatgagta

SEQ ID NO: 645520 - DNA, 25 bp, Homo sapien
tgctttcttggttgaaagagaacta

SEQ ID NO: 645521 - DNA, 25 bp, Homo sapien
tcttggttgaaagagaactagtttt

SEQ ID NO: 645522 - DNA, 25 bp, Homo sapien
gaagatagttgtattttctcatttt

SEQ ID NO: 645523 - DNA, 25 bp, Homo sapien
ttttttctacatgagactaaatgac

SEQ ID NO: 645524 - DNA, 25 bp, Homo sapien
tttctacatgagactaaatgactat

SEQ ID NO: 645525 - DNA, 25 bp, Homo sapien
tgagactaaatgactatagtttcat

SEQ ID NO: 645526 - DNA, 25 bp, Homo sapien
gactatagtttcattaaaccttctt

SEQ ID NO: 645527 - DNA, 25 bp, Homo sapien
tagtttcattaaaccttctttgctt

SEQ ID NO: 645528 - DNA, 25 bp, Homo sapien
tttgcttttgaattcaatgtatgag

SEQ ID NO: 645529 - DNA, 25 bp, Homo sapien
gtatgagtagaatattttgttcttt

SEQ ID NO: 645530 - DNA, 25 bp, Homo sapien
actgttagatttttgtggccgggca

SEQ ID NO: 645531 - DNA, 25 bp, Homo sapien
aaattaagtagttagggctgggcat

SEQ ID NO: 645532 - DNA, 25 bp, Homo sapien
aattaagtagttagggctgggcata

SEQ ID NO: 645533 - DNA, 25 bp, Homo sapien
attaagtagttagggctgggcatag

SEQ ID NO: 645534 - DNA, 25 bp, Homo sapien
ttaagtagttagggctgggcatagt

SEQ ID NO: 645535 - DNA, 25 bp, Homo sapien
taagtagttagggctgggcatagtg

SEQ ID NO: 645536 - DNA, 25 bp, Homo sapien
aagtagttagggctgggcatagtgg

SEQ ID NO: 645537 - DNA, 25 bp, Homo sapien
agtagttagggctgggcatagtggc

SEQ ID NO: 645538 - DNA, 25 bp, Homo sapien
gtagttagggctgggcatagtggct

SEQ ID NO: 645539 - DNA, 25 bp, Homo sapien
tagttagggctgggcatagtggctc

SEQ ID NO: 645540 - DNA, 25 bp, Homo sapien
tgatcccagctacatgagaggctgg

SEQ ID NO: 645541 - DNA, 25 bp, Homo sapien
gatcccagctacatgagaggctggg

SEQ ID NO: 645542 - DNA, 25 bp, Homo sapien
gagaccgaggccagaggattacttg

SEQ ID NO: 645543 - DNA, 25 bp, Homo sapien
ctattagctgtcagagcgatgatat

SEQ ID NO: 645544 - DNA, 25 bp, Homo sapien
tattagctgtcagagcgatgatatc

SEQ ID NO: 645545 - DNA, 25 bp, Homo sapien
tcatgtgctgggaaactctattgta

SEQ ID NO: 645546 - DNA, 25 bp, Homo sapien
catgtgctgggaaactctattgtat

SEQ ID NO: 645547 - DNA, 25 bp, Homo sapien
atgtgctgggaaactctattgtata

SEQ ID NO: 645548 - DNA, 25 bp, Homo sapien
gtgctgggaaactctattgtatact

SEQ ID NO: 645549 - DNA, 25 bp, Homo sapien
gctgggaaactctattgtatactta

SEQ ID NO: 645550 - DNA, 25 bp, Homo sapien
gggaaactctattgtatacttacga

SEQ ID NO: 645551 - DNA, 25 bp, Homo sapien
gaaactctattgtatacttacgaaa

SEQ ID NO: 645552 - DNA, 25 bp, Homo sapien
actctattgtatacttacgaaagaa

SEQ ID NO: 645553 - DNA, 25 bp, Homo sapien
ccctgcagtgcctgcgttagaaaag

SEQ ID NO: 645554 - DNA, 25 bp, Homo sapien
cctgcagtgcctgcgttagaaaagc

SEQ ID NO: 645555 - DNA, 25 bp, Homo sapien
tgcagtgcctgcgttagaaaagcat

SEQ ID NO: 645556 - DNA, 25 bp, Homo sapien
gcagtgcctgcgttagaaaagcatt

SEQ ID NO: 645557 - DNA, 25 bp, Homo sapien
cagtgcctgcgttagaaaagcattc

SEQ ID NO: 645558 - DNA, 25 bp, Homo sapien
agtgcctgcgttagaaaagcattct

SEQ ID NO: 645559 - DNA, 25 bp, Homo sapien
gtgcctgcgttagaaaagcattcta

SEQ ID NO: 645560 - DNA, 25 bp, Homo sapien
gcctgcgttagaaaagcattctaag

SEQ ID NO: 645561 - DNA, 25 bp, Homo sapien
agaaaagcattctaaggctgaggtg

SEQ ID NO: 645562 - DNA, 25 bp, Homo sapien
gaaaagcattctaaggctgaggtgg

SEQ ID NO: 645563 - DNA, 25 bp, Homo sapien
aaagcattctaaggctgaggtgggc

SEQ ID NO: 645564 - DNA, 25 bp, Homo sapien
catccggaggtctagaataattttg

SEQ ID NO: 645565 - DNA, 25 bp, Homo sapien
ataattttggcctggaatctctgca

SEQ ID NO: 645566 - DNA, 25 bp, Homo sapien
ggaatctctgcaggacttgatctaa

SEQ ID NO: 645567 - DNA, 25 bp, Homo sapien
ggacttgatctaatctggtgtggac

SEQ ID NO: 645568 - DNA, 25 bp, Homo sapien
aatctggtgtggacagttcccctgc

SEQ ID NO: 645569 - DNA, 25 bp, Homo sapien
agcactgataccagcttctttagta

SEQ ID NO: 645570 - DNA, 25 bp, Homo sapien
gatgctgagggaactaaggattttt

SEQ ID NO: 645571 - DNA, 25 bp, Homo sapien
tgctggttcaacattgcccagaaca

SEQ ID NO: 645572 - DNA, 25 bp, Homo sapien
ttgcccagaacaggtaaacagaact

SEQ ID NO: 645573 - DNA, 25 bp, Homo sapien
acttgacggcgggagatgacaatga

SEQ ID NO: 645574 - DNA, 25 bp, Homo sapien
aggctttctttatgtcttcaaattt

SEQ ID NO: 645575 - DNA, 25 bp, Homo sapien
gaaacaacagagacttattttactt

SEQ ID NO: 645576 - DNA, 25 bp, Homo sapien
aacaacagagacttattttacttat

SEQ ID NO: 645577 - DNA, 25 bp, Homo sapien
acaacagagacttattttacttatg

SEQ ID NO: 645578 - DNA, 25 bp, Homo sapien
aacagagacttattttacttatgtt

SEQ ID NO: 645579 - DNA, 25 bp, Homo sapien
acagagacttattttacttatgttt

SEQ ID NO: 645580 - DNA, 25 bp, Homo sapien
cagagacttattttacttatgtttt

SEQ ID NO: 645581 - DNA, 25 bp, Homo sapien
tttacttatgttttcctcttttctg

SEQ ID NO: 645582 - DNA, 25 bp, Homo sapien
ttatgttttcctcttttctgtgtgt

SEQ ID NO: 645583 - DNA, 25 bp, Homo sapien
cttttctgtgtgtataatgagagaa

SEQ ID NO: 645584 - DNA, 25 bp, Homo sapien
gtataatgagagaaattaggatgcc

SEQ ID NO: 645585 - DNA, 25 bp, Homo sapien
atcactggaggtcagcctggccaac

SEQ ID NO: 645586 - DNA, 25 bp, Homo sapien
ccaaaactgggaggccaacgtgaga

SEQ ID NO: 645587 - DNA, 25 bp, Homo sapien
tttgaaatcagcctaggtaactagg

SEQ ID NO: 645588 - DNA, 25 bp, Homo sapien
cctaggtaactaggcaagacctcat

SEQ ID NO: 645589 - DNA, 25 bp, Homo sapien
taggtaactaggcaagacctcatgt

SEQ ID NO: 645590 - DNA, 25 bp, Homo sapien
aggtaactaggcaagacctcatgtc

SEQ ID NO: 645591 - DNA, 25 bp, Homo sapien
ggtaactaggcaagacctcatgtct

SEQ ID NO: 645592 - DNA, 25 bp, Homo sapien
gtaactaggcaagacctcatgtcta

SEQ ID NO: 645593 - DNA, 25 bp, Homo sapien
taactaggcaagacctcatgtctat

SEQ ID NO: 645594 - DNA, 25 bp, Homo sapien
aactaggcaagacctcatgtctata

SEQ ID NO: 645595 - DNA, 25 bp, Homo sapien
taggcaagacctcatgtctatagaa

SEQ ID NO: 645596 - DNA, 25 bp, Homo sapien
gcaacacagcaacacaccgtgtccc

SEQ ID NO: 645597 - DNA, 25 bp, Homo sapien
attagtgcactttgaaacagcacta

SEQ ID NO: 645598 - DNA, 25 bp, Homo sapien
tgcactttgaaacagcactagaggc

SEQ ID NO: 645599 - DNA, 25 bp, Homo sapien
gcactttgaaacagcactagaggct

SEQ ID NO: 645600 - DNA, 25 bp, Homo sapien
actttgaaacagcactagaggctgg

SEQ ID NO: 645601 - DNA, 25 bp, Homo sapien
ttgaaacagcactagaggctgggct

SEQ ID NO: 645602 - DNA, 25 bp, Homo sapien
tgaaacagcactagaggctgggctg

SEQ ID NO: 645603 - DNA, 25 bp, Homo sapien
aacagcactagaggctgggctgatg

SEQ ID NO: 645604 - DNA, 25 bp, Homo sapien
tagaggctgggctgatggcttacac

SEQ ID NO: 645605 - DNA, 25 bp, Homo sapien
gtggcggacacctataattctagct

SEQ ID NO: 645606 - DNA, 25 bp, Homo sapien
taattctagctcttgggagacagag

SEQ ID NO: 645607 - DNA, 25 bp, Homo sapien
aattctagctcttgggagacagagg

SEQ ID NO: 645608 - DNA, 25 bp, Homo sapien
cccagctaatttcccgtattatcca

SEQ ID NO: 645609 - DNA, 25 bp, Homo sapien
aaatgtgccagaacaggacctcaca

SEQ ID NO: 645610 - DNA, 25 bp, Homo sapien
gaacaggacctcacaacccaaaatt

SEQ ID NO: 645611 - DNA, 25 bp, Homo sapien
gacctcacaacccaaaattactcta

SEQ ID NO: 645612 - DNA, 25 bp, Homo sapien
tcacaacccaaaattactctaccaa

SEQ ID NO: 645613 - DNA, 25 bp, Homo sapien
tctaccaaatgagagatgtacctta

SEQ ID NO: 645614 - DNA, 25 bp, Homo sapien
atgagagatgtaccttaagcaaaag

SEQ ID NO: 645615 - DNA, 25 bp, Homo sapien
aaagggaaagatgcctgggttctgt

SEQ ID NO: 645616 - DNA, 25 bp, Homo sapien
aaagatgcctgggttctgtagaaag

SEQ ID NO: 645617 - DNA, 25 bp, Homo sapien
tgcctgggttctgtagaaagacttt

SEQ ID NO: 645618 - DNA, 25 bp, Homo sapien
tttggagtcgaggttttgctcttgt

SEQ ID NO: 645619 - DNA, 25 bp, Homo sapien
catggggttgtatctgattggcaga

SEQ ID NO: 645620 - DNA, 25 bp, Homo sapien
atgttttcatgttgtgacaattggg

SEQ ID NO: 645621 - DNA, 25 bp, Homo sapien
gtgacaattgggtaaacttctggaa

SEQ ID NO: 645622 - DNA, 25 bp, Homo sapien
aaaatagagctccatacctcactca

SEQ ID NO: 645623 - DNA, 25 bp, Homo sapien
atagagctccatacctcactcagca

SEQ ID NO: 645624 - DNA, 25 bp, Homo sapien
ctcactcagcacacctggattgtaa

SEQ ID NO: 645625 - DNA, 25 bp, Homo sapien
cactcagcacacctggattgtaaat

SEQ ID NO: 645626 - DNA, 25 bp, Homo sapien
tcagcacacctggattgtaaatcga

SEQ ID NO: 645627 - DNA, 25 bp, Homo sapien
gcacacctggattgtaaatcgatta

SEQ ID NO: 645628 - DNA, 25 bp, Homo sapien
ggattgtaaatcgattaggagctta

SEQ ID NO: 645629 - DNA, 25 bp, Homo sapien
aatcgattaggagcttaatgtataa

SEQ ID NO: 645630 - DNA, 25 bp, Homo sapien
acaaagcacttaaatcagtccattc

SEQ ID NO: 645631 - DNA, 25 bp, Homo sapien
gacttccgcagtgtgctaacatgga

SEQ ID NO: 645632 - DNA, 25 bp, Homo sapien
gtgtgctaacatggattattctttc

SEQ ID NO: 645633 - DNA, 25 bp, Homo sapien
attctttcatttgctgatccttgta

SEQ ID NO: 645634 - DNA, 25 bp, Homo sapien
ttgctgatccttgtatgtgcagtag

SEQ ID NO: 645635 - DNA, 25 bp, Homo sapien
gggtggtggcagcatatttctacat

SEQ ID NO: 645636 - DNA, 25 bp, Homo sapien
gcagcatatttctacatcaccttgg

SEQ ID NO: 645637 - DNA, 25 bp, Homo sapien
tttctacatcaccttggactttacc

SEQ ID NO: 645638 - DNA, 25 bp, Homo sapien
catcaccttggactttacctttctg

SEQ ID NO: 645639 - DNA, 25 bp, Homo sapien
ccctgactggtgcttcagtaaaccc

SEQ ID NO: 645640 - DNA, 25 bp, Homo sapien
ggtgcttcagtaaacccacgaataa

SEQ ID NO: 645641 - DNA, 25 bp, Homo sapien
agttgccttttgttagcagtgtgga

SEQ ID NO: 645642 - DNA, 25 bp, Homo sapien
caggcaaaagtgatcagcgtggttt

SEQ ID NO: 645643 - DNA, 25 bp, Homo sapien
agcgtggtttgtatttgcagccgcc

SEQ ID NO: 645644 - DNA, 25 bp, Homo sapien
tcccagctgcaaggtgcgtctttaa

SEQ ID NO: 645645 - DNA, 25 bp, Homo sapien
gcgtctttaatgtgcgacactgaca

SEQ ID NO: 645646 - DNA, 25 bp, Homo sapien
actgacaaggcgtttcagccatgca

SEQ ID NO: 645647 - DNA, 25 bp, Homo sapien
gctaattaatatcatgccgaggctc

SEQ ID NO: 645648 - DNA, 25 bp, Homo sapien
atgccgaggctcaatgtgacaggtc

SEQ ID NO: 645649 - DNA, 25 bp, Homo sapien
gtgacaggtccttcagactcataaa

SEQ ID NO: 645650 - DNA, 25 bp, Homo sapien
aaatgtcgttccttttctgatctct

SEQ ID NO: 645651 - DNA, 25 bp, Homo sapien
gatttactttcagtatgcataacca

SEQ ID NO: 645652 - DNA, 25 bp, Homo sapien
gatgtagcgagatactttgtctctt

SEQ ID NO: 645653 - DNA, 25 bp, Homo sapien
atgtagcgagatactttgtctctta

SEQ ID NO: 645654 - DNA, 25 bp, Homo sapien
tgtagcgagatactttgtctcttaa

SEQ ID NO: 645655 - DNA, 25 bp, Homo sapien
gtagcgagatactttgtctcttaaa

SEQ ID NO: 645656 - DNA, 25 bp, Homo sapien
agcgagatactttgtctcttaaaaa

SEQ ID NO: 645657 - DNA, 25 bp, Homo sapien
aaaatgaaatgtttggctgagagcg

SEQ ID NO: 645658 - DNA, 25 bp, Homo sapien
aaatgaaatgtttggctgagagcgg

SEQ ID NO: 645659 - DNA, 25 bp, Homo sapien
aatgaaatgtttggctgagagcggt

SEQ ID NO: 645660 - DNA, 25 bp, Homo sapien
aatgtttggctgagagcggtggctc

SEQ ID NO: 645661 - DNA, 25 bp, Homo sapien
ggcctgggcaacttggagaaacact

SEQ ID NO: 645662 - DNA, 25 bp, Homo sapien
tactaaaagaatgcaagaattggct

SEQ ID NO: 645663 - DNA, 25 bp, Homo sapien
gaggcccttggcttttgcataatta

SEQ ID NO: 645664 - DNA, 25 bp, Homo sapien
tttgcataattatggaagctccaaa

SEQ ID NO: 645665 - DNA, 25 bp, Homo sapien
aagataccagattgatcttgatcac

SEQ ID NO: 645666 - DNA, 25 bp, Homo sapien
ctagtcttccttggcacatcgtgag

SEQ ID NO: 645667 - DNA, 25 bp, Homo sapien
tggcacatcgtgagtgctcgggtca

SEQ ID NO: 645668 - DNA, 25 bp, Homo sapien
agtgctcgggtcaggctgtgccaca

SEQ ID NO: 645669 - DNA, 25 bp, Homo sapien
ttatcctacatgtactcagatcacg

SEQ ID NO: 645670 - DNA, 25 bp, Homo sapien
tgtactcagatcacgtgaactggtg

SEQ ID NO: 645671 - DNA, 25 bp, Homo sapien
tgaactggtgatgggccacccatgt

SEQ ID NO: 645672 - DNA, 25 bp, Homo sapien
atgtgcctgcctggagactcctatt

SEQ ID NO: 645673 - DNA, 25 bp, Homo sapien
tattcacccttcagatcaatatccc

SEQ ID NO: 645674 - DNA, 25 bp, Homo sapien
gtgggcgtgatcactgtgcccgttt

SEQ ID NO: 645675 - DNA, 25 bp, Homo sapien
atcactgtgcccgttttacagacaa

SEQ ID NO: 645676 - DNA, 25 bp, Homo sapien
gcccgttttacagacaaggccactg

SEQ ID NO: 645677 - DNA, 25 bp, Homo sapien
caaggccactgagctctgagaggtt

SEQ ID NO: 645678 - DNA, 25 bp, Homo sapien
gccactgagctctgagaggttatgt

SEQ ID NO: 645679 - DNA, 25 bp, Homo sapien
cgcctgcaggtctcaaaggtgggat

SEQ ID NO: 645680 - DNA, 25 bp, Homo sapien
gcgagggtccggctgactgcagagc

SEQ ID NO: 645681 - DNA, 25 bp, Homo sapien
tgtgagtccccgtgtgacactctgc

SEQ ID NO: 645682 - DNA, 25 bp, Homo sapien
gtgacactctgcacttggacccttg

SEQ ID NO: 645683 - DNA, 25 bp, Homo sapien
agtggccccgagagtcactccctga

SEQ ID NO: 645684 - DNA, 25 bp, Homo sapien
gagtcactccctgaacacagggaaa

SEQ ID NO: 645685 - DNA, 25 bp, Homo sapien
tcaaagggattttgtgaacagatgc

SEQ ID NO: 645686 - DNA, 25 bp, Homo sapien
aagaggcattggattcttaaaccag

SEQ ID NO: 645687 - DNA, 25 bp, Homo sapien
gattcttaaaccagatgcattagac

SEQ ID NO: 645688 - DNA, 25 bp, Homo sapien
atgatatctcataacctttgtagaa

SEQ ID NO: 645689 - DNA, 25 bp, Homo sapien
gaatggttccatcaaaaaccaagaa

SEQ ID NO: 645690 - DNA, 25 bp, Homo sapien
agcattggctgtgcacttactccct

SEQ ID NO: 645691 - DNA, 25 bp, Homo sapien
tgtgcacttactcccttaggtgtaa

SEQ ID NO: 645692 - DNA, 25 bp, Homo sapien
tactcccttaggtgtaaagcaaaag

SEQ ID NO: 645693 - DNA, 25 bp, Homo sapien
aaagcaaaagtgaatgagccataac

SEQ ID NO: 645694 - DNA, 25 bp, Homo sapien
gaatgagccataacagtgctatgtt

SEQ ID NO: 645695 - DNA, 25 bp, Homo sapien
gagccataacagtgctatgttagaa

SEQ ID NO: 645696 - DNA, 25 bp, Homo sapien
agacatttgtcgaaactttactggt

SEQ ID NO: 645697 - DNA, 25 bp, Homo sapien
ttgtcgaaactttactggtccatgt

SEQ ID NO: 645698 - DNA, 25 bp, Homo sapien
tggtccatgttgtcagctacttctt

SEQ ID NO: 645699 - DNA, 25 bp, Homo sapien
gtcagctacttctttgctagatcgg

SEQ ID NO: 645700 - DNA, 25 bp, Homo sapien
gctacttctttgctagatcggatag

SEQ ID NO: 645701 - DNA, 25 bp, Homo sapien
ttgctagatcggatagtagttttct

SEQ ID NO: 645702 - DNA, 25 bp, Homo sapien
aatggttatagatgtgagatacttc

SEQ ID NO: 645703 - DNA, 25 bp, Homo sapien
gagatacttctaagtttaatctgca

SEQ ID NO: 645704 - DNA, 25 bp, Homo sapien
agcattttcttatcacttgcttaag

SEQ ID NO: 645705 - DNA, 25 bp, Homo sapien
ttatcacttgcttaagtctagacaa

SEQ ID NO: 645706 - DNA, 25 bp, Homo sapien
tctgcagtgtaaatactcccgctgt

SEQ ID NO: 645707 - DNA, 25 bp, Homo sapien
gaacttctgacttcaagcaatccgc

SEQ ID NO: 645708 - DNA, 25 bp, Homo sapien
aacttctgacttcaagcaatccgcc

SEQ ID NO: 645709 - DNA, 25 bp, Homo sapien
ttctgacttcaagcaatccgcccgc

SEQ ID NO: 645710 - DNA, 25 bp, Homo sapien
cagcttcccagggttggtggaattg

SEQ ID NO: 645711 - DNA, 25 bp, Homo sapien
agcttcccagggttggtggaattgc

SEQ ID NO: 645712 - DNA, 25 bp, Homo sapien
gcttcccagggttggtggaattgca

SEQ ID NO: 645713 - DNA, 25 bp, Homo sapien
cttcccagggttggtggaattgcag

SEQ ID NO: 645714 - DNA, 25 bp, Homo sapien
tcccagggttggtggaattgcaggc

SEQ ID NO: 645715 - DNA, 25 bp, Homo sapien
cagggttggtggaattgcaggcgtg

SEQ ID NO: 645716 - DNA, 25 bp, Homo sapien
atctttggaaaagagcagagggctg

SEQ ID NO: 645717 - DNA, 25 bp, Homo sapien
gaggtaggcggagtgctggagccca

SEQ ID NO: 645718 - DNA, 25 bp, Homo sapien
gtattgttctataggttgcttggag

SEQ ID NO: 645719 - DNA, 25 bp, Homo sapien
ctataggttgcttggagtttgtgtc

SEQ ID NO: 645720 - DNA, 25 bp, Homo sapien
tggatttagaacaacctgggatact

SEQ ID NO: 645721 - DNA, 25 bp, Homo sapien
gaacaacctgggatacttagtaata

SEQ ID NO: 645722 - DNA, 25 bp, Homo sapien
ggatacttagtaataacaacgcaca

SEQ ID NO: 645723 - DNA, 25 bp, Homo sapien
gtaataacaacgcacaaacatgtgt

SEQ ID NO: 645724 - DNA, 25 bp, Homo sapien
caacgcacaaacatgtgtatacaca

SEQ ID NO: 645725 - DNA, 25 bp, Homo sapien
ataaatgtgttcctgatatgttgca

SEQ ID NO: 645726 - DNA, 25 bp, Homo sapien
atgtgttcctgatatgttgcatgta

SEQ ID NO: 645727 - DNA, 25 bp, Homo sapien
gttcctgatatgttgcatgtaaact

SEQ ID NO: 645728 - DNA, 25 bp, Homo sapien
atgtaaactgattttgtatggtcaa

SEQ ID NO: 645729 - DNA, 25 bp, Homo sapien
gaatcatttccatctcttactaatt

SEQ ID NO: 645730 - DNA, 25 bp, Homo sapien
taatttagcagggttgacagcaatc

SEQ ID NO: 645731 - DNA, 25 bp, Homo sapien
aattatattctaactggtgctgact

SEQ ID NO: 645732 - DNA, 25 bp, Homo sapien
ggtgctgacttgaagctgagtatca

SEQ ID NO: 645733 - DNA, 25 bp, Homo sapien
agctgagtatcaacgcttaggcaca

SEQ ID NO: 645734 - DNA, 25 bp, Homo sapien
cgcttaggcacagagaccgaatatt

SEQ ID NO: 645735 - DNA, 25 bp, Homo sapien
ttttatgtgtttgcactctctcacc

SEQ ID NO: 645736 - DNA, 25 bp, Homo sapien
actctctcacccagcaactgggaaa

SEQ ID NO: 645737 - DNA, 25 bp, Homo sapien
acacagatctctttcattcattgct

SEQ ID NO: 645738 - DNA, 25 bp, Homo sapien
attcattgctttgcagagcctgcca

SEQ ID NO: 645739 - DNA, 25 bp, Homo sapien
tgccataaccggctatacctttttt

SEQ ID NO: 645740 - DNA, 25 bp, Homo sapien
agggaataatatttacgtggctcac

SEQ ID NO: 645741 - DNA, 25 bp, Homo sapien
gggaataatatttacgtggctcaca

SEQ ID NO: 645742 - DNA, 25 bp, Homo sapien
ggaataatatttacgtggctcacaa

SEQ ID NO: 645743 - DNA, 25 bp, Homo sapien
gaataatatttacgtggctcacaaa

SEQ ID NO: 645744 - DNA, 25 bp, Homo sapien
aataatatttacgtggctcacaaag

SEQ ID NO: 645745 - DNA, 25 bp, Homo sapien
ataatatttacgtggctcacaaaga

SEQ ID NO: 645746 - DNA, 25 bp, Homo sapien
taatatttacgtggctcacaaagac

SEQ ID NO: 645747 - DNA, 25 bp, Homo sapien
ggctcacaaagaccagcaatggatc

SEQ ID NO: 645748 - DNA, 25 bp, Homo sapien
gctcacaaagaccagcaatggatca

SEQ ID NO: 645749 - DNA, 25 bp, Homo sapien
tcacaaagaccagcaatggatcact

SEQ ID NO: 645750 - DNA, 25 bp, Homo sapien
acaaagaccagcaatggatcacttg

SEQ ID NO: 645751 - DNA, 25 bp, Homo sapien
tcggtggtttgggagtcaacggagg

SEQ ID NO: 645752 - DNA, 25 bp, Homo sapien
gagtcaacggaggtgggatgagaga

SEQ ID NO: 645753 - DNA, 25 bp, Homo sapien
tgagcggggtttgatttcctttgga

SEQ ID NO: 645754 - DNA, 25 bp, Homo sapien
tcctttggagattgtgggaaatgat

SEQ ID NO: 645755 - DNA, 25 bp, Homo sapien
tgaggggcatgttctggatccagga

SEQ ID NO: 645756 - DNA, 25 bp, Homo sapien
gataaaagcaagtgtttggaaggaa

SEQ ID NO: 645757 - DNA, 25 bp, Homo sapien
ttggaaggaagggtcttagttctca

SEQ ID NO: 645758 - DNA, 25 bp, Homo sapien
gaaggaagggtcttagttctcagag

SEQ ID NO: 645759 - DNA, 25 bp, Homo sapien
aggaagggtcttagttctcagaggc

SEQ ID NO: 645760 - DNA, 25 bp, Homo sapien
gaagggtcttagttctcagaggcga

SEQ ID NO: 645761 - DNA, 25 bp, Homo sapien
aagggtcttagttctcagaggcgaa

SEQ ID NO: 645762 - DNA, 25 bp, Homo sapien
gtcaccccgatttatgttaaattat

SEQ ID NO: 645763 - DNA, 25 bp, Homo sapien
attatcaccttgactactgctatag

SEQ ID NO: 645764 - DNA, 25 bp, Homo sapien
ctatagaacgaatgtttatgtcccc

SEQ ID NO: 645765 - DNA, 25 bp, Homo sapien
ccccacccaaattcgtatgctaaga

SEQ ID NO: 645766 - DNA, 25 bp, Homo sapien
gtatgctaagacctaatagccaata

SEQ ID NO: 645767 - DNA, 25 bp, Homo sapien
ctcaaaaccagataagtgcccgaat

SEQ ID NO: 645768 - DNA, 25 bp, Homo sapien
ccagagagatcccttgcaccgtcta

SEQ ID NO: 645769 - DNA, 25 bp, Homo sapien
ttgcaccgtctaccatgtgaagtgt

SEQ ID NO: 645770 - DNA, 25 bp, Homo sapien
agaacacagcgagaaggccacctat

SEQ ID NO: 645771 - DNA, 25 bp, Homo sapien
aaggccacctatgagccagaacgtg

SEQ ID NO: 645772 - DNA, 25 bp, Homo sapien
tatgagccagaacgtgggccctcac

SEQ ID NO: 645773 - DNA, 25 bp, Homo sapien
cgggcgtggggtgcgggcttgtaat

SEQ ID NO: 645774 - DNA, 25 bp, Homo sapien
ggcgtggggtgcgggcttgtaatcc

SEQ ID NO: 645775 - DNA, 25 bp, Homo sapien
aaatgaacaaatcagctgggcttgg

SEQ ID NO: 645776 - DNA, 25 bp, Homo sapien
aatgaacaaatcagctgggcttggg

SEQ ID NO: 645777 - DNA, 25 bp, Homo sapien
atcagctgggcttgggggtgcgcgc

SEQ ID NO: 645778 - DNA, 25 bp, Homo sapien
cactggagaccaggaagtcgatgct

SEQ ID NO: 645779 - DNA, 25 bp, Homo sapien
actggagaccaggaagtcgatgctg

SEQ ID NO: 645780 - DNA, 25 bp, Homo sapien
ctggagaccaggaagtcgatgctgc

SEQ ID NO: 645781 - DNA, 25 bp, Homo sapien
tggagaccaggaagtcgatgctgca

SEQ ID NO: 645782 - DNA, 25 bp, Homo sapien
ggagaccaggaagtcgatgctgcag

SEQ ID NO: 645783 - DNA, 25 bp, Homo sapien
cagccttggggacagagccagacct

SEQ ID NO: 645784 - DNA, 25 bp, Homo sapien
aaagcaagatggagcctcactgtct

SEQ ID NO: 645785 - DNA, 25 bp, Homo sapien
agatggagcctcactgtctgatttt

SEQ ID NO: 645786 - DNA, 25 bp, Homo sapien
tgattttcccagacgttcccaggag

SEQ ID NO: 645787 - DNA, 25 bp, Homo sapien
ttcccagacgttcccaggaggtcct

SEQ ID NO: 645788 - DNA, 25 bp, Homo sapien
aggtcctggttatgcagggcagtct

SEQ ID NO: 645789 - DNA, 25 bp, Homo sapien
tatgcagggcagtctggatttttgc

SEQ ID NO: 645790 - DNA, 25 bp, Homo sapien
gcagtctggatttttgccctcacag

SEQ ID NO: 645791 - DNA, 25 bp, Homo sapien
tgcaggtgggaatgaccactccctt

SEQ ID NO: 645792 - DNA, 25 bp, Homo sapien
gaccactcccttcctaaagatgaga

SEQ ID NO: 645793 - DNA, 25 bp, Homo sapien
aaagatgagaaaacctgaactagga

SEQ ID NO: 645794 - DNA, 25 bp, Homo sapien
tatgatcccactgctgcactttagc

SEQ ID NO: 645795 - DNA, 25 bp, Homo sapien
gatggtaccttcttggtgattgcta

SEQ ID NO: 645796 - DNA, 25 bp, Homo sapien
accttcttggtgattgctatttctt

SEQ ID NO: 645797 - DNA, 25 bp, Homo sapien
attgctatttctttaattcttctta

SEQ ID NO: 645798 - DNA, 25 bp, Homo sapien
attcttcttaatcgctaaatccttg

SEQ ID NO: 645799 - DNA, 25 bp, Homo sapien
atcgctaaatccttgtttggttcag

SEQ ID NO: 645800 - DNA, 25 bp, Homo sapien
aatccttgtttggttcagtttctgg

SEQ ID NO: 645801 - DNA, 25 bp, Homo sapien
aatatttccactttcatggattcac

SEQ ID NO: 645802 - DNA, 25 bp, Homo sapien
ggattcactttttctccataggagg

SEQ ID NO: 645803 - DNA, 25 bp, Homo sapien
gggtacattttttcaccacatcact

SEQ ID NO: 645804 - DNA, 25 bp, Homo sapien
ttttttcaccacatcacttattcac

SEQ ID NO: 645805 - DNA, 25 bp, Homo sapien
acttattcaccacactacattcaga

SEQ ID NO: 645806 - DNA, 25 bp, Homo sapien
ccatgtgaaagaactcaagtgcacc

SEQ ID NO: 645807 - DNA, 25 bp, Homo sapien
catgtgaaagaactcaagtgcacca

SEQ ID NO: 645808 - DNA, 25 bp, Homo sapien
atgtgaaagaactcaagtgcaccag

SEQ ID NO: 645809 - DNA, 25 bp, Homo sapien
tgtgaaagaactcaagtgcaccagc

SEQ ID NO: 645810 - DNA, 25 bp, Homo sapien
gtgaaagaactcaagtgcaccagcc

SEQ ID NO: 645811 - DNA, 25 bp, Homo sapien
tgaaagaactcaagtgcaccagcct

SEQ ID NO: 645812 - DNA, 25 bp, Homo sapien
gaaagaactcaagtgcaccagcctg

SEQ ID NO: 645813 - DNA, 25 bp, Homo sapien
aaagaactcaagtgcaccagcctgg

SEQ ID NO: 645814 - DNA, 25 bp, Homo sapien
aagaactcaagtgcaccagcctggc

SEQ ID NO: 645815 - DNA, 25 bp, Homo sapien
agaactcaagtgcaccagcctggcc

SEQ ID NO: 645816 - DNA, 25 bp, Homo sapien
gaactcaagtgcaccagcctggcca

SEQ ID NO: 645817 - DNA, 25 bp, Homo sapien
attttctgtttccatagttcatacc

SEQ ID NO: 645818 - DNA, 25 bp, Homo sapien
gtttccatagttcatacccttgctg

SEQ ID NO: 645819 - DNA, 25 bp, Homo sapien
atagttcatacccttgctggttatg

SEQ ID NO: 645820 - DNA, 25 bp, Homo sapien
ggaaacagtgccacacataatgctg

SEQ ID NO: 645821 - DNA, 25 bp, Homo sapien
acagtgccacacataatgctgtgca

SEQ ID NO: 645822 - DNA, 25 bp, Homo sapien
gctgtgcaaataagcaatcaacatt

SEQ ID NO: 645823 - DNA, 25 bp, Homo sapien
tgaatatgatgcctaatccctcctg

SEQ ID NO: 645824 - DNA, 25 bp, Homo sapien
tatgatgcctaatccctcctggtta

SEQ ID NO: 645825 - DNA, 25 bp, Homo sapien
taatccctcctggttaccttgtatt

SEQ ID NO: 645826 - DNA, 25 bp, Homo sapien
taagtagtttggtgatggttccaat

SEQ ID NO: 645827 - DNA, 25 bp, Homo sapien
gtgatggttccaattttcaacaata

SEQ ID NO: 645828 - DNA, 25 bp, Homo sapien
tttgaaatcagcctaggtaactagg

SEQ ID NO: 645829 - DNA, 25 bp, Homo sapien
gaaatcagcctaggtaactaggcaa

SEQ ID NO: 645830 - DNA, 25 bp, Homo sapien
aaatcagcctaggtaactaggcaag

SEQ ID NO: 645831 - DNA, 25 bp, Homo sapien
cctaggtaactaggcaagacctcat

SEQ ID NO: 645832 - DNA, 25 bp, Homo sapien
taggtaactaggcaagacctcatgt

SEQ ID NO: 645833 - DNA, 25 bp, Homo sapien
aggtaactaggcaagacctcatgtc

SEQ ID NO: 645834 - DNA, 25 bp, Homo sapien
ggtaactaggcaagacctcatgtct

SEQ ID NO: 645835 - DNA, 25 bp, Homo sapien
gtaactaggcaagacctcatgtcta

SEQ ID NO: 645836 - DNA, 25 bp, Homo sapien
taactaggcaagacctcatgtctat

SEQ ID NO: 645837 - DNA, 25 bp, Homo sapien
aactaggcaagacctcatgtctata

SEQ ID NO: 645838 - DNA, 25 bp, Homo sapien
gcaacacagcaacacaccgtgtccc

SEQ ID NO: 645839 - DNA, 25 bp, Homo sapien
ctgggaaacgctcattagcagcctt

SEQ ID NO: 645840 - DNA, 25 bp, Homo sapien
tgtgcatcccagatcatcagcgaag

SEQ ID NO: 645841 - DNA, 25 bp, Homo sapien
agcgaagtgcacagctggcttccat

SEQ ID NO: 645842 - DNA, 25 bp, Homo sapien
agccttcctccttcatttgcctatt

SEQ ID NO: 645843 - DNA, 25 bp, Homo sapien
tcatttgcctattcaacagttacaa

SEQ ID NO: 645844 - DNA, 25 bp, Homo sapien
aacagttacaaaggcctgagttgca

SEQ ID NO: 645845 - DNA, 25 bp, Homo sapien
ttacaacccattccacccagaagaa

SEQ ID NO: 645846 - DNA, 25 bp, Homo sapien
aagagaactgagactgagcaagaca

SEQ ID NO: 645847 - DNA, 25 bp, Homo sapien
gaaaccaagcaatctctagatccca

SEQ ID NO: 645848 - DNA, 25 bp, Homo sapien
gggaccctgatgtagcaagagcctc

SEQ ID NO: 645849 - DNA, 25 bp, Homo sapien
gtagcaagagcctcttttaaatcct

SEQ ID NO: 645850 - DNA, 25 bp, Homo sapien
tcaaagactggtcctcttctctggg

SEQ ID NO: 645851 - DNA, 25 bp, Homo sapien
gggacgacctcttccacggagcgtg

SEQ ID NO: 645852 - DNA, 25 bp, Homo sapien
cttccacggagcgtgcacttaggga

SEQ ID NO: 645853 - DNA, 25 bp, Homo sapien
gaagaagagcacacacgcctagcca

SEQ ID NO: 645854 - DNA, 25 bp, Homo sapien
ccgaatcaaccctggcgatcaatag

SEQ ID NO: 645855 - DNA, 25 bp, Homo sapien
gggtaacagacgtctcagccagatc

SEQ ID NO: 645856 - DNA, 25 bp, Homo sapien
gccagatcaccctcatatcctaaag

SEQ ID NO: 645857 - DNA, 25 bp, Homo sapien
ccctcatatcctaaagcactcttaa

SEQ ID NO: 645858 - DNA, 25 bp, Homo sapien
agagcttgtttggagagtgtatcat

SEQ ID NO: 645859 - DNA, 25 bp, Homo sapien
gggtgcagctactcctatacctttg

SEQ ID NO: 645860 - DNA, 25 bp, Homo sapien
ctactcctatacctttgctcaaaga

SEQ ID NO: 645861 - DNA, 25 bp, Homo sapien
gttaaagtggaattgtgtcttcaaa

SEQ ID NO: 645862 - DNA, 25 bp, Homo sapien
aaagtggaattgtgtcttcaaaatt

SEQ ID NO: 645863 - DNA, 25 bp, Homo sapien
ggaattgtgtcttcaaaattgtgtc

SEQ ID NO: 645864 - DNA, 25 bp, Homo sapien
tgtgtcttcaaaattgtgtcttcaa

SEQ ID NO: 645865 - DNA, 25 bp, Homo sapien
gtgtcttcaaaattgtgtcttcaaa

SEQ ID NO: 645866 - DNA, 25 bp, Homo sapien
gtcttcaaaattgtgtcttcaaaat

SEQ ID NO: 645867 - DNA, 25 bp, Homo sapien
aaaattgtgtcttcaaaatttcaca

SEQ ID NO: 645868 - DNA, 25 bp, Homo sapien
gtgtcttcaaaatttcacaagttaa

SEQ ID NO: 645869 - DNA, 25 bp, Homo sapien
atttcacaagttaatactattactg

SEQ ID NO: 645870 - DNA, 25 bp, Homo sapien
tactgtattagtccaatgttaaaca

SEQ ID NO: 645871 - DNA, 25 bp, Homo sapien
tttgtttcccaaatagatacaataa

SEQ ID NO: 645872 - DNA, 25 bp, Homo sapien
gaacttctgacttcaagcaatccgc

SEQ ID NO: 645873 - DNA, 25 bp, Homo sapien
aacttctgacttcaagcaatccgcc

SEQ ID NO: 645874 - DNA, 25 bp, Homo sapien
ttctgacttcaagcaatccgcccgc

SEQ ID NO: 645875 - DNA, 25 bp, Homo sapien
cagcttcccagggttggtggaattg

SEQ ID NO: 645876 - DNA, 25 bp, Homo sapien
gcttcccagggttggtggaattgca

SEQ ID NO: 645877 - DNA, 25 bp, Homo sapien
cttcccagggttggtggaattgcag

SEQ ID NO: 645878 - DNA, 25 bp, Homo sapien
cagggttggtggaattgcaggcgtg

SEQ ID NO: 645879 - DNA, 25 bp, Homo sapien
cagcccagctcagcatctttggaaa

SEQ ID NO: 645880 - DNA, 25 bp, Homo sapien
ccagctcagcatctttggaaaagag

SEQ ID NO: 645881 - DNA, 25 bp, Homo sapien
atctttggaaaagagcagagggctg

SEQ ID NO: 645882 - DNA, 25 bp, Homo sapien
gaggtaggcggagtgctggagccca

SEQ ID NO: 645883 - DNA, 25 bp, Homo sapien
tacctttttcacacagccttcgtgg

SEQ ID NO: 645884 - DNA, 25 bp, Homo sapien
acagccttcgtggttatcacagaga

SEQ ID NO: 645885 - DNA, 25 bp, Homo sapien
tcgtggttatcacagagacttaaga

SEQ ID NO: 645886 - DNA, 25 bp, Homo sapien
cataaggccagcgttgtataaaaaa

SEQ ID NO: 645887 - DNA, 25 bp, Homo sapien
gtcatcctgttatatttctttgtct

SEQ ID NO: 645888 - DNA, 25 bp, Homo sapien
ctttgtcttcttcctgttagcaaga

SEQ ID NO: 645889 - DNA, 25 bp, Homo sapien
cttcctgttagcaagaatttggctt

SEQ ID NO: 645890 - DNA, 25 bp, Homo sapien
gaatttggcttttaacttctaagca

SEQ ID NO: 645891 - DNA, 25 bp, Homo sapien
taacttctaagcactatccctgttt

SEQ ID NO: 645892 - DNA, 25 bp, Homo sapien
atccctgtttctctgtagtggtgca

SEQ ID NO: 645893 - DNA, 25 bp, Homo sapien
gtagtggtgcatcccagaatggcca

SEQ ID NO: 645894 - DNA, 25 bp, Homo sapien
atcctcttaaagccccaggccagaa

SEQ ID NO: 645895 - DNA, 25 bp, Homo sapien
ccaggccagaacttcttgggagaca

SEQ ID NO: 645896 - DNA, 25 bp, Homo sapien
agaacttcttgggagacagatttga

SEQ ID NO: 645897 - DNA, 25 bp, Homo sapien
cagatttgagggtttccttccactt

SEQ ID NO: 645898 - DNA, 25 bp, Homo sapien
gatgtcagctgaaggaccacactga

SEQ ID NO: 645899 - DNA, 25 bp, Homo sapien
tgaaggaccacactgatgcagctgt

SEQ ID NO: 645900 - DNA, 25 bp, Homo sapien
actgatgcagctgtcctgaaggact

SEQ ID NO: 645901 - DNA, 25 bp, Homo sapien
tgtcctgaaggactccccgaggagc

SEQ ID NO: 645902 - DNA, 25 bp, Homo sapien
tccccgaggagctacctcatcaaaa

SEQ ID NO: 645903 - DNA, 25 bp, Homo sapien
agtttccactttgcgatgattttat

SEQ ID NO: 645904 - DNA, 25 bp, Homo sapien
tccactttgcgatgattttatcccc

SEQ ID NO: 645905 - DNA, 25 bp, Homo sapien
agagaaaatggaggccgggcacagt

SEQ ID NO: 645906 - DNA, 25 bp, Homo sapien
catggcgaaactacatctctgctga

SEQ ID NO: 645907 - DNA, 25 bp, Homo sapien
atggcgaaactacatctctgctgaa

SEQ ID NO: 645908 - DNA, 25 bp, Homo sapien
tggcgaaactacatctctgctgaag

SEQ ID NO: 645909 - DNA, 25 bp, Homo sapien
ggcgaaactacatctctgctgaaga

SEQ ID NO: 645910 - DNA, 25 bp, Homo sapien
gcgaaactacatctctgctgaagat

SEQ ID NO: 645911 - DNA, 25 bp, Homo sapien
cgaaactacatctctgctgaagata

SEQ ID NO: 645912 - DNA, 25 bp, Homo sapien
gaaactacatctctgctgaagatac

SEQ ID NO: 645913 - DNA, 25 bp, Homo sapien
aaactacatctctgctgaagataca

SEQ ID NO: 645914 - DNA, 25 bp, Homo sapien
aactacatctctgctgaagatacaa

SEQ ID NO: 645915 - DNA, 25 bp, Homo sapien
actacatctctgctgaagatacaaa

SEQ ID NO: 645916 - DNA, 25 bp, Homo sapien
catccattttcgtatgtaagtgtac

SEQ ID NO: 645917 - DNA, 25 bp, Homo sapien
gtaagtgtacataagtatccgcagg

SEQ ID NO: 645918 - DNA, 25 bp, Homo sapien
aagtatccgcaggaggttcttcctt

SEQ ID NO: 645919 - DNA, 25 bp, Homo sapien
atccgcaggaggttcttcctttgaa

SEQ ID NO: 645920 - DNA, 25 bp, Homo sapien
ggaggttcttcctttgaaatcttga

SEQ ID NO: 645921 - DNA, 25 bp, Homo sapien
ttcttcctttgaaatcttgatccag

SEQ ID NO: 645922 - DNA, 25 bp, Homo sapien
cttgatccaggaaagcagcataatt

SEQ ID NO: 645923 - DNA, 25 bp, Homo sapien
acaaaggttttgctttctgatctat

SEQ ID NO: 645924 - DNA, 25 bp, Homo sapien
ctttctgatctatgctgctagaaaa

SEQ ID NO: 645925 - DNA, 25 bp, Homo sapien
tggtgtttctaaaccatgagcaaac

SEQ ID NO: 645926 - DNA, 25 bp, Homo sapien
aaaccatgttatgagtatgtgccac

SEQ ID NO: 645927 - DNA, 25 bp, Homo sapien
gattctgttagcaaattaacccttt

SEQ ID NO: 645928 - DNA, 25 bp, Homo sapien
aaattttattcatatcactgactag

SEQ ID NO: 645929 - DNA, 25 bp, Homo sapien
attttattcatatcactgactagaa

SEQ ID NO: 645930 - DNA, 25 bp, Homo sapien
tatcactgactagaatatatcctca

SEQ ID NO: 645931 - DNA, 25 bp, Homo sapien
tcactgactagaatatatcctcatt

SEQ ID NO: 645932 - DNA, 25 bp, Homo sapien
gactagaatatatcctcattctggg

SEQ ID NO: 645933 - DNA, 25 bp, Homo sapien
actagaatatatcctcattctggga

SEQ ID NO: 645934 - DNA, 25 bp, Homo sapien
ctagaatatatcctcattctgggaa

SEQ ID NO: 645935 - DNA, 25 bp, Homo sapien
cctcattctgggaaaggagagtctt

SEQ ID NO: 645936 - DNA, 25 bp, Homo sapien
ctcattctgggaaaggagagtcttt

SEQ ID NO: 645937 - DNA, 25 bp, Homo sapien
tagtttaaaaagacaacaggccagg

SEQ ID NO: 645938 - DNA, 25 bp, Homo sapien
tccaagtacctgttatgttgcctgg

SEQ ID NO: 645939 - DNA, 25 bp, Homo sapien
gacaacatagtctatgacttcatga

SEQ ID NO: 645940 - DNA, 25 bp, Homo sapien
gacttcatgaagcttctgtacgtta

SEQ ID NO: 645941 - DNA, 25 bp, Homo sapien
catgaagcttctgtacgttagtggg

SEQ ID NO: 645942 - DNA, 25 bp, Homo sapien
atggagtgccagagaagtttatcaa

SEQ ID NO: 645943 - DNA, 25 bp, Homo sapien
aagtttatcaaaatggccacctaca

SEQ ID NO: 645944 - DNA, 25 bp, Homo sapien
gccacctacatttactgctcataga

SEQ ID NO: 645945 - DNA, 25 bp, Homo sapien
catttactgctcatagaggctaaag

SEQ ID NO: 645946 - DNA, 25 bp, Homo sapien
gaggctaaagtgttcctgaatatgg

SEQ ID NO: 645947 - DNA, 25 bp, Homo sapien
gaatatggaatgttccctactcttt

SEQ ID NO: 645948 - DNA, 25 bp, Homo sapien
gttccctactctttctgtttaaatg

SEQ ID NO: 645949 - DNA, 25 bp, Homo sapien
gtgtgtagatatatttctgccatat

SEQ ID NO: 645950 - DNA, 25 bp, Homo sapien
agatatatttctgccatatatagca

SEQ ID NO: 645951 - DNA, 25 bp, Homo sapien
atatagcatattttgataccagcat

SEQ ID NO: 645952 - DNA, 25 bp, Homo sapien
atagcatattttgataccagcataa

SEQ ID NO: 645953 - DNA, 25 bp, Homo sapien
cgtcagggtaaatgagggattcttc

SEQ ID NO: 645954 - DNA, 25 bp, Homo sapien
ttattccttgaattacaagcaatcc

SEQ ID NO: 645955 - DNA, 25 bp, Homo sapien
gaattacaagcaatccaaatctaca

SEQ ID NO: 645956 - DNA, 25 bp, Homo sapien
acaagcaatccaaatctacactttt

SEQ ID NO: 645957 - DNA, 25 bp, Homo sapien
ttgttatctttattatagcgtcatt

SEQ ID NO: 645958 - DNA, 25 bp, Homo sapien
tattatagcgtcatttttgtggtca

SEQ ID NO: 645959 - DNA, 25 bp, Homo sapien
tatagcgtcatttttgtggtcataa

SEQ ID NO: 645960 - DNA, 25 bp, Homo sapien
tgcctgccaggtgggtttcctgcct

SEQ ID NO: 645961 - DNA, 25 bp, Homo sapien
tgccaggtgggtttcctgcctgtct

SEQ ID NO: 645962 - DNA, 25 bp, Homo sapien
acggactctgccagtagctgcttta

SEQ ID NO: 645963 - DNA, 25 bp, Homo sapien
gactctgccagtagctgctttaaag

SEQ ID NO: 645964 - DNA, 25 bp, Homo sapien
ccagtagctgctttaaaggagggag

SEQ ID NO: 645965 - DNA, 25 bp, Homo sapien
gagggagggagttttctgatcctct

SEQ ID NO: 645966 - DNA, 25 bp, Homo sapien
ggagttttctgatcctctggacatc

SEQ ID NO: 645967 - DNA, 25 bp, Homo sapien
ctgagccataggagagccagcccag

SEQ ID NO: 645968 - DNA, 25 bp, Homo sapien
tgtgtctctccatcccttagtaaaa

SEQ ID NO: 645969 - DNA, 25 bp, Homo sapien
gtctctccatcccttagtaaaaata

SEQ ID NO: 645970 - DNA, 25 bp, Homo sapien
gtaaaaatacagcaactcccaactc

SEQ ID NO: 645971 - DNA, 25 bp, Homo sapien
agatgatgggctccagcctcacata

SEQ ID NO: 645972 - DNA, 25 bp, Homo sapien
agcctcacatactgcgtctccaagg

SEQ ID NO: 645973 - DNA, 25 bp, Homo sapien
aacaggttaatcttcaggccgctgt

SEQ ID NO: 645974 - DNA, 25 bp, Homo sapien
ttcaggccgctgttgttcacattac

SEQ ID NO: 645975 - DNA, 25 bp, Homo sapien
gccgctgttgttcacattacctata

SEQ ID NO: 645976 - DNA, 25 bp, Homo sapien
ataaatatcttatctcctgaccgcc

SEQ ID NO: 645977 - DNA, 25 bp, Homo sapien
accgccctgcaacctggatgaactg

SEQ ID NO: 645978 - DNA, 25 bp, Homo sapien
gggttcagtgcatccactcagctca

SEQ ID NO: 645979 - DNA, 25 bp, Homo sapien
atccactcagctcacagccaaggag

SEQ ID NO: 645980 - DNA, 25 bp, Homo sapien
caaggagctcaaagcggagtgtgca

SEQ ID NO: 645981 - DNA, 25 bp, Homo sapien
tgtgcagccccggtggcagatgatg

SEQ ID NO: 645982 - DNA, 25 bp, Homo sapien
gtctttctgtgctgcgaacaccatc

SEQ ID NO: 645983 - DNA, 25 bp, Homo sapien
tcaagctgtcctgctcagatatctt

SEQ ID NO: 645984 - DNA, 25 bp, Homo sapien
cctgctcagatatcttcctcaatga

SEQ ID NO: 645985 - DNA, 25 bp, Homo sapien
gggtggtggtcattaccctgccatt

SEQ ID NO: 645986 - DNA, 25 bp, Homo sapien
tcattaccctgccattcatgtgtat

SEQ ID NO: 645987 - DNA, 25 bp, Homo sapien
cctgccattcatgtgtatcctggta

SEQ ID NO: 645988 - DNA, 25 bp, Homo sapien
gtatcctggtatcatatggctacat

SEQ ID NO: 645989 - DNA, 25 bp, Homo sapien
tcatgagggaagagctctgtgtctt

SEQ ID NO: 645990 - DNA, 25 bp, Homo sapien
ctgtgtcttcttagtggctgtatct

SEQ ID NO: 645991 - DNA, 25 bp, Homo sapien
gtggctgtatcttggattctgtctt

SEQ ID NO: 645992 - DNA, 25 bp, Homo sapien
ttggattctgtcttgtgccagctcc

SEQ ID NO: 645993 - DNA, 25 bp, Homo sapien
tggacgccattacccgcgccgagat

SEQ ID NO: 645994 - DNA, 25 bp, Homo sapien
gagatccagagcctggccgccgaac

SEQ ID NO: 645995 - DNA, 25 bp, Homo sapien
gaactgctggcgcaaaacaccgtgc

SEQ ID NO: 645996 - DNA, 25 bp, Homo sapien
gcgcaaaacaccgtgctgctgatca

SEQ ID NO: 645997 - DNA, 25 bp, Homo sapien
tgctgatcacccacgatccgatgga

SEQ ID NO: 645998 - DNA, 25 bp, Homo sapien
acgatccgatggaggcctgccgcct

SEQ ID NO: 645999 - DNA, 25 bp, Homo sapien
ggatgacgccgacctgctgaaaagc

SEQ ID NO: 646000 - DNA, 25 bp, Homo sapien
tgctgaaaagccaggccgagctgct

SEQ ID NO: 646001 - DNA, 25 bp, Homo sapien
aacaccagccgatcgtgctgatgga

SEQ ID NO: 646002 - DNA, 25 bp, Homo sapien
atcgtgctgatggacgaaccctttt

SEQ ID NO: 646003 - DNA, 25 bp, Homo sapien
tggacgaacccttttccgcgctgga

SEQ ID NO: 646004 - DNA, 25 bp, Homo sapien
ttcagtcatgttagttcagtttcca

SEQ ID NO: 646005 - DNA, 25 bp, Homo sapien
gtcatgttagttcagtttccacagt

SEQ ID NO: 646006 - DNA, 25 bp, Homo sapien
tgttagttcagtttccacagtttga

SEQ ID NO: 646007 - DNA, 25 bp, Homo sapien
cagtttccacagtttgaactgggta

SEQ ID NO: 646008 - DNA, 25 bp, Homo sapien
ttgaactgggtatagattaatatct

SEQ ID NO: 646009 - DNA, 25 bp, Homo sapien
gaacatgtgtatagtgatgctgaaa

SEQ ID NO: 646010 - DNA, 25 bp, Homo sapien
gaggtgtgagctatatttgcttctt

SEQ ID NO: 646011 - DNA, 25 bp, Homo sapien
gcttctttcctgtatgatatacata

SEQ ID NO: 646012 - DNA, 25 bp, Homo sapien
tgatatacatacattgtttccaatc

SEQ ID NO: 646013 - DNA, 25 bp, Homo sapien
attgtttccaatctcatttctatta

SEQ ID NO: 646014 - DNA, 25 bp, Homo sapien
aactataggagagcccacagccttg

SEQ ID NO: 646015 - DNA, 25 bp, Homo sapien
gctgtactcctgctcgcatacagag

SEQ ID NO: 646016 - DNA, 25 bp, Homo sapien
gctcgcatacagagcactgtcactt

SEQ ID NO: 646017 - DNA, 25 bp, Homo sapien
tacagagcactgtcactttccttaa

SEQ ID NO: 646018 - DNA, 25 bp, Homo sapien
agagcactgtcactttccttaaact

SEQ ID NO: 646019 - DNA, 25 bp, Homo sapien
tgtcactttccttaaactcagcagc

SEQ ID NO: 646020 - DNA, 25 bp, Homo sapien
ccccaattaaaacctgcattccttg

SEQ ID NO: 646021 - DNA, 25 bp, Homo sapien
attaaaacctgcattccttgaaatt

SEQ ID NO: 646022 - DNA, 25 bp, Homo sapien
gcattccttgaaattaactcccctt

SEQ ID NO: 646023 - DNA, 25 bp, Homo sapien
ttgaaattaactccccttttgcagc

SEQ ID NO: 646024 - DNA, 25 bp, Homo sapien
tccccttttgcagcttttctgttta

SEQ ID NO: 646025 - DNA, 25 bp, Homo sapien
tttcaccttatttgtcatgctaaga

SEQ ID NO: 646026 - DNA, 25 bp, Homo sapien
agtgattcccctgcgtgagcctcca

SEQ ID NO: 646027 - DNA, 25 bp, Homo sapien
gtgattcccctgcgtgagcctccag

SEQ ID NO: 646028 - DNA, 25 bp, Homo sapien
tgattcccctgcgtgagcctccaga

SEQ ID NO: 646029 - DNA, 25 bp, Homo sapien
gattcccctgcgtgagcctccagag

SEQ ID NO: 646030 - DNA, 25 bp, Homo sapien
attcccctgcgtgagcctccagagt

SEQ ID NO: 646031 - DNA, 25 bp, Homo sapien
ttcccctgcgtgagcctccagagta

SEQ ID NO: 646032 - DNA, 25 bp, Homo sapien
aataaaagttgtctatgtttatggt

SEQ ID NO: 646033 - DNA, 25 bp, Homo sapien
ataaaagttgtctatgtttatggtg

SEQ ID NO: 646034 - DNA, 25 bp, Homo sapien
taaaagttgtctatgtttatggtgc

SEQ ID NO: 646035 - DNA, 25 bp, Homo sapien
ggaaaggcagttacaggacaaacca

SEQ ID NO: 646036 - DNA, 25 bp, Homo sapien
ggcagttacaggacaaaccactcat

SEQ ID NO: 646037 - DNA, 25 bp, Homo sapien
ttacaggacaaaccactcatctttc

SEQ ID NO: 646038 - DNA, 25 bp, Homo sapien
ggacaaaccactcatctttcccaaa

SEQ ID NO: 646039 - DNA, 25 bp, Homo sapien
catctttcccaaaacttgacccaag

SEQ ID NO: 646040 - DNA, 25 bp, Homo sapien
acaggccccatctagtgcaaattag

SEQ ID NO: 646041 - DNA, 25 bp, Homo sapien
atctagtgcaaattaggcccagaaa

SEQ ID NO: 646042 - DNA, 25 bp, Homo sapien
tgctttgctcaacagccacagtagg

SEQ ID NO: 646043 - DNA, 25 bp, Homo sapien
gccacagtaggcttacgtaacctat

SEQ ID NO: 646044 - DNA, 25 bp, Homo sapien
aaacctcatggccttaccctggcaa

SEQ ID NO: 646045 - DNA, 25 bp, Homo sapien
ggtcttgagttcacaatacccccag

SEQ ID NO: 646046 - DNA, 25 bp, Homo sapien
ttatttttggactcattgaaatgaa

SEQ ID NO: 646047 - DNA, 25 bp, Homo sapien
atgaaatactctgacattgtgatgt

SEQ ID NO: 646048 - DNA, 25 bp, Homo sapien
actctgacattgtgatgtcacacta

SEQ ID NO: 646049 - DNA, 25 bp, Homo sapien
ttttccatccaaagttgtgtaattg

SEQ ID NO: 646050 - DNA, 25 bp, Homo sapien
tgtaattgtaaaactttcctaagtg

SEQ ID NO: 646051 - DNA, 25 bp, Homo sapien
actttcctaagtgacctttctctct

SEQ ID NO: 646052 - DNA, 25 bp, Homo sapien
tcaatcccagtgtattttcgcaata

SEQ ID NO: 646053 - DNA, 25 bp, Homo sapien
gaattgaacaactaggtgagccttt

SEQ ID NO: 646054 - DNA, 25 bp, Homo sapien
gtgagccttttaatagtccgtgtct

SEQ ID NO: 646055 - DNA, 25 bp, Homo sapien
gccttttaatagtccgtgtctgaga

SEQ ID NO: 646056 - DNA, 25 bp, Homo sapien
ttttaatagtccgtgtctgagatta

SEQ ID NO: 646057 - DNA, 25 bp, Homo sapien
aggcagagaagccactgataaaggc

SEQ ID NO: 646058 - DNA, 25 bp, Homo sapien
gaagccactgataaaggcgacaagt

SEQ ID NO: 646059 - DNA, 25 bp, Homo sapien
aaggcgacaagtgaggctgagctta

SEQ ID NO: 646060 - DNA, 25 bp, Homo sapien
acaagtgaggctgagcttagagcac

SEQ ID NO: 646061 - DNA, 25 bp, Homo sapien
aagtgaggctgagcttagagcactg

SEQ ID NO: 646062 - DNA, 25 bp, Homo sapien
tgaggctgagcttagagcactggct

SEQ ID NO: 646063 - DNA, 25 bp, Homo sapien
aggctgagcttagagcactggctca

SEQ ID NO: 646064 - DNA, 25 bp, Homo sapien
gagcttagagcactggctcaggcct

SEQ ID NO: 646065 - DNA, 25 bp, Homo sapien
agcttagagcactggctcaggcctg

SEQ ID NO: 646066 - DNA, 25 bp, Homo sapien
gcttagagcactggctcaggcctgg

SEQ ID NO: 646067 - DNA, 25 bp, Homo sapien
tagagcactggctcaggcctgggcc

SEQ ID NO: 646068 - DNA, 25 bp, Homo sapien
gtcaatccagaaacgcgactttcct

SEQ ID NO: 646069 - DNA, 25 bp, Homo sapien
gaaacgcgactttcctggacccctg

SEQ ID NO: 646070 - DNA, 25 bp, Homo sapien
aaggccagtccagaggtgaagtttg

SEQ ID NO: 646071 - DNA, 25 bp, Homo sapien
gtccagaggtgaagtttgaggccct

SEQ ID NO: 646072 - DNA, 25 bp, Homo sapien
gcacgctagaccgtttgctgcacta

SEQ ID NO: 646073 - DNA, 25 bp, Homo sapien
gaccgtttgctgcactaggaattcg

SEQ ID NO: 646074 - DNA, 25 bp, Homo sapien
taggaattcgagcttgggccccact

SEQ ID NO: 646075 - DNA, 25 bp, Homo sapien
gattagtgggcggtctagtctctaa

SEQ ID NO: 646076 - DNA, 25 bp, Homo sapien
ggtctagtctctaaaatgacccctc

SEQ ID NO: 646077 - DNA, 25 bp, Homo sapien
agactggcccttctcgcatcgggac

SEQ ID NO: 646078 - DNA, 25 bp, Homo sapien
gcgcttgcacgctgcaggagccgca

SEQ ID NO: 646079 - DNA, 25 bp, Homo sapien
tatatatataaaataggcaggccag

SEQ ID NO: 646080 - DNA, 25 bp, Homo sapien
atatatataaaataggcaggccagg

SEQ ID NO: 646081 - DNA, 25 bp, Homo sapien
tatatataaaataggcaggccaggt

SEQ ID NO: 646082 - DNA, 25 bp, Homo sapien
atatataaaataggcaggccaggtg

SEQ ID NO: 646083 - DNA, 25 bp, Homo sapien
tatataaaataggcaggccaggtgg

SEQ ID NO: 646084 - DNA, 25 bp, Homo sapien
atataaaataggcaggccaggtggg

SEQ ID NO: 646085 - DNA, 25 bp, Homo sapien
ataaaataggcaggccaggtggggt

SEQ ID NO: 646086 - DNA, 25 bp, Homo sapien
ggtgagccgagatcctgggcaacaa

SEQ ID NO: 646087 - DNA, 25 bp, Homo sapien
gtgagccgagatcctgggcaacaag

SEQ ID NO: 646088 - DNA, 25 bp, Homo sapien
tgagccgagatcctgggcaacaaga

SEQ ID NO: 646089 - DNA, 25 bp, Homo sapien
gcaacaagaacgagattctgtctcc

SEQ ID NO: 646090 - DNA, 25 bp, Homo sapien
aatgggacagagtcctgagccccag

SEQ ID NO: 646091 - DNA, 25 bp, Homo sapien
tgagccccagattccatacgacagc

SEQ ID NO: 646092 - DNA, 25 bp, Homo sapien
attccatacgacagccctctgctga

SEQ ID NO: 646093 - DNA, 25 bp, Homo sapien
ggagtggactaaacgcccatccctg

SEQ ID NO: 646094 - DNA, 25 bp, Homo sapien
tgaagttcgttccagctccaagggt

SEQ ID NO: 646095 - DNA, 25 bp, Homo sapien
tcgttccagctccaagggtgtagaa

SEQ ID NO: 646096 - DNA, 25 bp, Homo sapien
aaaggcatcaacactctggaggact

SEQ ID NO: 646097 - DNA, 25 bp, Homo sapien
aggactttcccctgacagctaatct

SEQ ID NO: 646098 - DNA, 25 bp, Homo sapien
cagctaatctagaggccagcactta

SEQ ID NO: 646099 - DNA, 25 bp, Homo sapien
agaggccagcacttaatggcaaaaa

SEQ ID NO: 646100 - DNA, 25 bp, Homo sapien
gataaggaaaccagctcagagaggc

SEQ ID NO: 646101 - DNA, 25 bp, Homo sapien
aaaggaatcagcgttcatatatcca

SEQ ID NO: 646102 - DNA, 25 bp, Homo sapien
aaggaatcagcgttcatatatccaa

SEQ ID NO: 646103 - DNA, 25 bp, Homo sapien
aggaatcagcgttcatatatccaat

SEQ ID NO: 646104 - DNA, 25 bp, Homo sapien
gatttggtggtaatccaggtggctt

SEQ ID NO: 646105 - DNA, 25 bp, Homo sapien
atttggtggtaatccaggtggcttt

SEQ ID NO: 646106 - DNA, 25 bp, Homo sapien
tttggtggtaatccaggtggctttg

SEQ ID NO: 646107 - DNA, 25 bp, Homo sapien
ggtggtaatccaggtggctttggga

SEQ ID NO: 646108 - DNA, 25 bp, Homo sapien
cagggtggatttggtaatagcagag

SEQ ID NO: 646109 - DNA, 25 bp, Homo sapien
tttgggaaacaatcaaggtagtaat

SEQ ID NO: 646110 - DNA, 25 bp, Homo sapien
tgggaaacaatcaaggtagtaatat

SEQ ID NO: 646111 - DNA, 25 bp, Homo sapien
caatcaaggtagtaatatgggtggt

SEQ ID NO: 646112 - DNA, 25 bp, Homo sapien
agattctccttttaccggtgagcaa

SEQ ID NO: 646113 - DNA, 25 bp, Homo sapien
tccttttaccggtgagcaactactc

SEQ ID NO: 646114 - DNA, 25 bp, Homo sapien
gagcaactactcaaacagatggtgt

SEQ ID NO: 646115 - DNA, 25 bp, Homo sapien
atgaactggatcaacatggccatat

SEQ ID NO: 646116 - DNA, 25 bp, Homo sapien
gaactcaatgcataagtaccagcca

SEQ ID NO: 646117 - DNA, 25 bp, Homo sapien
ccagccaagggtgcacatcattaag

SEQ ID NO: 646118 - DNA, 25 bp, Homo sapien
gaagaaagaccacacagcctcattg

SEQ ID NO: 646119 - DNA, 25 bp, Homo sapien
ctcattgctcaacctgaagtctgaa

SEQ ID NO: 646120 - DNA, 25 bp, Homo sapien
agaactttcatctttccagaaacag

SEQ ID NO: 646121 - DNA, 25 bp, Homo sapien
aaacagtttttacggcagtcactgc

SEQ ID NO: 646122 - DNA, 25 bp, Homo sapien
actgcctaccagaatcaactgataa

SEQ ID NO: 646123 - DNA, 25 bp, Homo sapien
aagtacgtactcataagaagctata

SEQ ID NO: 646124 - DNA, 25 bp, Homo sapien
gaagctatatgtacaagttttctta

SEQ ID NO: 646125 - DNA, 25 bp, Homo sapien
ttaatttgcttgctacttggtcatt

SEQ ID NO: 646126 - DNA, 25 bp, Homo sapien
gcttgctacttggtcatttatttta

SEQ ID NO: 646127 - DNA, 25 bp, Homo sapien
ttggtcatttattttatctcttact

SEQ ID NO: 646128 - DNA, 25 bp, Homo sapien
atctcttactgcttgctaagggaca

SEQ ID NO: 646129 - DNA, 25 bp, Homo sapien
aagggacaagtggtagcagtctcta

SEQ ID NO: 646130 - DNA, 25 bp, Homo sapien
gtggtagcagtctctaaaggtttaa

SEQ ID NO: 646131 - DNA, 25 bp, Homo sapien
gtaaaaacaccagtatgctatggcc

SEQ ID NO: 646132 - DNA, 25 bp, Homo sapien
atgctatggcctgttagtctgacaa

SEQ ID NO: 646133 - DNA, 25 bp, Homo sapien
ggcctgttagtctgacaaacaatga

SEQ ID NO: 646134 - DNA, 25 bp, Homo sapien
ttcttatgactgtgagtcactcact

SEQ ID NO: 646135 - DNA, 25 bp, Homo sapien
gatattgtacattcttagtgccatt

SEQ ID NO: 646136 - DNA, 25 bp, Homo sapien
cttagtgccattaggtatgtatgta

SEQ ID NO: 646137 - DNA, 25 bp, Homo sapien
cttttacagtttttcagctgaaagt

SEQ ID NO: 646138 - DNA, 25 bp, Homo sapien
ttaatcagggctctttaatctcatt

SEQ ID NO: 646139 - DNA, 25 bp, Homo sapien
taatctcattttaatttcctttgtt

SEQ ID NO: 646140 - DNA, 25 bp, Homo sapien
ttcctttgtttgaatgaactgtagt

SEQ ID NO: 646141 - DNA, 25 bp, Homo sapien
aactgtagttattttctgtattcct

SEQ ID NO: 646142 - DNA, 25 bp, Homo sapien
ttctgtattcctatattaaccatct

SEQ ID NO: 646143 - DNA, 25 bp, Homo sapien
atattaaccatctaaaccaactgta

SEQ ID NO: 646144 - DNA, 25 bp, Homo sapien
ctaaaccaactgtaatgacacgtac

SEQ ID NO: 646145 - DNA, 25 bp, Homo sapien
attcttccaacatattttaaggcct

SEQ ID NO: 646146 - DNA, 25 bp, Homo sapien
ccattctcctaccttatagattcac

SEQ ID NO: 646147 - DNA, 25 bp, Homo sapien
ttatagattcacaggcctttctcgc

SEQ ID NO: 646148 - DNA, 25 bp, Homo sapien
ctttctcgcctaggcatcatagata

SEQ ID NO: 646149 - DNA, 25 bp, Homo sapien
ggcatcatagataaacgtaattgtt

SEQ ID NO: 646150 - DNA, 25 bp, Homo sapien
actttgtaacccatcttggctttag

SEQ ID NO: 646151 - DNA, 25 bp, Homo sapien
atcttggctttagtaactttatcaa

SEQ ID NO: 646152 - DNA, 25 bp, Homo sapien
gtaactttatcaaggtggtggcttt

SEQ ID NO: 646153 - DNA, 25 bp, Homo sapien
caaggtggtggctttagtgaatata

SEQ ID NO: 646154 - DNA, 25 bp, Homo sapien
tagaggacgctaaagcctcctttta

SEQ ID NO: 646155 - DNA, 25 bp, Homo sapien
acagtagctgcttgtgggaactagg

SEQ ID NO: 646156 - DNA, 25 bp, Homo sapien
ttggcaaccactcaactgtttttca

SEQ ID NO: 646157 - DNA, 25 bp, Homo sapien
ctcaactgtttttcatctccatgga

SEQ ID NO: 646158 - DNA, 25 bp, Homo sapien
tggatttacctattccggacatctc

SEQ ID NO: 646159 - DNA, 25 bp, Homo sapien
acctattccggacatctcatattaa

SEQ ID NO: 646160 - DNA, 25 bp, Homo sapien
gtaactgactcttttcactagcata

SEQ ID NO: 646161 - DNA, 25 bp, Homo sapien
actagcatagtgttttcaaggttca

SEQ ID NO: 646162 - DNA, 25 bp, Homo sapien
atccatgctgtagctggtaccagta

SEQ ID NO: 646163 - DNA, 25 bp, Homo sapien
gtaccagtacttcatccctttttag

SEQ ID NO: 646164 - DNA, 25 bp, Homo sapien
gtacttcatccctttttagtgccaa

SEQ ID NO: 646165 - DNA, 25 bp, Homo sapien
ataatagtacatgctgaggaccgtt

SEQ ID NO: 646166 - DNA, 25 bp, Homo sapien
gctgaggaccgttttatttacccat

SEQ ID NO: 646167 - DNA, 25 bp, Homo sapien
gagacgtgaagccagaaaatatcct

SEQ ID NO: 646168 - DNA, 25 bp, Homo sapien
aatatcctcatcacgaaacattccg

SEQ ID NO: 646169 - DNA, 25 bp, Homo sapien
cattccgtgattaagctttgtgact

SEQ ID NO: 646170 - DNA, 25 bp, Homo sapien
actttggatttgctcggcttttgac

SEQ ID NO: 646171 - DNA, 25 bp, Homo sapien
ggcttttgactggaccgagtgacta

SEQ ID NO: 646172 - DNA, 25 bp, Homo sapien
ggaccgagtgactactatacagact

SEQ ID NO: 646173 - DNA, 25 bp, Homo sapien
tatacagactacgtggctaccaggt

SEQ ID NO: 646174 - DNA, 25 bp, Homo sapien
tgagctgctgtcaggagtgcctctg

SEQ ID NO: 646175 - DNA, 25 bp, Homo sapien
caggagtgcctctgtggccaggaaa

SEQ ID NO: 646176 - DNA, 25 bp, Homo sapien
atcggatgtggatcagctgtatctg

SEQ ID NO: 646177 - DNA, 25 bp, Homo sapien
gctgtatctgattaggaagaccttg

SEQ ID NO: 646178 - DNA, 25 bp, Homo sapien
atggaacgtttcactgtgatcagag

SEQ ID NO: 646179 - DNA, 25 bp, Homo sapien
tggaacgtttcactgtgatcagagt

SEQ ID NO: 646180 - DNA, 25 bp, Homo sapien
ggaacgtttcactgtgatcagagtc

SEQ ID NO: 646181 - DNA, 25 bp, Homo sapien
gaacgtttcactgtgatcagagtct

SEQ ID NO: 646182 - DNA, 25 bp, Homo sapien
aacgtttcactgtgatcagagtctg

SEQ ID NO: 646183 - DNA, 25 bp, Homo sapien
acgtttcactgtgatcagagtctgc

SEQ ID NO: 646184 - DNA, 25 bp, Homo sapien
tgatcagagtctgcaaaatggctgg

SEQ ID NO: 646185 - DNA, 25 bp, Homo sapien
atcagagtctgcaaaatggctggag

SEQ ID NO: 646186 - DNA, 25 bp, Homo sapien
tcagagtctgcaaaatggctggagg

SEQ ID NO: 646187 - DNA, 25 bp, Homo sapien
aaaatggctggaggtttacgaaatg

SEQ ID NO: 646188 - DNA, 25 bp, Homo sapien
aatggctggaggtttacgaaatggt

SEQ ID NO: 646189 - DNA, 25 bp, Homo sapien
ggcatgagcaaagctctgccaagtc

SEQ ID NO: 646190 - DNA, 25 bp, Homo sapien
tgccaagtcccttctgtccatctac

SEQ ID NO: 646191 - DNA, 25 bp, Homo sapien
tacacagtcagcctccatcacgagg

SEQ ID NO: 646192 - DNA, 25 bp, Homo sapien
gtcagcctccatcacgaggatgtga

SEQ ID NO: 646193 - DNA, 25 bp, Homo sapien
gcctccatcacgaggatgtgaagag

SEQ ID NO: 646194 - DNA, 25 bp, Homo sapien
ggatgaatatggaaagctaactttc

SEQ ID NO: 646195 - DNA, 25 bp, Homo sapien
tttccattcacagtcgggctcctta

SEQ ID NO: 646196 - DNA, 25 bp, Homo sapien
tcacagtcgggctccttatcttcat

SEQ ID NO: 646197 - DNA, 25 bp, Homo sapien
agtcgggctccttatcttcatgctg

SEQ ID NO: 646198 - DNA, 25 bp, Homo sapien
gctccttatcttcatgctgctctaa

SEQ ID NO: 646199 - DNA, 25 bp, Homo sapien
ttatcttcatgctgctctaagggat

SEQ ID NO: 646200 - DNA, 25 bp, Homo sapien
ctgtgtgtctgaccctcccaccagt

SEQ ID NO: 646201 - DNA, 25 bp, Homo sapien
tcccaccagtcatgcaacctgagat

SEQ ID NO: 646202 - DNA, 25 bp, Homo sapien
ccaccagtcatgcaacctgagattt

SEQ ID NO: 646203 - DNA, 25 bp, Homo sapien
ttagccacttgtcttaatttattgc

SEQ ID NO: 646204 - DNA, 25 bp, Homo sapien
agccacttgtcttaatttattgcca

SEQ ID NO: 646205 - DNA, 25 bp, Homo sapien
gccacttgtcttaatttattgccac

SEQ ID NO: 646206 - DNA, 25 bp, Homo sapien
acttgtcttaatttattgccaccca

SEQ ID NO: 646207 - DNA, 25 bp, Homo sapien
ttgtcttaatttattgccacccagt

SEQ ID NO: 646208 - DNA, 25 bp, Homo sapien
gtcttaatttattgccacccagtcg

SEQ ID NO: 646209 - DNA, 25 bp, Homo sapien
ttaatttattgccacccagtcgcta

SEQ ID NO: 646210 - DNA, 25 bp, Homo sapien
taatttattgccacccagtcgctat

SEQ ID NO: 646211 - DNA, 25 bp, Homo sapien
agcatgctgccctcagacgtgtcca

SEQ ID NO: 646212 - DNA, 25 bp, Homo sapien
tgccctcagacgtgtccatcctgta

SEQ ID NO: 646213 - DNA, 25 bp, Homo sapien
tccatcctgtaccacatgaaaacgc

SEQ ID NO: 646214 - DNA, 25 bp, Homo sapien
gtaccacatgaaaacgctgctgctc

SEQ ID NO: 646215 - DNA, 25 bp, Homo sapien
acatgaaaacgctgctgctcctgca

SEQ ID NO: 646216 - DNA, 25 bp, Homo sapien
ctgctgctcctgcaagatactgaga

SEQ ID NO: 646217 - DNA, 25 bp, Homo sapien
gctgctcctgcaagatactgagaga

SEQ ID NO: 646218 - DNA, 25 bp, Homo sapien
ctcctgcaagatactgagagattga

SEQ ID NO: 646219 - DNA, 25 bp, Homo sapien
gagattgaagcatgctctggaaatg

SEQ ID NO: 646220 - DNA, 25 bp, Homo sapien
gttcccagaacattgcacgatgcct

SEQ ID NO: 646221 - DNA, 25 bp, Homo sapien
ccagaacattgcacgatgcctcctg

SEQ ID NO: 646222 - DNA, 25 bp, Homo sapien
agaccagaggttgatgtgatgtgca

SEQ ID NO: 646223 - DNA, 25 bp, Homo sapien
gaccagaggttgatgtgatgtgcac

SEQ ID NO: 646224 - DNA, 25 bp, Homo sapien
accagaggttgatgtgatgtgcact

SEQ ID NO: 646225 - DNA, 25 bp, Homo sapien
cagaggttgatgtgatgtgcactgc

SEQ ID NO: 646226 - DNA, 25 bp, Homo sapien
gaggttgatgtgatgtgcactgctt

SEQ ID NO: 646227 - DNA, 25 bp, Homo sapien
aggttgatgtgatgtgcactgcttt

SEQ ID NO: 646228 - DNA, 25 bp, Homo sapien
tgcttcttgcaacacaaagatgaca

SEQ ID NO: 646229 - DNA, 25 bp, Homo sapien
gcttcttgcaacacaaagatgacaa

SEQ ID NO: 646230 - DNA, 25 bp, Homo sapien
tgcaacacaaagatgacaacccaaa

SEQ ID NO: 646231 - DNA, 25 bp, Homo sapien
aacacaaagatgacaacccaaacct

SEQ ID NO: 646232 - DNA, 25 bp, Homo sapien
acacaaagatgacaacccaaacctc

SEQ ID NO: 646233 - DNA, 25 bp, Homo sapien
agccgacacccctgccgcaggtcct

SEQ ID NO: 646234 - DNA, 25 bp, Homo sapien
ccgctcagctgaagcccctccagat

SEQ ID NO: 646235 - DNA, 25 bp, Homo sapien
tccagatgccacaggcgcccctgca

SEQ ID NO: 646236 - DNA, 25 bp, Homo sapien
acaggcgcccctgcagccgcttgct

SEQ ID NO: 646237 - DNA, 25 bp, Homo sapien
gcagatgcccccgattcctgttgtg

SEQ ID NO: 646238 - DNA, 25 bp, Homo sapien
agatgcccccgattcctgttgtgcc

SEQ ID NO: 646239 - DNA, 25 bp, Homo sapien
catcacgcccctggcgggaatcgac

SEQ ID NO: 646240 - DNA, 25 bp, Homo sapien
gcccctggcgggaatcgacggcctc

SEQ ID NO: 646241 - DNA, 25 bp, Homo sapien
tggcgggaatcgacggcctccctcc

SEQ ID NO: 646242 - DNA, 25 bp, Homo sapien
ccagacctgccgaccgcgactgtgc

SEQ ID NO: 646243 - DNA, 25 bp, Homo sapien
gaccgcgactgtgcctcccgtgcca

SEQ ID NO: 646244 - DNA, 25 bp, Homo sapien
agattggcgcgggagtgtggccgcg

SEQ ID NO: 646245 - DNA, 25 bp, Homo sapien
agtgtggccgcgccccatcagatgt

SEQ ID NO: 646246 - DNA, 25 bp, Homo sapien
cttcaccagcgggagcttgatatcc

SEQ ID NO: 646247 - DNA, 25 bp, Homo sapien
accagcgggagcttgatatcccttg

SEQ ID NO: 646248 - DNA, 25 bp, Homo sapien
agcgggagcttgatatcccttgtct

SEQ ID NO: 646249 - DNA, 25 bp, Homo sapien
ggagcttgatatcccttgtctgtaa

SEQ ID NO: 646250 - DNA, 25 bp, Homo sapien
agcttgatatcccttgtctgtaaca

SEQ ID NO: 646251 - DNA, 25 bp, Homo sapien
gcttgatatcccttgtctgtaacat

SEQ ID NO: 646252 - DNA, 25 bp, Homo sapien
cttgatatcccttgtctgtaacata

SEQ ID NO: 646253 - DNA, 25 bp, Homo sapien
tgatatcccttgtctgtaacataga

SEQ ID NO: 646254 - DNA, 25 bp, Homo sapien
atcccttgtctgtaacatagacccc

SEQ ID NO: 646255 - DNA, 25 bp, Homo sapien
ggaaacacacctttatatcccagtt

SEQ ID NO: 646256 - DNA, 25 bp, Homo sapien
acacctttatatcccagttagtact

SEQ ID NO: 646257 - DNA, 25 bp, Homo sapien
taaactagggactggccaaaaacag

SEQ ID NO: 646258 - DNA, 25 bp, Homo sapien
ttcctcactttaatctcactaaagt

SEQ ID NO: 646259 - DNA, 25 bp, Homo sapien
gactcaagttattttgttcttgcaa

SEQ ID NO: 646260 - DNA, 25 bp, Homo sapien
ttttgttcttgcaatggcattgaca

SEQ ID NO: 646261 - DNA, 25 bp, Homo sapien
ggcattgacaaatgtttgcaccaaa

SEQ ID NO: 646262 - DNA, 25 bp, Homo sapien
gtgatccaagatccaaggtcaaaaa

SEQ ID NO: 646263 - DNA, 25 bp, Homo sapien
aaattcatcaattcagcacaccacc

SEQ ID NO: 646264 - DNA, 25 bp, Homo sapien
aactcacaggctaagcatcttactg

SEQ ID NO: 646265 - DNA, 25 bp, Homo sapien
ttactgctaattcattgatgctgcc

SEQ ID NO: 646266 - DNA, 25 bp, Homo sapien
tgcgcccagccccagtgataaggat

SEQ ID NO: 646267 - DNA, 25 bp, Homo sapien
gcccagccccagtgataaggatttt

SEQ ID NO: 646268 - DNA, 25 bp, Homo sapien
cccagccccagtgataaggattttt

SEQ ID NO: 646269 - DNA, 25 bp, Homo sapien
cagccccagtgataaggatttttat

SEQ ID NO: 646270 - DNA, 25 bp, Homo sapien
gccccagtgataaggatttttatgg

SEQ ID NO: 646271 - DNA, 25 bp, Homo sapien
ttttccaaaccataagtatgggttg

SEQ ID NO: 646272 - DNA, 25 bp, Homo sapien
ccataagtatgggttgtagctctat

SEQ ID NO: 646273 - DNA, 25 bp, Homo sapien
taagtatgggttgtagctctatgtt

SEQ ID NO: 646274 - DNA, 25 bp, Homo sapien
gtatgggttgtagctctatgtttct

SEQ ID NO: 646275 - DNA, 25 bp, Homo sapien
gttgtagctctatgtttctaatcat

SEQ ID NO: 646276 - DNA, 25 bp, Homo sapien
tgtagctctatgtttctaatcattt

SEQ ID NO: 646277 - DNA, 25 bp, Homo sapien
ctgggaagcccctagacgcgccgag

SEQ ID NO: 646278 - DNA, 25 bp, Homo sapien
aatgatgcatcctgttgccagcagt

SEQ ID NO: 646279 - DNA, 25 bp, Homo sapien
tgttgccagcagtaatccagctttc

SEQ ID NO: 646280 - DNA, 25 bp, Homo sapien
cagtaatccagctttctgtgggcct

SEQ ID NO: 646281 - DNA, 25 bp, Homo sapien
ttctgtgggcctggcaagccttcct

SEQ ID NO: 646282 - DNA, 25 bp, Homo sapien
ttcctgcctcaatgaagatgccatg

SEQ ID NO: 646283 - DNA, 25 bp, Homo sapien
aagatgccatgagagctgctgatca

SEQ ID NO: 646284 - DNA, 25 bp, Homo sapien
agtttgacatatattcctcccagca

SEQ ID NO: 646285 - DNA, 25 bp, Homo sapien
aaaccaatggtttgtcagaggcaag

SEQ ID NO: 646286 - DNA, 25 bp, Homo sapien
gtcagaggcaagacccattaaatga

SEQ ID NO: 646287 - DNA, 25 bp, Homo sapien
tgcagactacaagtggcagaagcat

SEQ ID NO: 646288 - DNA, 25 bp, Homo sapien
tggatgtaagtgaccttctaacctt

SEQ ID NO: 646289 - DNA, 25 bp, Homo sapien
gaccttctaaccttaaggctgcgaa

SEQ ID NO: 646290 - DNA, 25 bp, Homo sapien
tgttttcaccaaaatccaggaatag

SEQ ID NO: 646291 - DNA, 25 bp, Homo sapien
agacaaaaagactgatacctggtat

SEQ ID NO: 646292 - DNA, 25 bp, Homo sapien
ctgatacctggtatctgtacctcat

SEQ ID NO: 646293 - DNA, 25 bp, Homo sapien
tatctgtacctcattgagtgaaagg

SEQ ID NO: 646294 - DNA, 25 bp, Homo sapien
gaaaggagttaattaagttcctcag

SEQ ID NO: 646295 - DNA, 25 bp, Homo sapien
gaactccggagattcagggtgtctt

SEQ ID NO: 646296 - DNA, 25 bp, Homo sapien
gattcagggtgtcttgttagttgta

SEQ ID NO: 646297 - DNA, 25 bp, Homo sapien
gtcttgttagttgtaggatgccttc

SEQ ID NO: 646298 - DNA, 25 bp, Homo sapien
ggatgccttcagtagcttacaaaca

SEQ ID NO: 646299 - DNA, 25 bp, Homo sapien
gattccaagtctgaattacatgatg

SEQ ID NO: 646300 - DNA, 25 bp, Homo sapien
gagatggttcactagagctgcaaat

SEQ ID NO: 646301 - DNA, 25 bp, Homo sapien
taccgaagccattttactgaaaact

SEQ ID NO: 646302 - DNA, 25 bp, Homo sapien
agcactcatctaattccattggtgt

SEQ ID NO: 646303 - DNA, 25 bp, Homo sapien
aattccattggtgtagactttagca

SEQ ID NO: 646304 - DNA, 25 bp, Homo sapien
tgctatttgcaattaatgtcgtaac

SEQ ID NO: 646305 - DNA, 25 bp, Homo sapien
acattttggtttgcagtctgtactt

SEQ ID NO: 646306 - DNA, 25 bp, Homo sapien
gtttgcagtctgtacttgagtagtg

SEQ ID NO: 646307 - DNA, 25 bp, Homo sapien
cttgagtagtgtttatttagtggac

SEQ ID NO: 646308 - DNA, 25 bp, Homo sapien
ggtaaagcccttcatacatattaat

SEQ ID NO: 646309 - DNA, 25 bp, Homo sapien
attaatctcttcacagtacacattt

SEQ ID NO: 646310 - DNA, 25 bp, Homo sapien
agctcgtggcgctggagaacaagtt

SEQ ID NO: 646311 - DNA, 25 bp, Homo sapien
tcgtggcgctggagaacaagttcaa

SEQ ID NO: 646312 - DNA, 25 bp, Homo sapien
gagaacaagttcaaggccacgcgct

SEQ ID NO: 646313 - DNA, 25 bp, Homo sapien
gaacaagttcaaggccacgcgctac

SEQ ID NO: 646314 - DNA, 25 bp, Homo sapien
aagttcaaggccacgcgctacctgt

SEQ ID NO: 646315 - DNA, 25 bp, Homo sapien
aaggccacgcgctacctgtcggtgt

SEQ ID NO: 646316 - DNA, 25 bp, Homo sapien
acgcgctacctgtcggtgtgcgagc

SEQ ID NO: 646317 - DNA, 25 bp, Homo sapien
gctacctgtcggtgtgcgagcgcct

SEQ ID NO: 646318 - DNA, 25 bp, Homo sapien
acctgtcggtgtgcgagcgcctcaa

SEQ ID NO: 646319 - DNA, 25 bp, Homo sapien
gtcggtgtgcgagcgcctcaacctg

SEQ ID NO: 646320 - DNA, 25 bp, Homo sapien
tgcgagcgcctcaacctggccgtgt

SEQ ID NO: 646321 - DNA, 25 bp, Homo sapien
aggctgtgctccgtgggaaagttct

SEQ ID NO: 646322 - DNA, 25 bp, Homo sapien
gtgctccgtgggaaagttcttctca

SEQ ID NO: 646323 - DNA, 25 bp, Homo sapien
gggaaagttcttctcaccagagcac

SEQ ID NO: 646324 - DNA, 25 bp, Homo sapien
ttctcaccagagcacacatcaaatg

SEQ ID NO: 646325 - DNA, 25 bp, Homo sapien
gagcacacatcaaatgccagttcca

SEQ ID NO: 646326 - DNA, 25 bp, Homo sapien
agagagggaccctccgcccgactgt

SEQ ID NO: 646327 - DNA, 25 bp, Homo sapien
gactgtgctctcctagggcaatcag

SEQ ID NO: 646328 - DNA, 25 bp, Homo sapien
cctagggcaatcaggaggagactgc

SEQ ID NO: 646329 - DNA, 25 bp, Homo sapien
tgctgtgagtacaaggctgtcctca

SEQ ID NO: 646330 - DNA, 25 bp, Homo sapien
tgtcctcaggcagctgcctcagatt

SEQ ID NO: 646331 - DNA, 25 bp, Homo sapien
ctgcctcagatttgggctgggactg

SEQ ID NO: 646332 - DNA, 25 bp, Homo sapien
acacgtgaccacagtttagatgaac

SEQ ID NO: 646333 - DNA, 25 bp, Homo sapien
cacgtgaccacagtttagatgaaca

SEQ ID NO: 646334 - DNA, 25 bp, Homo sapien
acgtgaccacagtttagatgaacaa

SEQ ID NO: 646335 - DNA, 25 bp, Homo sapien
cgtgaccacagtttagatgaacaat

SEQ ID NO: 646336 - DNA, 25 bp, Homo sapien
gtgaccacagtttagatgaacaatg

SEQ ID NO: 646337 - DNA, 25 bp, Homo sapien
tgaccacagtttagatgaacaatgg

SEQ ID NO: 646338 - DNA, 25 bp, Homo sapien
gaccacagtttagatgaacaatgga

SEQ ID NO: 646339 - DNA, 25 bp, Homo sapien
cacagtttagatgaacaatggacca

SEQ ID NO: 646340 - DNA, 25 bp, Homo sapien
acagtttagatgaacaatggaccaa

SEQ ID NO: 646341 - DNA, 25 bp, Homo sapien
cagtttagatgaacaatggaccaag

SEQ ID NO: 646342 - DNA, 25 bp, Homo sapien
gtttagatgaacaatggaccaagtg

SEQ ID NO: 646343 - DNA, 25 bp, Homo sapien
tggaggcagagaagccactgataaa

SEQ ID NO: 646344 - DNA, 25 bp, Homo sapien
gaagccactgataaaggcgacaagt

SEQ ID NO: 646345 - DNA, 25 bp, Homo sapien
aaggcgacaagtgaggctgagctta

SEQ ID NO: 646346 - DNA, 25 bp, Homo sapien
acaagtgaggctgagcttagagcac

SEQ ID NO: 646347 - DNA, 25 bp, Homo sapien
tgaggctgagcttagagcactggct

SEQ ID NO: 646348 - DNA, 25 bp, Homo sapien
aggctgagcttagagcactggctca

SEQ ID NO: 646349 - DNA, 25 bp, Homo sapien
gagcttagagcactggctcaggcct

SEQ ID NO: 646350 - DNA, 25 bp, Homo sapien
gcttagagcactggctcaggcctgg

SEQ ID NO: 646351 - DNA, 25 bp, Homo sapien
tagagcactggctcaggcctgggcc

SEQ ID NO: 646352 - DNA, 25 bp, Homo sapien
ggaggaaacattgctggaccagctg

SEQ ID NO: 646353 - DNA, 25 bp, Homo sapien
ggaccagctgacagctgtcctaagc

SEQ ID NO: 646354 - DNA, 25 bp, Homo sapien
gactggagtccagagcatcagacct

SEQ ID NO: 646355 - DNA, 25 bp, Homo sapien
gagtccagagcatcagacctggccg

SEQ ID NO: 646356 - DNA, 25 bp, Homo sapien
ctccatccaaggcattgggaccatg

SEQ ID NO: 646357 - DNA, 25 bp, Homo sapien
ttgggaccatgggtgccggagccac

SEQ ID NO: 646358 - DNA, 25 bp, Homo sapien
agcactgattcctggaggtggtcgt

SEQ ID NO: 646359 - DNA, 25 bp, Homo sapien
attcctggaggtggtcgtttttgag

SEQ ID NO: 646360 - DNA, 25 bp, Homo sapien
ttctgtccagcacttgcatggcact

SEQ ID NO: 646361 - DNA, 25 bp, Homo sapien
tgcatggcacttccctctattttca

SEQ ID NO: 646362 - DNA, 25 bp, Homo sapien
ctattttcactcttggcgggtgccc

SEQ ID NO: 646363 - DNA, 25 bp, Homo sapien
tggcgggtgcccacacgttgcattt

SEQ ID NO: 646364 - DNA, 25 bp, Homo sapien
ggtgcccacacgttgcatttctctt

SEQ ID NO: 646365 - DNA, 25 bp, Homo sapien
gtgggtttcagcttcgcctacatgg

SEQ ID NO: 646366 - DNA, 25 bp, Homo sapien
gcttcgcctacatgggcaaagagct

SEQ ID NO: 646367 - DNA, 25 bp, Homo sapien
gagctgcccaccaactacaacgagg

SEQ ID NO: 646368 - DNA, 25 bp, Homo sapien
atcaccctcagcatgaccttctatt

SEQ ID NO: 646369 - DNA, 25 bp, Homo sapien
agcatgaccttctatttcacctcat

SEQ ID NO: 646370 - DNA, 25 bp, Homo sapien
tggacctcttggtcactgtgctcaa

SEQ ID NO: 646371 - DNA, 25 bp, Homo sapien
tacttcggccccaagtgctacatga

SEQ ID NO: 646372 - DNA, 25 bp, Homo sapien
caagtgctacatgatcctcttctac

SEQ ID NO: 646373 - DNA, 25 bp, Homo sapien
tgatcctcttctacccggagcgcaa

SEQ ID NO: 646374 - DNA, 25 bp, Homo sapien
acagcatgatccagggctacaccat

SEQ ID NO: 646375 - DNA, 25 bp, Homo sapien
agggctacaccatgaggagggacta

SEQ ID NO: 646376 - DNA, 25 bp, Homo sapien
cagaccaggcatcaactgggatgtt

SEQ ID NO: 646377 - DNA, 25 bp, Homo sapien
ggacatctcatcctttgttttctgc

SEQ ID NO: 646378 - DNA, 25 bp, Homo sapien
ttgttttctgcctatgctttcacca

SEQ ID NO: 646379 - DNA, 25 bp, Homo sapien
atacccattcccatgtctggtcatc

SEQ ID NO: 646380 - DNA, 25 bp, Homo sapien
tgtctggtcatcacagcgtccttca

SEQ ID NO: 646381 - DNA, 25 bp, Homo sapien
agcccttagctgaatcatgttgagt

SEQ ID NO: 646382 - DNA, 25 bp, Homo sapien
gtttgaatgcaaccatggtctgtcc

SEQ ID NO: 646383 - DNA, 25 bp, Homo sapien
catggtctgtccatgtggcttgttt

SEQ ID NO: 646384 - DNA, 25 bp, Homo sapien
tttttgcagcccacttagacttaag

SEQ ID NO: 646385 - DNA, 25 bp, Homo sapien
tagacttaagccctcttaatttcaa

SEQ ID NO: 646386 - DNA, 25 bp, Homo sapien
gtgccaataaagttgtccctacatg

SEQ ID NO: 646387 - DNA, 25 bp, Homo sapien
gaaactctgtagtcaaatttgttca

SEQ ID NO: 646388 - DNA, 25 bp, Homo sapien
aactctgtagtcaaatttgttcagc

SEQ ID NO: 646389 - DNA, 25 bp, Homo sapien
attaacaattgcaaaaactataggt

SEQ ID NO: 646390 - DNA, 25 bp, Homo sapien
caaccccaggaatggtagaatttgt

SEQ ID NO: 646391 - DNA, 25 bp, Homo sapien
ccccaggaatggtagaatttgtaat

SEQ ID NO: 646392 - DNA, 25 bp, Homo sapien
tttgtaattttatctgcttgtgcac

SEQ ID NO: 646393 - DNA, 25 bp, Homo sapien
ttttatctgcttgtgcacatacttg

SEQ ID NO: 646394 - DNA, 25 bp, Homo sapien
tctgcttgtgcacatacttgtaatg

SEQ ID NO: 646395 - DNA, 25 bp, Homo sapien
gcttgtgcacatacttgtaatggag

SEQ ID NO: 646396 - DNA, 25 bp, Homo sapien
gcacatacttgtaatggagtatcat

SEQ ID NO: 646397 - DNA, 25 bp, Homo sapien
cattttatcaaattaactccctcta

SEQ ID NO: 646398 - DNA, 25 bp, Homo sapien
ctcaagatcaatgggtgttacaaaa

SEQ ID NO: 646399 - DNA, 25 bp, Homo sapien
caagatcaatgggtgttacaaaaaa

SEQ ID NO: 646400 - DNA, 25 bp, Homo sapien
atgggtgttacaaaaaagagctatc

SEQ ID NO: 646401 - DNA, 25 bp, Homo sapien
gggtgttacaaaaaagagctatcgg

SEQ ID NO: 646402 - DNA, 25 bp, Homo sapien
gtgttacaaaaaagagctatcggct

SEQ ID NO: 646403 - DNA, 25 bp, Homo sapien
tgttacaaaaaagagctatcggctg

SEQ ID NO: 646404 - DNA, 25 bp, Homo sapien
gttacaaaaaagagctatcggctgg

SEQ ID NO: 646405 - DNA, 25 bp, Homo sapien
tacaaaaaagagctatcggctggga

SEQ ID NO: 646406 - DNA, 25 bp, Homo sapien
caaaaaagagctatcggctgggagt

SEQ ID NO: 646407 - DNA, 25 bp, Homo sapien
aaaaaagagctatcggctgggagtg

SEQ ID NO: 646408 - DNA, 25 bp, Homo sapien
aagagctatcggctgggagtggtgg

SEQ ID NO: 646409 - DNA, 25 bp, Homo sapien
ccggcgctgtatgagaaaggatttg

SEQ ID NO: 646410 - DNA, 25 bp, Homo sapien
cggcgctgtatgagaaaggatttgc

SEQ ID NO: 646411 - DNA, 25 bp, Homo sapien
gagaaaggatttgccagatctgctg

SEQ ID NO: 646412 - DNA, 25 bp, Homo sapien
aggatttgccagatctgctggagat

SEQ ID NO: 646413 - DNA, 25 bp, Homo sapien
gccagatctgctggagatggataaa

SEQ ID NO: 646414 - DNA, 25 bp, Homo sapien
ggagactttttattagtcctgctaa

SEQ ID NO: 646415 - DNA, 25 bp, Homo sapien
ttagtcctgctaatgaaaaaaccct

SEQ ID NO: 646416 - DNA, 25 bp, Homo sapien
gtcctgctaatgaaaaaaccctatt

SEQ ID NO: 646417 - DNA, 25 bp, Homo sapien
aaaaaccctattatctgaagatatg

SEQ ID NO: 646418 - DNA, 25 bp, Homo sapien
gatatgagaaaagaacttcagcgcc

SEQ ID NO: 646419 - DNA, 25 bp, Homo sapien
aacttcagcgccagcaatgggagga

SEQ ID NO: 646420 - DNA, 25 bp, Homo sapien
ggagtatggcagaatagctaaagac

SEQ ID NO: 646421 - DNA, 25 bp, Homo sapien
agaatagctaaagactggactcagt

SEQ ID NO: 646422 - DNA, 25 bp, Homo sapien
gactggactcagtagtgtaccatgt

SEQ ID NO: 646423 - DNA, 25 bp, Homo sapien
cagtagtgtaccatgtaatttcaaa

SEQ ID NO: 646424 - DNA, 25 bp, Homo sapien
aaatataattccatcgccttaataa

SEQ ID NO: 646425 - DNA, 25 bp, Homo sapien
ggcaggccaccataacgaggcccaa

SEQ ID NO: 646426 - DNA, 25 bp, Homo sapien
gactacctattcaaaccacccaaga

SEQ ID NO: 646427 - DNA, 25 bp, Homo sapien
ccacccaagatcaaatttaccaacg

SEQ ID NO: 646428 - DNA, 25 bp, Homo sapien
ttaccaacggaatttaccatcaacg

SEQ ID NO: 646429 - DNA, 25 bp, Homo sapien
taccatcaacgttaacggaaatacg

SEQ ID NO: 646430 - DNA, 25 bp, Homo sapien
gttaacggaaatacgcgacaggagg

SEQ ID NO: 646431 - DNA, 25 bp, Homo sapien
gctcccacctggtgctcactgccca

SEQ ID NO: 646432 - DNA, 25 bp, Homo sapien
actgcccacactgaggctctcctgc

SEQ ID NO: 646433 - DNA, 25 bp, Homo sapien
ccacactgaggctctcctgcagaag

SEQ ID NO: 646434 - DNA, 25 bp, Homo sapien
cacactgaggctctcctgcagaagg

SEQ ID NO: 646435 - DNA, 25 bp, Homo sapien
tgaggctctcctgcagaaggcacgg

SEQ ID NO: 646436 - DNA, 25 bp, Homo sapien
gaggctctcctgcagaaggcacggt

SEQ ID NO: 646437 - DNA, 25 bp, Homo sapien
aggctctcctgcagaaggcacggtg

SEQ ID NO: 646438 - DNA, 25 bp, Homo sapien
ggctctcctgcagaaggcacggtgg

SEQ ID NO: 646439 - DNA, 25 bp, Homo sapien
gctctcctgcagaaggcacggtggc

SEQ ID NO: 646440 - DNA, 25 bp, Homo sapien
ctctcctgcagaaggcacggtggct

SEQ ID NO: 646441 - DNA, 25 bp, Homo sapien
tctcctgcagaaggcacggtggctc

SEQ ID NO: 646442 - DNA, 25 bp, Homo sapien
aactttaaatttttgatcaaccatg

SEQ ID NO: 646443 - DNA, 25 bp, Homo sapien
gagcaaagattgaattatccttctg

SEQ ID NO: 646444 - DNA, 25 bp, Homo sapien
caaagattgaattatccttctgttc

SEQ ID NO: 646445 - DNA, 25 bp, Homo sapien
gattgaattatccttctgttctctc

SEQ ID NO: 646446 - DNA, 25 bp, Homo sapien
tgttctctctacagaaatgatataa

SEQ ID NO: 646447 - DNA, 25 bp, Homo sapien
attttcctgggattcatgatatttg

SEQ ID NO: 646448 - DNA, 25 bp, Homo sapien
tatttgatatattcgtaagcttttg

SEQ ID NO: 646449 - DNA, 25 bp, Homo sapien
gatatattcgtaagcttttgttaag

SEQ ID NO: 646450 - DNA, 25 bp, Homo sapien
tattcgtaagcttttgttaagtttg

SEQ ID NO: 646451 - DNA, 25 bp, Homo sapien
gttaagtttgtaatttgttgcaatt

SEQ ID NO: 646452 - DNA, 25 bp, Homo sapien
aataaatattcacttacgtgtctaa

SEQ ID NO: 646453 - DNA, 25 bp, Homo sapien
ttccaccactttctgctattcaagc

SEQ ID NO: 646454 - DNA, 25 bp, Homo sapien
cactttctgctattcaagcacctgg

SEQ ID NO: 646455 - DNA, 25 bp, Homo sapien
tttctgctattcaagcacctggcaa

SEQ ID NO: 646456 - DNA, 25 bp, Homo sapien
tgctattcaagcacctggcaaagtg

SEQ ID NO: 646457 - DNA, 25 bp, Homo sapien
gcacctggcaaagtggaaccaacca

SEQ ID NO: 646458 - DNA, 25 bp, Homo sapien
tggcaaagtggaaccaaccaaattt

SEQ ID NO: 646459 - DNA, 25 bp, Homo sapien
ataaggactctcagcttgtatcctc

SEQ ID NO: 646460 - DNA, 25 bp, Homo sapien
ggactctcagcttgtatcctctgga

SEQ ID NO: 646461 - DNA, 25 bp, Homo sapien
tcagcttgtatcctctggacacaat

SEQ ID NO: 646462 - DNA, 25 bp, Homo sapien
gcttgtatcctctggacacaataat

SEQ ID NO: 646463 - DNA, 25 bp, Homo sapien
gtatcctctggacacaataatccaa

SEQ ID NO: 646464 - DNA, 25 bp, Homo sapien
gctgtactcctgctcgcatacagag

SEQ ID NO: 646465 - DNA, 25 bp, Homo sapien
tgtactcctgctcgcatacagagca

SEQ ID NO: 646466 - DNA, 25 bp, Homo sapien
gctcgcatacagagcactgtcactt

SEQ ID NO: 646467 - DNA, 25 bp, Homo sapien
tacagagcactgtcactttccttaa

SEQ ID NO: 646468 - DNA, 25 bp, Homo sapien
agagcactgtcactttccttaaact

SEQ ID NO: 646469 - DNA, 25 bp, Homo sapien
gagcactgtcactttccttaaactc

SEQ ID NO: 646470 - DNA, 25 bp, Homo sapien
ccccaattaaaacctgcattccttg

SEQ ID NO: 646471 - DNA, 25 bp, Homo sapien
attaaaacctgcattccttgaaatt

SEQ ID NO: 646472 - DNA, 25 bp, Homo sapien
gcattccttgaaattaactcccctt

SEQ ID NO: 646473 - DNA, 25 bp, Homo sapien
ttgaaattaactccccttttgcagc

SEQ ID NO: 646474 - DNA, 25 bp, Homo sapien
tttcaccttatttgtcatgctaaga

SEQ ID NO: 646475 - DNA, 25 bp, Homo sapien
ttgctgaaaacccttgggtcaagtt

SEQ ID NO: 646476 - DNA, 25 bp, Homo sapien
tgctgaaaacccttgggtcaagttt

SEQ ID NO: 646477 - DNA, 25 bp, Homo sapien
gagtggtttgtcctgtaactgcctt

SEQ ID NO: 646478 - DNA, 25 bp, Homo sapien
agtggtttgtcctgtaactgccttt

SEQ ID NO: 646479 - DNA, 25 bp, Homo sapien
gtggtttgtcctgtaactgcctttc

SEQ ID NO: 646480 - DNA, 25 bp, Homo sapien
tggtttgtcctgtaactgcctttcc

SEQ ID NO: 646481 - DNA, 25 bp, Homo sapien
gtttgtcctgtaactgcctttccct

SEQ ID NO: 646482 - DNA, 25 bp, Homo sapien
gcctgggggtattgtgaactcaaga

SEQ ID NO: 646483 - DNA, 25 bp, Homo sapien
cctgggggtattgtgaactcaagac

SEQ ID NO: 646484 - DNA, 25 bp, Homo sapien
ttgccagggtaaggccatgaggttt

SEQ ID NO: 646485 - DNA, 25 bp, Homo sapien
ccagggtaaggccatgaggtttggg

SEQ ID NO: 646486 - DNA, 25 bp, Homo sapien
cactgagtgccaagggtcccctgag

SEQ ID NO: 646487 - DNA, 25 bp, Homo sapien
gagtgccaagggtcccctgagcatg

SEQ ID NO: 646488 - DNA, 25 bp, Homo sapien
aagggtcccctgagcatgcttttct

SEQ ID NO: 646489 - DNA, 25 bp, Homo sapien
gcatgcttttctgaagagccgggcc

SEQ ID NO: 646490 - DNA, 25 bp, Homo sapien
atgcttttctgaagagccgggcctc

SEQ ID NO: 646491 - DNA, 25 bp, Homo sapien
cttttctgaagagccgggcctcaga

SEQ ID NO: 646492 - DNA, 25 bp, Homo sapien
cctcagagtgtgtggctgtgtgtct

SEQ ID NO: 646493 - DNA, 25 bp, Homo sapien
tggctgtgtgtctgttcgactcccc

SEQ ID NO: 646494 - DNA, 25 bp, Homo sapien
tgtgtgtctgttcgactcccctcgc

SEQ ID NO: 646495 - DNA, 25 bp, Homo sapien
agcttgatatcccttgtctgtaaca

SEQ ID NO: 646496 - DNA, 25 bp, Homo sapien
gtaacatagaccccgggtactgcgg

SEQ ID NO: 646497 - DNA, 25 bp, Homo sapien
caatgtaatctgaagggtccccata

SEQ ID NO: 646498 - DNA, 25 bp, Homo sapien
aatctgaagggtccccatatgaggg

SEQ ID NO: 646499 - DNA, 25 bp, Homo sapien
gaggaggatttgactacagaacaga

SEQ ID NO: 646500 - DNA, 25 bp, Homo sapien
cagaacagaaggcaatgtgacaact

SEQ ID NO: 646501 - DNA, 25 bp, Homo sapien
atgtgacaactgaagcaaaatgcta

SEQ ID NO: 646502 - DNA, 25 bp, Homo sapien
gcaaaatgctacatgctggcttgga

SEQ ID NO: 646503 - DNA, 25 bp, Homo sapien
atgctacatgctggcttggaggatg

SEQ ID NO: 646504 - DNA, 25 bp, Homo sapien
cagtcactgggagctgaaaaaggtg

SEQ ID NO: 646505 - DNA, 25 bp, Homo sapien
tctccccgagcctgtagagcaagta

SEQ ID NO: 646506 - DNA, 25 bp, Homo sapien
gcctgtagagcaagtatggccctat

SEQ ID NO: 646507 - DNA, 25 bp, Homo sapien
tagagcaagtatggccctattgacc

SEQ ID NO: 646508 - DNA, 25 bp, Homo sapien
ccggcctggaactgcaatttctaac

SEQ ID NO: 646509 - DNA, 25 bp, Homo sapien
ggcctggaactgcaatttctaactc

SEQ ID NO: 646510 - DNA, 25 bp, Homo sapien
ggaactgcaatttctaactcataca

SEQ ID NO: 646511 - DNA, 25 bp, Homo sapien
atttctaactcatacatcattgcta

SEQ ID NO: 646512 - DNA, 25 bp, Homo sapien
atacatcattgctataaaccttatt

SEQ ID NO: 646513 - DNA, 25 bp, Homo sapien
ttactgtttctcttccaaggacggt

SEQ ID NO: 646514 - DNA, 25 bp, Homo sapien
tgtttctcttccaaggacggtcagt

SEQ ID NO: 646515 - DNA, 25 bp, Homo sapien
ttctcttccaaggacggtcagtcat

SEQ ID NO: 646516 - DNA, 25 bp, Homo sapien
ctcttccaaggacggtcagtcatcc

SEQ ID NO: 646517 - DNA, 25 bp, Homo sapien
aagatagtttttgttacatgggcaa

SEQ ID NO: 646518 - DNA, 25 bp, Homo sapien
gttacatgggcaatttacttttagt

SEQ ID NO: 646519 - DNA, 25 bp, Homo sapien
agaagtctgtagacccttccagcag

SEQ ID NO: 646520 - DNA, 25 bp, Homo sapien
aaaagctcagcttgacacggtccaa

SEQ ID NO: 646521 - DNA, 25 bp, Homo sapien
ttgacacggtccaattccaccttgt

SEQ ID NO: 646522 - DNA, 25 bp, Homo sapien
gtccaattccaccttgtgcacaaag

SEQ ID NO: 646523 - DNA, 25 bp, Homo sapien
ccttgtgcacaaagcccttatatgt

SEQ ID NO: 646524 - DNA, 25 bp, Homo sapien
gggcggctctcagtcactccaggaa

SEQ ID NO: 646525 - DNA, 25 bp, Homo sapien
ctcagtcactccaggaacctatggg

SEQ ID NO: 646526 - DNA, 25 bp, Homo sapien
gaacacaagcaagcttctgtcccag

SEQ ID NO: 646527 - DNA, 25 bp, Homo sapien
aagcttctgtcccagggatggacgc

SEQ ID NO: 646528 - DNA, 25 bp, Homo sapien
gggtctcatttatctcagggagaaa

SEQ ID NO: 646529 - DNA, 25 bp, Homo sapien
atctcagggagaaacactcctcctc

SEQ ID NO: 646530 - DNA, 25 bp, Homo sapien
gatagtttgtccttgtttctgttct

SEQ ID NO: 646531 - DNA, 25 bp, Homo sapien
gtccttgtttctgttctctggaaga

SEQ ID NO: 646532 - DNA, 25 bp, Homo sapien
tacgagagaaccgtaacaacctgtt

SEQ ID NO: 646533 - DNA, 25 bp, Homo sapien
taatttctggatagttccaccctaa

SEQ ID NO: 646534 - DNA, 25 bp, Homo sapien
ttccaccctaacttaaaatacagca

SEQ ID NO: 646535 - DNA, 25 bp, Homo sapien
acagcaaatcagttggtatcagtga

SEQ ID NO: 646536 - DNA, 25 bp, Homo sapien
gtatcagtgacagaacatcaagttt

SEQ ID NO: 646537 - DNA, 25 bp, Homo sapien
aagttcttcctttaccagcagtcct

SEQ ID NO: 646538 - DNA, 25 bp, Homo sapien
agcagtccttgttctaggtaaccta

SEQ ID NO: 646539 - DNA, 25 bp, Homo sapien
aattccagtgtttctcctttttatg

SEQ ID NO: 646540 - DNA, 25 bp, Homo sapien
tctcctttttatgtcattgtggaat

SEQ ID NO: 646541 - DNA, 25 bp, Homo sapien
gggaagattttctctggcctggcac

SEQ ID NO: 646542 - DNA, 25 bp, Homo sapien
aatcgaatcgatgcttctgtgctct

SEQ ID NO: 646543 - DNA, 25 bp, Homo sapien
tcccagatccagacgatccgaaatg

SEQ ID NO: 646544 - DNA, 25 bp, Homo sapien
gatccgaaatgctctgatccatcag

SEQ ID NO: 646545 - DNA, 25 bp, Homo sapien
tgatccatcagttaaccacgttcca

SEQ ID NO: 646546 - DNA, 25 bp, Homo sapien
aaccacgttccagtttgaagggcag

SEQ ID NO: 646547 - DNA, 25 bp, Homo sapien
agggcaggagatttccctggactcc

SEQ ID NO: 646548 - DNA, 25 bp, Homo sapien
aaggacctggcgaaagccttgggct

SEQ ID NO: 646549 - DNA, 25 bp, Homo sapien
aaagccttgggcttgctctgtgttg

SEQ ID NO: 646550 - DNA, 25 bp, Homo sapien
ctgtgttgtcaccaactgtggcgaa

SEQ ID NO: 646551 - DNA, 25 bp, Homo sapien
aactgtggcgaaggcatggattaca

SEQ ID NO: 646552 - DNA, 25 bp, Homo sapien
ggatactaatgtggacttctctgca

SEQ ID NO: 646553 - DNA, 25 bp, Homo sapien
acttctctgcattgtgtaagaacca

SEQ ID NO: 646554 - DNA, 25 bp, Homo sapien
ttctctgcattgtgtaagaaccaat

SEQ ID NO: 646555 - DNA, 25 bp, Homo sapien
ctctgcattgtgtaagaaccaattc

SEQ ID NO: 646556 - DNA, 25 bp, Homo sapien
gtgtaagaaccaattcaagaccagg

SEQ ID NO: 646557 - DNA, 25 bp, Homo sapien
gtaagaaccaattcaagaccaggca

SEQ ID NO: 646558 - DNA, 25 bp, Homo sapien
aagaaccaattcaagaccaggcacg

SEQ ID NO: 646559 - DNA, 25 bp, Homo sapien
agaaccaattcaagaccaggcacgg

SEQ ID NO: 646560 - DNA, 25 bp, Homo sapien
gaaccaattcaagaccaggcacggt

SEQ ID NO: 646561 - DNA, 25 bp, Homo sapien
aaccaattcaagaccaggcacggtg

SEQ ID NO: 646562 - DNA, 25 bp, Homo sapien
accaattcaagaccaggcacggtgg

SEQ ID NO: 646563 - DNA, 25 bp, Homo sapien
gctgcttttggcttactttgtattt

SEQ ID NO: 646564 - DNA, 25 bp, Homo sapien
agctagatgctattatagtgttgaa

SEQ ID NO: 646565 - DNA, 25 bp, Homo sapien
ggatatggattctgtctgggatgca

SEQ ID NO: 646566 - DNA, 25 bp, Homo sapien
ttctgtctgggatgcatttgttgtc

SEQ ID NO: 646567 - DNA, 25 bp, Homo sapien
gatgcatttgttgtcctttcagaac

SEQ ID NO: 646568 - DNA, 25 bp, Homo sapien
gcatttgttgtcctttcagaaccct

SEQ ID NO: 646569 - DNA, 25 bp, Homo sapien
ttgttgtcctttcagaacccttcct

SEQ ID NO: 646570 - DNA, 25 bp, Homo sapien
ttcctcccattaccctgtgaataaa

SEQ ID NO: 646571 - DNA, 25 bp, Homo sapien
caccccatatctaccatattctaga

SEQ ID NO: 646572 - DNA, 25 bp, Homo sapien
tatctaccatattctagaacactgt

SEQ ID NO: 646573 - DNA, 25 bp, Homo sapien
ctagaacactgtaatgctactaggc

SEQ ID NO: 646574 - DNA, 25 bp, Homo sapien
gcaaagctttcatactattaactgg

SEQ ID NO: 646575 - DNA, 25 bp, Homo sapien
gtatgattacttcacaagcaaaaat

SEQ ID NO: 646576 - DNA, 25 bp, Homo sapien
aaaatgggaattcaaatctctggct

SEQ ID NO: 646577 - DNA, 25 bp, Homo sapien
caaatctctggcttttttctgcatt

SEQ ID NO: 646578 - DNA, 25 bp, Homo sapien
ctctggcttttttctgcattacaaa

SEQ ID NO: 646579 - DNA, 25 bp, Homo sapien
ctgcattacaaaagagtggcttcat

SEQ ID NO: 646580 - DNA, 25 bp, Homo sapien
gtggcttcatgatttctgacccgtg

SEQ ID NO: 646581 - DNA, 25 bp, Homo sapien
tcatgatttctgacccgtgcagctc

SEQ ID NO: 646582 - DNA, 25 bp, Homo sapien
gtgcagctccagagggtcacacttg

SEQ ID NO: 646583 - DNA, 25 bp, Homo sapien
agagggtcacacttgttctgctgtc

SEQ ID NO: 646584 - DNA, 25 bp, Homo sapien
acttgttctgctgtcatcatcttga

SEQ ID NO: 646585 - DNA, 25 bp, Homo sapien
aaatattcatttggagtcaggggcg

SEQ ID NO: 646586 - DNA, 25 bp, Homo sapien
aatattcatttggagtcaggggcgg

SEQ ID NO: 646587 - DNA, 25 bp, Homo sapien
atattcatttggagtcaggggcggt

SEQ ID NO: 646588 - DNA, 25 bp, Homo sapien
tattcatttggagtcaggggcggtg

SEQ ID NO: 646589 - DNA, 25 bp, Homo sapien
attcatttggagtcaggggcggtgg

SEQ ID NO: 646590 - DNA, 25 bp, Homo sapien
ttcatttggagtcaggggcggtggc

SEQ ID NO: 646591 - DNA, 25 bp, Homo sapien
tcatttggagtcaggggcggtggct

SEQ ID NO: 646592 - DNA, 25 bp, Homo sapien
catttggagtcaggggcggtggctc

SEQ ID NO: 646593 - DNA, 25 bp, Homo sapien
tggagtcaggggcggtggctcaagc

SEQ ID NO: 646594 - DNA, 25 bp, Homo sapien
aaattagtcaggcttagtggcgggc

SEQ ID NO: 646595 - DNA, 25 bp, Homo sapien
agtgagacaagatcatgatcgcacc

SEQ ID NO: 646596 - DNA, 25 bp, Homo sapien
tttttgcctgatgcttagaataata

SEQ ID NO: 646597 - DNA, 25 bp, Homo sapien
ttagaataataaatactcccaaggc

SEQ ID NO: 646598 - DNA, 25 bp, Homo sapien
tcccaaggcttaggagtagacatgg

SEQ ID NO: 646599 - DNA, 25 bp, Homo sapien
gcctgagagaaagcctattaaatgc

SEQ ID NO: 646600 - DNA, 25 bp, Homo sapien
atcatgctactcaaactgattttct

SEQ ID NO: 646601 - DNA, 25 bp, Homo sapien
gattttcttgctaaaacagaactag

SEQ ID NO: 646602 - DNA, 25 bp, Homo sapien
ttaaacttgaagttgggctctatct

SEQ ID NO: 646603 - DNA, 25 bp, Homo sapien
agttgggctctatctggatttgctt

SEQ ID NO: 646604 - DNA, 25 bp, Homo sapien
atagatctgcttcatttcatgccag

SEQ ID NO: 646605 - DNA, 25 bp, Homo sapien
tgcttcatttcatgccagatttggg

SEQ ID NO: 646606 - DNA, 25 bp, Homo sapien
agatttgggcaaaccatgaacaacc

SEQ ID NO: 646607 - DNA, 25 bp, Homo sapien
atcactcccactaaaagttgcatag

SEQ ID NO: 646608 - DNA, 25 bp, Homo sapien
ttgcatagactccaacagttgtaaa

SEQ ID NO: 646609 - DNA, 25 bp, Homo sapien
aagggatacatcttaatgagtgaac

SEQ ID NO: 646610 - DNA, 25 bp, Homo sapien
gagtgaacagagtctcttcatggaa

SEQ ID NO: 646611 - DNA, 25 bp, Homo sapien
agaattcacgcctgaaagcctagcc

SEQ ID NO: 646612 - DNA, 25 bp, Homo sapien
gaaagcctagcccttgggagctaga

SEQ ID NO: 646613 - DNA, 25 bp, Homo sapien
cccttgggagctagaggcctgaact

SEQ ID NO: 646614 - DNA, 25 bp, Homo sapien
gaactgggcggatacgtgcccatgt

SEQ ID NO: 646615 - DNA, 25 bp, Homo sapien
gtgcccatgtgtacagtttctgtga

SEQ ID NO: 646616 - DNA, 25 bp, Homo sapien
atcttaggaaacaagctggatttaa

SEQ ID NO: 646617 - DNA, 25 bp, Homo sapien
gtgcatttactaatcactcccacta

SEQ ID NO: 646618 - DNA, 25 bp, Homo sapien
tgccttctccttcacggtgtgttct

SEQ ID NO: 646619 - DNA, 25 bp, Homo sapien
acggtgtgttctccactttgtgtct

SEQ ID NO: 646620 - DNA, 25 bp, Homo sapien
gatgaggacaccagtaattggattt

SEQ ID NO: 646621 - DNA, 25 bp, Homo sapien
aatctggtatcaccttttcttgatg

SEQ ID NO: 646622 - DNA, 25 bp, Homo sapien
tcaccttttcttgatgacatctgca

SEQ ID NO: 646623 - DNA, 25 bp, Homo sapien
ctgcaaagaccctgtgtccatgtag

SEQ ID NO: 646624 - DNA, 25 bp, Homo sapien
gtccatgtagggtcatgttcacaga

SEQ ID NO: 646625 - DNA, 25 bp, Homo sapien
ggttaggacagggatatatcttctg

SEQ ID NO: 646626 - DNA, 25 bp, Homo sapien
tcttctgggaggacacggttcaacc

SEQ ID NO: 646627 - DNA, 25 bp, Homo sapien
aggacacggttcaacccacagcaag

SEQ ID NO: 646628 - DNA, 25 bp, Homo sapien
acagcaagcctcagtttgtctcctc

SEQ ID NO: 646629 - DNA, 25 bp, Homo sapien
tctcctgcctcggactcccagctac

SEQ ID NO: 646630 - DNA, 25 bp, Homo sapien
ctcctgcctcggactcccagctact

SEQ ID NO: 646631 - DNA, 25 bp, Homo sapien
tcctgcctcggactcccagctactc

SEQ ID NO: 646632 - DNA, 25 bp, Homo sapien
cctgcctcggactcccagctactcg

SEQ ID NO: 646633 - DNA, 25 bp, Homo sapien
ctgcctcggactcccagctactcgg

SEQ ID NO: 646634 - DNA, 25 bp, Homo sapien
tgcctcggactcccagctactcggg

SEQ ID NO: 646635 - DNA, 25 bp, Homo sapien
tggacgttgcagtgagtcaagatta

SEQ ID NO: 646636 - DNA, 25 bp, Homo sapien
ggacgttgcagtgagtcaagattat

SEQ ID NO: 646637 - DNA, 25 bp, Homo sapien
gacgttgcagtgagtcaagattatg

SEQ ID NO: 646638 - DNA, 25 bp, Homo sapien
acgttgcagtgagtcaagattatgc

SEQ ID NO: 646639 - DNA, 25 bp, Homo sapien
cgttgcagtgagtcaagattatgcc

SEQ ID NO: 646640 - DNA, 25 bp, Homo sapien
ttgtcactctatagacatgagaatc

SEQ ID NO: 646641 - DNA, 25 bp, Homo sapien
tgtcactctatagacatgagaatct

SEQ ID NO: 646642 - DNA, 25 bp, Homo sapien
ggacagttagaagacgacggagttt

SEQ ID NO: 646643 - DNA, 25 bp, Homo sapien
gacagttagaagacgacggagtttc

SEQ ID NO: 646644 - DNA, 25 bp, Homo sapien
cagttagaagacgacggagtttcac

SEQ ID NO: 646645 - DNA, 25 bp, Homo sapien
gttagaagacgacggagtttcactc

SEQ ID NO: 646646 - DNA, 25 bp, Homo sapien
ggtaattcatccgattcaaaattgt

SEQ ID NO: 646647 - DNA, 25 bp, Homo sapien
gtaattcatccgattcaaaattgtt

SEQ ID NO: 646648 - DNA, 25 bp, Homo sapien
aattcatccgattcaaaattgtttt

SEQ ID NO: 646649 - DNA, 25 bp, Homo sapien
agtgtttcgtagtttttgaaatctg

SEQ ID NO: 646650 - DNA, 25 bp, Homo sapien
gtgtttcgtagtttttgaaatctga

SEQ ID NO: 646651 - DNA, 25 bp, Homo sapien
gggcagcccatttctcaaagtccag

SEQ ID NO: 646652 - DNA, 25 bp, Homo sapien
gcagcccatttctcaaagtccagaa

SEQ ID NO: 646653 - DNA, 25 bp, Homo sapien
gtccagaaaattagggtcccagaag

SEQ ID NO: 646654 - DNA, 25 bp, Homo sapien
gcagcaggctgggagttaggaggga

SEQ ID NO: 646655 - DNA, 25 bp, Homo sapien
agggagagcagggtgccggccctgc

SEQ ID NO: 646656 - DNA, 25 bp, Homo sapien
ggccctgccaccaagttgagagctg

SEQ ID NO: 646657 - DNA, 25 bp, Homo sapien
ctgccaccaagttgagagctggagg

SEQ ID NO: 646658 - DNA, 25 bp, Homo sapien
gagagaacatcacagagcagccagc

SEQ ID NO: 646659 - DNA, 25 bp, Homo sapien
agaacatcacagagcagccagccct

SEQ ID NO: 646660 - DNA, 25 bp, Homo sapien
acagagcagccagccctggttcact

SEQ ID NO: 646661 - DNA, 25 bp, Homo sapien
tctcaagctccttccctaggagcat

SEQ ID NO: 646662 - DNA, 25 bp, Homo sapien
gaggagcattgaaaatatcacctat

SEQ ID NO: 646663 - DNA, 25 bp, Homo sapien
atatcacctatatttggatttctgt

SEQ ID NO: 646664 - DNA, 25 bp, Homo sapien
tacaaacctctttatagaaaacctg

SEQ ID NO: 646665 - DNA, 25 bp, Homo sapien
ttgcttgcttttttttgcagggagg

SEQ ID NO: 646666 - DNA, 25 bp, Homo sapien
tttttgcagggagggatattccctt

SEQ ID NO: 646667 - DNA, 25 bp, Homo sapien
agggatattcccttgataccactct

SEQ ID NO: 646668 - DNA, 25 bp, Homo sapien
cttgataccactctgtctttatgac

SEQ ID NO: 646669 - DNA, 25 bp, Homo sapien
taccactctgtctttatgactcatc

SEQ ID NO: 646670 - DNA, 25 bp, Homo sapien
ctctgtctttatgactcatcggtta

SEQ ID NO: 646671 - DNA, 25 bp, Homo sapien
tatgactcatcggttatttataaat

SEQ ID NO: 646672 - DNA, 25 bp, Homo sapien
aaatgttatcatcgtttttctgatt

SEQ ID NO: 646673 - DNA, 25 bp, Homo sapien
tgaaatttaatttgcgattgtccta

SEQ ID NO: 646674 - DNA, 25 bp, Homo sapien
gcgattgtcctataatgccttttca

SEQ ID NO: 646675 - DNA, 25 bp, Homo sapien
tgccttttcattacagtaccacaca

SEQ ID NO: 646676 - DNA, 25 bp, Homo sapien
acagtaccacacaaattgaggcaat

SEQ ID NO: 646677 - DNA, 25 bp, Homo sapien
tgtacacttggcttattcagcaccc

SEQ ID NO: 646678 - DNA, 25 bp, Homo sapien
ggcttattcagcacccataaaattc

SEQ ID NO: 646679 - DNA, 25 bp, Homo sapien
aaattcaatggaccaccatccggac

SEQ ID NO: 646680 - DNA, 25 bp, Homo sapien
atggaccaccatccggacaaaagga

SEQ ID NO: 646681 - DNA, 25 bp, Homo sapien
ttcttcaaactactgaggtacaatg

SEQ ID NO: 646682 - DNA, 25 bp, Homo sapien
tagcatatgctgtacctaaaagata

SEQ ID NO: 646683 - DNA, 25 bp, Homo sapien
gatacatcaaatgggacattgggaa

SEQ ID NO: 646684 - DNA, 25 bp, Homo sapien
gttggtttgcctatgaaaggagtac

SEQ ID NO: 646685 - DNA, 25 bp, Homo sapien
tggtttgcctatgaaaggagtactc

SEQ ID NO: 646686 - DNA, 25 bp, Homo sapien
gtttgcctatgaaaggagtactcaa

SEQ ID NO: 646687 - DNA, 25 bp, Homo sapien
ttgcctatgaaaggagtactcaaag

SEQ ID NO: 646688 - DNA, 25 bp, Homo sapien
ctatgaaaggagtactcaaaggtga

SEQ ID NO: 646689 - DNA, 25 bp, Homo sapien
aaaggtgagtttactatctctaatg

SEQ ID NO: 646690 - DNA, 25 bp, Homo sapien
tctctaatgaaaaagctaatcctgg

SEQ ID NO: 646691 - DNA, 25 bp, Homo sapien
aatgaaaaagctaatcctggcaggg

SEQ ID NO: 646692 - DNA, 25 bp, Homo sapien
gaaaaagctaatcctggcaggggca

SEQ ID NO: 646693 - DNA, 25 bp, Homo sapien
aaaagacatgcttaatacagaagtt

SEQ ID NO: 646694 - DNA, 25 bp, Homo sapien
gacatgcttaatacagaagttaata

SEQ ID NO: 646695 - DNA, 25 bp, Homo sapien
taactcctcctgcagtatcaagggc

SEQ ID NO: 646696 - DNA, 25 bp, Homo sapien
agggccaagctgttgctagacaaag

SEQ ID NO: 646697 - DNA, 25 bp, Homo sapien
gagagaatcctcaccattcagacag

SEQ ID NO: 646698 - DNA, 25 bp, Homo sapien
attcagacagctcagctttgggcaa

SEQ ID NO: 646699 - DNA, 25 bp, Homo sapien
gatggccaccaacaaaaccccggag

SEQ ID NO: 646700 - DNA, 25 bp, Homo sapien
tctgaggttcagaacttccagagtt

SEQ ID NO: 646701 - DNA, 25 bp, Homo sapien
gaagatgagaggactggcttctccc

SEQ ID NO: 646702 - DNA, 25 bp, Homo sapien
ccaatacttcctttgtcattccgat

SEQ ID NO: 646703 - DNA, 25 bp, Homo sapien
gtcattccgatcctgctggacaaaa

SEQ ID NO: 646704 - DNA, 25 bp, Homo sapien
tcctgctggacaaaaactgatcttc

SEQ ID NO: 646705 - DNA, 25 bp, Homo sapien
aactgatcttcaatctttcataggt

SEQ ID NO: 646706 - DNA, 25 bp, Homo sapien
agtattctttgatgggacctctcat

SEQ ID NO: 646707 - DNA, 25 bp, Homo sapien
gtattctttgatgggacctctcatg

SEQ ID NO: 646708 - DNA, 25 bp, Homo sapien
attctttgatgggacctctcatggt

SEQ ID NO: 646709 - DNA, 25 bp, Homo sapien
tcttatggtggaagaagccgccatt

SEQ ID NO: 646710 - DNA, 25 bp, Homo sapien
ttatggtggaagaagccgccattat

SEQ ID NO: 646711 - DNA, 25 bp, Homo sapien
atggtggaagaagccgccattatta

SEQ ID NO: 646712 - DNA, 25 bp, Homo sapien
gaagaagccgccattattataacaa

SEQ ID NO: 646713 - DNA, 25 bp, Homo sapien
gaagccgccattattataacaatac

SEQ ID NO: 646714 - DNA, 25 bp, Homo sapien
gccgccattattataacaatacacg

SEQ ID NO: 646715 - DNA, 25 bp, Homo sapien
gatatagcagaagtcggagagttac

SEQ ID NO: 646716 - DNA, 25 bp, Homo sapien
cagaagtcggagagttactcaagac

SEQ ID NO: 646717 - DNA, 25 bp, Homo sapien
ccaatcacatgtaagggtaatcctg

SEQ ID NO: 646718 - DNA, 25 bp, Homo sapien
agggtaatcctgtggaaatagatac

SEQ ID NO: 646719 - DNA, 25 bp, Homo sapien
gagtgtattaaagaagccaaccttt

SEQ ID NO: 646720 - DNA, 25 bp, Homo sapien
gccaacctttttgcattgggtcctt

SEQ ID NO: 646721 - DNA, 25 bp, Homo sapien
gcattgggtcctttggttggagaca

SEQ ID NO: 646722 - DNA, 25 bp, Homo sapien
ctttggttggagacaattttgttcg

SEQ ID NO: 646723 - DNA, 25 bp, Homo sapien
ggcgctgggtgttacacgctgttta

SEQ ID NO: 646724 - DNA, 25 bp, Homo sapien
ggtgttacacgctgtttagctacaa

SEQ ID NO: 646725 - DNA, 25 bp, Homo sapien
cacgctgtttagctacaagacagaa

SEQ ID NO: 646726 - DNA, 25 bp, Homo sapien
gaggagatgggatagcttaaagcaa

SEQ ID NO: 646727 - DNA, 25 bp, Homo sapien
aaatggacagtttgccattaaagat

SEQ ID NO: 646728 - DNA, 25 bp, Homo sapien
tcttggcacccaagcgatccttttg

SEQ ID NO: 646729 - DNA, 25 bp, Homo sapien
tggaatcccaaagtgtcagatttac

SEQ ID NO: 646730 - DNA, 25 bp, Homo sapien
ggaatcccaaagtgtcagatttact

SEQ ID NO: 646731 - DNA, 25 bp, Homo sapien
aatcccaaagtgtcagatttactga

SEQ ID NO: 646732 - DNA, 25 bp, Homo sapien
tcccaaagtgtcagatttactgaag

SEQ ID NO: 646733 - DNA, 25 bp, Homo sapien
ccaaagtgtcagatttactgaagaa

SEQ ID NO: 646734 - DNA, 25 bp, Homo sapien
tatactttataggtcaagagctctg

SEQ ID NO: 646735 - DNA, 25 bp, Homo sapien
atactttataggtcaagagctctgt

SEQ ID NO: 646736 - DNA, 25 bp, Homo sapien
actttataggtcaagagctctgttt

SEQ ID NO: 646737 - DNA, 25 bp, Homo sapien
tttataggtcaagagctctgtttta

SEQ ID NO: 646738 - DNA, 25 bp, Homo sapien
tataggtcaagagctctgttttaaa

SEQ ID NO: 646739 - DNA, 25 bp, Homo sapien
cctgtaatcccagttactccagagg

SEQ ID NO: 646740 - DNA, 25 bp, Homo sapien
atcccagttactccagaggctaagg

SEQ ID NO: 646741 - DNA, 25 bp, Homo sapien
tcccagttactccagaggctaaggc

SEQ ID NO: 646742 - DNA, 25 bp, Homo sapien
cccagttactccagaggctaaggca

SEQ ID NO: 646743 - DNA, 25 bp, Homo sapien
ccagttactccagaggctaaggcag

SEQ ID NO: 646744 - DNA, 25 bp, Homo sapien
cagttactccagaggctaaggcagg

SEQ ID NO: 646745 - DNA, 25 bp, Homo sapien
agttactccagaggctaaggcagga

SEQ ID NO: 646746 - DNA, 25 bp, Homo sapien
gcatttttggaggccaaggacagtg

SEQ ID NO: 646747 - DNA, 25 bp, Homo sapien
tttttggaggccaaggacagtggat

SEQ ID NO: 646748 - DNA, 25 bp, Homo sapien
ttttggaggccaaggacagtggatc

SEQ ID NO: 646749 - DNA, 25 bp, Homo sapien
gcctgtaatcccagttactccagag

SEQ ID NO: 646750 - DNA, 25 bp, Homo sapien
atacccccttggagacgcagtatgt

SEQ ID NO: 646751 - DNA, 25 bp, Homo sapien
acgcagtatgtgaggctggagccca

SEQ ID NO: 646752 - DNA, 25 bp, Homo sapien
atgtgaggctggagcccatcatctg

SEQ ID NO: 646753 - DNA, 25 bp, Homo sapien
gggctgcacactccgctttgagctc

SEQ ID NO: 646754 - DNA, 25 bp, Homo sapien
ccgctttgagctccttggctgtgag

SEQ ID NO: 646755 - DNA, 25 bp, Homo sapien
gctgagtggatgcactgaaccccta

SEQ ID NO: 646756 - DNA, 25 bp, Homo sapien
agttcatccaggttgcagggcggtc

SEQ ID NO: 646757 - DNA, 25 bp, Homo sapien
cagggcggtcaggagataagatatt

SEQ ID NO: 646758 - DNA, 25 bp, Homo sapien
aatgtgaacaacagcggcctgaaga

SEQ ID NO: 646759 - DNA, 25 bp, Homo sapien
agcggcctgaagattaacctgtttg

SEQ ID NO: 646760 - DNA, 25 bp, Homo sapien
tgaagattaacctgtttgatacccc

SEQ ID NO: 646761 - DNA, 25 bp, Homo sapien
aaaacaaatcagccgggcggctact

SEQ ID NO: 646762 - DNA, 25 bp, Homo sapien
aaacaaatcagccgggcggctactc

SEQ ID NO: 646763 - DNA, 25 bp, Homo sapien
aacaaatcagccgggcggctactca

SEQ ID NO: 646764 - DNA, 25 bp, Homo sapien
acaaatcagccgggcggctactcag

SEQ ID NO: 646765 - DNA, 25 bp, Homo sapien
caaatcagccgggcggctactcagg

SEQ ID NO: 646766 - DNA, 25 bp, Homo sapien
aaatcagccgggcggctactcagga

SEQ ID NO: 646767 - DNA, 25 bp, Homo sapien
aatcagccgggcggctactcaggag

SEQ ID NO: 646768 - DNA, 25 bp, Homo sapien
atcagccgggcggctactcaggagg

SEQ ID NO: 646769 - DNA, 25 bp, Homo sapien
gggcgcctgtgatcacagcttctag

SEQ ID NO: 646770 - DNA, 25 bp, Homo sapien
ggcgcctgtgatcacagcttctagg

SEQ ID NO: 646771 - DNA, 25 bp, Homo sapien
gcctgtgatcacagcttctagggag

SEQ ID NO: 646772 - DNA, 25 bp, Homo sapien
tcaagatcaagactgcctacgagga

SEQ ID NO: 646773 - DNA, 25 bp, Homo sapien
actgcctacgaggagtctctggagc

SEQ ID NO: 646774 - DNA, 25 bp, Homo sapien
agtctctggagcatctagagtccgt

SEQ ID NO: 646775 - DNA, 25 bp, Homo sapien
ggagcatctagagtccgtgaagaag

SEQ ID NO: 646776 - DNA, 25 bp, Homo sapien
aggatctcattgatcagctgggtga

SEQ ID NO: 646777 - DNA, 25 bp, Homo sapien
gaaggagtgtgcatgaactgcagaa

SEQ ID NO: 646778 - DNA, 25 bp, Homo sapien
cctggaagaagctgagtcttccctg

SEQ ID NO: 646779 - DNA, 25 bp, Homo sapien
ctgagtcttccctggaggttgaaga

SEQ ID NO: 646780 - DNA, 25 bp, Homo sapien
gagagcaaggtgattcgaattcagt

SEQ ID NO: 646781 - DNA, 25 bp, Homo sapien
ttcgaattcagttggaactggctca

SEQ ID NO: 646782 - DNA, 25 bp, Homo sapien
ggctcaggttaaagctgacatcgac

SEQ ID NO: 646783 - DNA, 25 bp, Homo sapien
gtttatgttctggactggtagcttc

SEQ ID NO: 646784 - DNA, 25 bp, Homo sapien
ggactggtagcttctattctgggaa

SEQ ID NO: 646785 - DNA, 25 bp, Homo sapien
gtagcttctattctgggaacaccag

SEQ ID NO: 646786 - DNA, 25 bp, Homo sapien
ggaacaccagccgatgtcatcaaaa

SEQ ID NO: 646787 - DNA, 25 bp, Homo sapien
gcagaataatgaatcaaccacgaga

SEQ ID NO: 646788 - DNA, 25 bp, Homo sapien
ggacttttgtataaatcatcgactg

SEQ ID NO: 646789 - DNA, 25 bp, Homo sapien
gactgactgcttgattcaggctgtt

SEQ ID NO: 646790 - DNA, 25 bp, Homo sapien
gattcatgagtctatataaaggctt

SEQ ID NO: 646791 - DNA, 25 bp, Homo sapien
atcttggctgagaatgaccccttgg

SEQ ID NO: 646792 - DNA, 25 bp, Homo sapien
tgaccccttggtcaatggtgttctg

SEQ ID NO: 646793 - DNA, 25 bp, Homo sapien
caatggtgttctggcttacttatga

SEQ ID NO: 646794 - DNA, 25 bp, Homo sapien
gtgttctggataaagcaatcgtatg

SEQ ID NO: 646795 - DNA, 25 bp, Homo sapien
gttctggataaagcaatcgtatgta

SEQ ID NO: 646796 - DNA, 25 bp, Homo sapien
attataaagatctcctacgatactg

SEQ ID NO: 646797 - DNA, 25 bp, Homo sapien
taaagatctcctacgatactgtggt

SEQ ID NO: 646798 - DNA, 25 bp, Homo sapien
aagatctcctacgatactgtggtgt

SEQ ID NO: 646799 - DNA, 25 bp, Homo sapien
gatctcctacgatactgtggtgtct

SEQ ID NO: 646800 - DNA, 25 bp, Homo sapien
atctcctacgatactgtggtgtctt

SEQ ID NO: 646801 - DNA, 25 bp, Homo sapien
tctcctacgatactgtggtgtcttc

SEQ ID NO: 646802 - DNA, 25 bp, Homo sapien
tcctacgatactgtggtgtcttcta

SEQ ID NO: 646803 - DNA, 25 bp, Homo sapien
cctacgatactgtggtgtcttctag

SEQ ID NO: 646804 - DNA, 25 bp, Homo sapien
tacgatactgtggtgtcttctagat

SEQ ID NO: 646805 - DNA, 25 bp, Homo sapien
acagtgtcaggctgcagcgtcagga

SEQ ID NO: 646806 - DNA, 25 bp, Homo sapien
agcagcccagagttgatgaggcgca

SEQ ID NO: 646807 - DNA, 25 bp, Homo sapien
tgcccaggcccatgggagggttaat

SEQ ID NO: 646808 - DNA, 25 bp, Homo sapien
gagggttaattaaggccgccctgag

SEQ ID NO: 646809 - DNA, 25 bp, Homo sapien
cgccctgagctgcatacctgagtct

SEQ ID NO: 646810 - DNA, 25 bp, Homo sapien
acctgagtctcaacacttgggctga

SEQ ID NO: 646811 - DNA, 25 bp, Homo sapien
tgcagacctgagtgccgaggacatg

SEQ ID NO: 646812 - DNA, 25 bp, Homo sapien
atcttggccggcagccacggctgac

SEQ ID NO: 646813 - DNA, 25 bp, Homo sapien
gtgaaggcctgggatgccattcctc

SEQ ID NO: 646814 - DNA, 25 bp, Homo sapien
gatgccattcctccacagaagactg

SEQ ID NO: 646815 - DNA, 25 bp, Homo sapien
gaagactgcattagccagggctgga

SEQ ID NO: 646816 - DNA, 25 bp, Homo sapien
caccttggtctctggcacatagtag

SEQ ID NO: 646817 - DNA, 25 bp, Homo sapien
gcacatagtagccatctcaaatgct

SEQ ID NO: 646818 - DNA, 25 bp, Homo sapien
agtagccatctcaaatgcttgttag

SEQ ID NO: 646819 - DNA, 25 bp, Homo sapien
agccatctcaaatgcttgttaggga

SEQ ID NO: 646820 - DNA, 25 bp, Homo sapien
gcttgttagggagattcaggcatat

SEQ ID NO: 646821 - DNA, 25 bp, Homo sapien
ggagattcaggcatatacaagttaa

SEQ ID NO: 646822 - DNA, 25 bp, Homo sapien
tttggagccaagtataagaataaac

SEQ ID NO: 646823 - DNA, 25 bp, Homo sapien
ctaaaagccataagtagccgtgaat

SEQ ID NO: 646824 - DNA, 25 bp, Homo sapien
ccgtgaatggtggtaggagactatt

SEQ ID NO: 646825 - DNA, 25 bp, Homo sapien
aacttatttaagctgaactggtgat

SEQ ID NO: 646826 - DNA, 25 bp, Homo sapien
gctgaactggtgatatctattataa

SEQ ID NO: 646827 - DNA, 25 bp, Homo sapien
ataggtggacgagatcagcaacaga

SEQ ID NO: 646828 - DNA, 25 bp, Homo sapien
aaagatacttgacaccaggagacat

SEQ ID NO: 646829 - DNA, 25 bp, Homo sapien
ggagacatttatgtacatgctgatc

SEQ ID NO: 646830 - DNA, 25 bp, Homo sapien
gatcttcatggagctactagctgtg

SEQ ID NO: 646831 - DNA, 25 bp, Homo sapien
acggaccttgactgaagctggcaca

SEQ ID NO: 646832 - DNA, 25 bp, Homo sapien
aagctggcacaatggcactttgcta

SEQ ID NO: 646833 - DNA, 25 bp, Homo sapien
actttgctacagtgctgcttgggat

SEQ ID NO: 646834 - DNA, 25 bp, Homo sapien
gcttgggatgcacgagttatcacta

SEQ ID NO: 646835 - DNA, 25 bp, Homo sapien
atcactagtgcttggtgggtgtacc

SEQ ID NO: 646836 - DNA, 25 bp, Homo sapien
gtgggtgtaccatcatcaggtatct

SEQ ID NO: 646837 - DNA, 25 bp, Homo sapien
aggtatctaaaacagcaccaactgg

SEQ ID NO: 646838 - DNA, 25 bp, Homo sapien
gcagaaaaatgcacaaatgacaagt

SEQ ID NO: 646839 - DNA, 25 bp, Homo sapien
gaatacatttgtgtaaccagcagca

SEQ ID NO: 646840 - DNA, 25 bp, Homo sapien
catttgtgtaaccagcagcagatca

SEQ ID NO: 646841 - DNA, 25 bp, Homo sapien
agaacattgctagtgccccagaagc

SEQ ID NO: 646842 - DNA, 25 bp, Homo sapien
agtgccccagaagccacttgtgtgt

SEQ ID NO: 646843 - DNA, 25 bp, Homo sapien
agccacttgtgtgttccctctcagt

SEQ ID NO: 646844 - DNA, 25 bp, Homo sapien
tctcagtcactgctcttctcaagga

SEQ ID NO: 646845 - DNA, 25 bp, Homo sapien
agtcactgctcttctcaaggacaac

SEQ ID NO: 646846 - DNA, 25 bp, Homo sapien
tcaaggacaaccactcttctgactc

SEQ ID NO: 646847 - DNA, 25 bp, Homo sapien
ctcttctgactcctgataccataaa

SEQ ID NO: 646848 - DNA, 25 bp, Homo sapien
gactcctgataccataaactaattt

SEQ ID NO: 646849 - DNA, 25 bp, Homo sapien
taacctcccgagaagagtggtggct

SEQ ID NO: 646850 - DNA, 25 bp, Homo sapien
ggtgacaattccaaaatacgccttt

SEQ ID NO: 646851 - DNA, 25 bp, Homo sapien
aaatacgcctttagcagaacctggg

SEQ ID NO: 646852 - DNA, 25 bp, Homo sapien
atggctttgcatagggtagctactt

SEQ ID NO: 646853 - DNA, 25 bp, Homo sapien
taaaaataccactgccttcctaact

SEQ ID NO: 646854 - DNA, 25 bp, Homo sapien
actgccttcctaacttggaggtgaa

SEQ ID NO: 646855 - DNA, 25 bp, Homo sapien
acttggaggtgaatcctgggaattc

SEQ ID NO: 646856 - DNA, 25 bp, Homo sapien
ttgggcacagaatgcgtcattgtct

SEQ ID NO: 646857 - DNA, 25 bp, Homo sapien
tcattgtctgacaacgtcctacagc

SEQ ID NO: 646858 - DNA, 25 bp, Homo sapien
ctacagctctgttggttacccaagg

SEQ ID NO: 646859 - DNA, 25 bp, Homo sapien
ttacccaaggcagcaattgcatgaa

SEQ ID NO: 646860 - DNA, 25 bp, Homo sapien
cagctaactttaaacttgtgcaata

SEQ ID NO: 646861 - DNA, 25 bp, Homo sapien
aaagtcagcccaacataatttagtg

SEQ ID NO: 646862 - DNA, 25 bp, Homo sapien
gggaacaagagtcagagcaccttaa

SEQ ID NO: 646863 - DNA, 25 bp, Homo sapien
agagtcagagcaccttaattctgct

SEQ ID NO: 646864 - DNA, 25 bp, Homo sapien
tgctcttgcagctatcataaatacg

SEQ ID NO: 646865 - DNA, 25 bp, Homo sapien
ttgtcatttaatccctctgattctg

SEQ ID NO: 646866 - DNA, 25 bp, Homo sapien
atccctctgattctgattttcctca

SEQ ID NO: 646867 - DNA, 25 bp, Homo sapien
tcctcatctgtgaagaaggtgttgg

SEQ ID NO: 646868 - DNA, 25 bp, Homo sapien
gaggaacaatggagtatcttacggt

SEQ ID NO: 646869 - DNA, 25 bp, Homo sapien
gtatcttacggtgtatctgtggaga

SEQ ID NO: 646870 - DNA, 25 bp, Homo sapien
gtgtttgtttctacataatgtttgc

SEQ ID NO: 646871 - DNA, 25 bp, Homo sapien
gtggacagctgggaaaatcttcatt

SEQ ID NO: 646872 - DNA, 25 bp, Homo sapien
aatcttcattggtactttgcgtggg

SEQ ID NO: 646873 - DNA, 25 bp, Homo sapien
tttgcgtgggtcatcaccagtgaat

SEQ ID NO: 646874 - DNA, 25 bp, Homo sapien
gataccacctagttttacatctaac

SEQ ID NO: 646875 - DNA, 25 bp, Homo sapien
aactcatgtggatctttatgtgaca

SEQ ID NO: 646876 - DNA, 25 bp, Homo sapien
agatataccatgttttcgccattaa

SEQ ID NO: 646877 - DNA, 25 bp, Homo sapien
atcgaaaatttcacgcgttggcata

SEQ ID NO: 646878 - DNA, 25 bp, Homo sapien
gttggcatatcacgaggcactaagt

SEQ ID NO: 646879 - DNA, 25 bp, Homo sapien
ggcactaagttaccataatcaggat

SEQ ID NO: 646880 - DNA, 25 bp, Homo sapien
gaagtaccaaggcttaccatcttta

SEQ ID NO: 646881 - DNA, 25 bp, Homo sapien
ggcttaccatctttatatgtccaaa

SEQ ID NO: 646882 - DNA, 25 bp, Homo sapien
acaccacgtgctctgtgactatcta

SEQ ID NO: 646883 - DNA, 25 bp, Homo sapien
gaatttgatccttacgaaatgcagg

SEQ ID NO: 646884 - DNA, 25 bp, Homo sapien
gaaatgcaggtcgtcctgactccca

SEQ ID NO: 646885 - DNA, 25 bp, Homo sapien
ttccttgaggttacccagaactctc

SEQ ID NO: 646886 - DNA, 25 bp, Homo sapien
cagaactctcctgccagggagatga

SEQ ID NO: 646887 - DNA, 25 bp, Homo sapien
tgaggaggccatgtggactgcaaaa

SEQ ID NO: 646888 - DNA, 25 bp, Homo sapien
gatttgaaccattcccttattcagc

SEQ ID NO: 646889 - DNA, 25 bp, Homo sapien
attgttaactgaacgtcctgtaaat

SEQ ID NO: 646890 - DNA, 25 bp, Homo sapien
gaacgtcctgtaaatgcctggtgct

SEQ ID NO: 646891 - DNA, 25 bp, Homo sapien
aaatgcctggtgctgtatgaccttt

SEQ ID NO: 646892 - DNA, 25 bp, Homo sapien
ggtgctgtatgacctttggcaaatc

SEQ ID NO: 646893 - DNA, 25 bp, Homo sapien
atgtcactgatgtatgttgtattgc

SEQ ID NO: 646894 - DNA, 25 bp, Homo sapien
gtatgttgtattgctggagtagaag

SEQ ID NO: 646895 - DNA, 25 bp, Homo sapien
tgacctggtatattctactcaaatg

SEQ ID NO: 646896 - DNA, 25 bp, Homo sapien
tctactcaaatgtatcttttgacaa

SEQ ID NO: 646897 - DNA, 25 bp, Homo sapien
gtatcttttgacaattgaaatgttc

SEQ ID NO: 646898 - DNA, 25 bp, Homo sapien
gaaatgttcttaatagctaagtttt

SEQ ID NO: 646899 - DNA, 25 bp, Homo sapien
tattggtatgtatcttgtactgcaa

SEQ ID NO: 646900 - DNA, 25 bp, Homo sapien
ggtatgtatcttgtactgcaaaata

SEQ ID NO: 646901 - DNA, 25 bp, Homo sapien
cagaagtctgactgccttatttgat

SEQ ID NO: 646902 - DNA, 25 bp, Homo sapien
aagtctgactgccttatttgatgtc

SEQ ID NO: 646903 - DNA, 25 bp, Homo sapien
tctgactgccttatttgatgtcact

SEQ ID NO: 646904 - DNA, 25 bp, Homo sapien
ccatacaagataacagagggatgct

SEQ ID NO: 646905 - DNA, 25 bp, Homo sapien
gataacagagggatgctatgcgttt

SEQ ID NO: 646906 - DNA, 25 bp, Homo sapien
aacagagggatgctatgcgtttttt

SEQ ID NO: 646907 - DNA, 25 bp, Homo sapien
gagggatgctatgcgttttttgtag

SEQ ID NO: 646908 - DNA, 25 bp, Homo sapien
gatgctatgcgttttttgtagtaac

SEQ ID NO: 646909 - DNA, 25 bp, Homo sapien
gctatgcgttttttgtagtaactgt

SEQ ID NO: 646910 - DNA, 25 bp, Homo sapien
gcgttttttgtagtaactgttcagg

SEQ ID NO: 646911 - DNA, 25 bp, Homo sapien
gtagtaactgttcaggttgtgcccg

SEQ ID NO: 646912 - DNA, 25 bp, Homo sapien
agtaactgttcaggttgtgcccgta

SEQ ID NO: 646913 - DNA, 25 bp, Homo sapien
ggttgtgcccgtaagaaggtaaatg

SEQ ID NO: 646914 - DNA, 25 bp, Homo sapien
gaaggtaaatgtacgggcagatcac

SEQ ID NO: 646915 - DNA, 25 bp, Homo sapien
agctaaaggcaaggtaagtgatgag

SEQ ID NO: 646916 - DNA, 25 bp, Homo sapien
gctaaaggcaaggtaagtgatgagg

SEQ ID NO: 646917 - DNA, 25 bp, Homo sapien
ctaaaggcaaggtaagtgatgaggc

SEQ ID NO: 646918 - DNA, 25 bp, Homo sapien
taaaggcaaggtaagtgatgaggcg

SEQ ID NO: 646919 - DNA, 25 bp, Homo sapien
aaaggcaaggtaagtgatgaggcgc

SEQ ID NO: 646920 - DNA, 25 bp, Homo sapien
aaggcaaggtaagtgatgaggcgcg

SEQ ID NO: 646921 - DNA, 25 bp, Homo sapien
aggcaaggtaagtgatgaggcgcgg

SEQ ID NO: 646922 - DNA, 25 bp, Homo sapien
ggcaaggtaagtgatgaggcgcggg

SEQ ID NO: 646923 - DNA, 25 bp, Homo sapien
caaggtaagtgatgaggcgcggggc

SEQ ID NO: 646924 - DNA, 25 bp, Homo sapien
aaggtaagtgatgaggcgcggggcg

SEQ ID NO: 646925 - DNA, 25 bp, Homo sapien
aggtaagtgatgaggcgcggggcgc

SEQ ID NO: 646926 - DNA, 25 bp, Homo sapien
cagggcgacagcaccagcagccggt

SEQ ID NO: 646927 - DNA, 25 bp, Homo sapien
aggcctccatcggatcgtgggtgat

SEQ ID NO: 646928 - DNA, 25 bp, Homo sapien
tgttgcagcagctcggcctggcttt

SEQ ID NO: 646929 - DNA, 25 bp, Homo sapien
tgggtgatcagcagcacggtgtttt

SEQ ID NO: 646930 - DNA, 25 bp, Homo sapien
agcacggtgttttgcgccagcagtt

SEQ ID NO: 646931 - DNA, 25 bp, Homo sapien
agttcggcggccaggctctggatct

SEQ ID NO: 646932 - DNA, 25 bp, Homo sapien
atctcggcgcgggtaatggcgtcca

SEQ ID NO: 646933 - DNA, 25 bp, Homo sapien
tccagcgcggaaaagggttcgtcca

SEQ ID NO: 646934 - DNA, 25 bp, Homo sapien
aaagggttcgtccatcagcacgatc

SEQ ID NO: 646935 - DNA, 25 bp, Homo sapien
agcacgatcggctggtgttcgtaga

SEQ ID NO: 646936 - DNA, 25 bp, Homo sapien
tggcttttcagcaggtcggcgtcat

SEQ ID NO: 646937 - DNA, 25 bp, Homo sapien
taaatttacactcagaagccccact

SEQ ID NO: 646938 - DNA, 25 bp, Homo sapien
tttacactcagaagccccacttttt

SEQ ID NO: 646939 - DNA, 25 bp, Homo sapien
tttacattcacaaaggtatcttgct

SEQ ID NO: 646940 - DNA, 25 bp, Homo sapien
ggtatcttgctattaaaatgccact

SEQ ID NO: 646941 - DNA, 25 bp, Homo sapien
gaaaccagtaaacgtaagctgcaaa

SEQ ID NO: 646942 - DNA, 25 bp, Homo sapien
aagctgcaaatgagctgacaagcta

SEQ ID NO: 646943 - DNA, 25 bp, Homo sapien
tatcattgtaatgctctgtagtaaa

SEQ ID NO: 646944 - DNA, 25 bp, Homo sapien
gctctgtagtaaaataacctagact

SEQ ID NO: 646945 - DNA, 25 bp, Homo sapien
atcaaagttacttcaaccaatttat

SEQ ID NO: 646946 - DNA, 25 bp, Homo sapien
gtactcaactgttattcaggcccat

SEQ ID NO: 646947 - DNA, 25 bp, Homo sapien
tattcaggcccatgactccatgctt

SEQ ID NO: 646948 - DNA, 25 bp, Homo sapien
gtttgtttttgctggggaaagtgat

SEQ ID NO: 646949 - DNA, 25 bp, Homo sapien
tttgctggggaaagtgatagtctaa

SEQ ID NO: 646950 - DNA, 25 bp, Homo sapien
gtgatagtctaagagaaagaaacat

SEQ ID NO: 646951 - DNA, 25 bp, Homo sapien
gaaacatagattgtgatatttggga

SEQ ID NO: 646952 - DNA, 25 bp, Homo sapien
aaacatagattgtgatatttgggag

SEQ ID NO: 646953 - DNA, 25 bp, Homo sapien
aacatagattgtgatatttgggagg

SEQ ID NO: 646954 - DNA, 25 bp, Homo sapien
acatagattgtgatatttgggaggc

SEQ ID NO: 646955 - DNA, 25 bp, Homo sapien
catagattgtgatatttgggaggcc

SEQ ID NO: 646956 - DNA, 25 bp, Homo sapien
atagattgtgatatttgggaggccg

SEQ ID NO: 646957 - DNA, 25 bp, Homo sapien
tagattgtgatatttgggaggccga

SEQ ID NO: 646958 - DNA, 25 bp, Homo sapien
agattgtgatatttgggaggccgag

SEQ ID NO: 646959 - DNA, 25 bp, Homo sapien
gcgagatacaaataattaaagagct

SEQ ID NO: 646960 - DNA, 25 bp, Homo sapien
aagagctttaatatttaatctcaaa

SEQ ID NO: 646961 - DNA, 25 bp, Homo sapien
taatctcaaaattctttaaatcaaa

SEQ ID NO: 646962 - DNA, 25 bp, Homo sapien
gctggaactacaagcccgtgtcact

SEQ ID NO: 646963 - DNA, 25 bp, Homo sapien
ctggaactacaagcccgtgtcactg

SEQ ID NO: 646964 - DNA, 25 bp, Homo sapien
tggaactacaagcccgtgtcactgc

SEQ ID NO: 646965 - DNA, 25 bp, Homo sapien
ggaactacaagcccgtgtcactgca

SEQ ID NO: 646966 - DNA, 25 bp, Homo sapien
gaactacaagcccgtgtcactgcac

SEQ ID NO: 646967 - DNA, 25 bp, Homo sapien
aactacaagcccgtgtcactgcacc

SEQ ID NO: 646968 - DNA, 25 bp, Homo sapien
tacaagcccgtgtcactgcacccag

SEQ ID NO: 646969 - DNA, 25 bp, Homo sapien
ctgcacccagctcaaaaaaattaat

SEQ ID NO: 646970 - DNA, 25 bp, Homo sapien
cctttcaccagattgtatactcacc

SEQ ID NO: 646971 - DNA, 25 bp, Homo sapien
tgtatactcacctgtatctgacctt

SEQ ID NO: 646972 - DNA, 25 bp, Homo sapien
tactcacctgtatctgaccttattg

SEQ ID NO: 646973 - DNA, 25 bp, Homo sapien
cacctgtatctgaccttattgctac

SEQ ID NO: 646974 - DNA, 25 bp, Homo sapien
gtatctgaccttattgctactcaca

SEQ ID NO: 646975 - DNA, 25 bp, Homo sapien
gaccttattgctactcacactctag

SEQ ID NO: 646976 - DNA, 25 bp, Homo sapien
ttattgctactcacactctaggtcc

SEQ ID NO: 646977 - DNA, 25 bp, Homo sapien
tactcacactctaggtcccaggata

SEQ ID NO: 646978 - DNA, 25 bp, Homo sapien
cacactctaggtcccaggataaaat

SEQ ID NO: 646979 - DNA, 25 bp, Homo sapien
tcccaacatgatggaggagtgcccc

SEQ ID NO: 646980 - DNA, 25 bp, Homo sapien
gagtgccccctcattatgtgaagca

SEQ ID NO: 646981 - DNA, 25 bp, Homo sapien
gacagagccattcaggtagttcgaa

SEQ ID NO: 646982 - DNA, 25 bp, Homo sapien
ggtagttcgaagtgctttagctaac

SEQ ID NO: 646983 - DNA, 25 bp, Homo sapien
gtgctttagctaaccagatagattg

SEQ ID NO: 646984 - DNA, 25 bp, Homo sapien
ggctcaaggagaccctgttgcaagt

SEQ ID NO: 646985 - DNA, 25 bp, Homo sapien
aaaccatgttacaatgctgctaaga

SEQ ID NO: 646986 - DNA, 25 bp, Homo sapien
agaaatccatacttgttatcagagg

SEQ ID NO: 646987 - DNA, 25 bp, Homo sapien
tgatgttgatggtgacgtcaatgtt

SEQ ID NO: 646988 - DNA, 25 bp, Homo sapien
gaaaacagattggaagctcttcagc

SEQ ID NO: 646989 - DNA, 25 bp, Homo sapien
gaagctcttcagcaggctcaggaaa

SEQ ID NO: 646990 - DNA, 25 bp, Homo sapien
aaggagagctcatagaaatgaacct

SEQ ID NO: 646991 - DNA, 25 bp, Homo sapien
gaacctacaaatagttgacagagcc

SEQ ID NO: 646992 - DNA, 25 bp, Homo sapien
agacagttgtcgctcaaggtgcaaa

SEQ ID NO: 646993 - DNA, 25 bp, Homo sapien
caaggtgcaaactccgggctggcgc

SEQ ID NO: 646994 - DNA, 25 bp, Homo sapien
gtcccaccttacctggaagaaccat

SEQ ID NO: 646995 - DNA, 25 bp, Homo sapien
tggcgctgtgtgtgaacagataaca

SEQ ID NO: 646996 - DNA, 25 bp, Homo sapien
aacaaaatgtatgtggctgagtcca

SEQ ID NO: 646997 - DNA, 25 bp, Homo sapien
ggctgagtccactaggaagacgctt

SEQ ID NO: 646998 - DNA, 25 bp, Homo sapien
gaagacgcttctgtaccacatggag

SEQ ID NO: 646999 - DNA, 25 bp, Homo sapien
ctgtaccacatggagttctctgaat

SEQ ID NO: 647000 - DNA, 25 bp, Homo sapien
aagatcaaatagaaggtccttgtgc

SEQ ID NO: 647001 - DNA, 25 bp, Homo sapien
tccttgtgcatgaagctcagcggaa

SEQ ID NO: 647002 - DNA, 25 bp, Homo sapien
gctcagcggaaaaaagctcggatgt

SEQ ID NO: 647003 - DNA, 25 bp, Homo sapien
aactttattcatgattctttagata

SEQ ID NO: 647004 - DNA, 25 bp, Homo sapien
ttagcatgtgccaggaatcatacca

SEQ ID NO: 647005 - DNA, 25 bp, Homo sapien
tagcatgtgccaggaatcataccaa

SEQ ID NO: 647006 - DNA, 25 bp, Homo sapien
gcatgtgccaggaatcataccaaat

SEQ ID NO: 647007 - DNA, 25 bp, Homo sapien
gtgccaggaatcataccaaatactt

SEQ ID NO: 647008 - DNA, 25 bp, Homo sapien
gccaggaatcataccaaatacttca

SEQ ID NO: 647009 - DNA, 25 bp, Homo sapien
ggaatcataccaaatacttcatatg

SEQ ID NO: 647010 - DNA, 25 bp, Homo sapien
cacagagtaagctctcagtaaagta

SEQ ID NO: 647011 - DNA, 25 bp, Homo sapien
gagtaagctctcagtaaagtattag

SEQ ID NO: 647012 - DNA, 25 bp, Homo sapien
gtattagttgctttattgttattaa

SEQ ID NO: 647013 - DNA, 25 bp, Homo sapien
attgttattaaaaacgtgtctggct

SEQ ID NO: 647014 - DNA, 25 bp, Homo sapien
aaattttattcatatcactgactag

SEQ ID NO: 647015 - DNA, 25 bp, Homo sapien
attttattcatatcactgactagaa

SEQ ID NO: 647016 - DNA, 25 bp, Homo sapien
tatcactgactagaatatatcctca

SEQ ID NO: 647017 - DNA, 25 bp, Homo sapien
atcactgactagaatatatcctcat

SEQ ID NO: 647018 - DNA, 25 bp, Homo sapien
tcactgactagaatatatcctcatt

SEQ ID NO: 647019 - DNA, 25 bp, Homo sapien
cactgactagaatatatcctcattc

SEQ ID NO: 647020 - DNA, 25 bp, Homo sapien
gactagaatatatcctcattctggg

SEQ ID NO: 647021 - DNA, 25 bp, Homo sapien
actagaatatatcctcattctggga

SEQ ID NO: 647022 - DNA, 25 bp, Homo sapien
ctagaatatatcctcattctgggaa

SEQ ID NO: 647023 - DNA, 25 bp, Homo sapien
cctcattctgggaaaggagagtctt

SEQ ID NO: 647024 - DNA, 25 bp, Homo sapien
ctcattctgggaaaggagagtcttt

SEQ ID NO: 647025 - DNA, 25 bp, Homo sapien
atatctgagcaggacagcttgagca

SEQ ID NO: 647026 - DNA, 25 bp, Homo sapien
agcagggcagcaaggtcacagaaga

SEQ ID NO: 647027 - DNA, 25 bp, Homo sapien
gatggtgttcgcagcacagaaagac

SEQ ID NO: 647028 - DNA, 25 bp, Homo sapien
ggagctggcacaagacagaatccaa

SEQ ID NO: 647029 - DNA, 25 bp, Homo sapien
gaatccaagatacagccactaagaa

SEQ ID NO: 647030 - DNA, 25 bp, Homo sapien
taagaagacacagagctcttccctc

SEQ ID NO: 647031 - DNA, 25 bp, Homo sapien
gctcttccctcatgatgacagtgta

SEQ ID NO: 647032 - DNA, 25 bp, Homo sapien
ggaccctcaggatggtggccccaat

SEQ ID NO: 647033 - DNA, 25 bp, Homo sapien
gatggtggccccaatgtagccatat

SEQ ID NO: 647034 - DNA, 25 bp, Homo sapien
gtagccatatgataccaggatacac

SEQ ID NO: 647035 - DNA, 25 bp, Homo sapien
gaatggcagggtaatgaccaccacc

SEQ ID NO: 647036 - DNA, 25 bp, Homo sapien
agtggggtctgaatctcccctggcc

SEQ ID NO: 647037 - DNA, 25 bp, Homo sapien
catcggcggcaccagagccggagaa

SEQ ID NO: 647038 - DNA, 25 bp, Homo sapien
ttgtgagcgttcaggaacggatcag

SEQ ID NO: 647039 - DNA, 25 bp, Homo sapien
ttcaggaacggatcagaggctggac

SEQ ID NO: 647040 - DNA, 25 bp, Homo sapien
ctggactgccgagagctcagaggct

SEQ ID NO: 647041 - DNA, 25 bp, Homo sapien
ggactgccgagagctcagaggctaa

SEQ ID NO: 647042 - DNA, 25 bp, Homo sapien
actgccgagagctcagaggctaagc

SEQ ID NO: 647043 - DNA, 25 bp, Homo sapien
ccgagagctcagaggctaagcccga

SEQ ID NO: 647044 - DNA, 25 bp, Homo sapien
agctcagaggctaagcccgaggtca

SEQ ID NO: 647045 - DNA, 25 bp, Homo sapien
ctcagaggctaagcccgaggtcagg

SEQ ID NO: 647046 - DNA, 25 bp, Homo sapien
ccgaggtcaggaggaggacgttcca

SEQ ID NO: 647047 - DNA, 25 bp, Homo sapien
caaagagaacctggatgccgatgag

SEQ ID NO: 647048 - DNA, 25 bp, Homo sapien
taacgacctcgtccttagttgtcct

SEQ ID NO: 647049 - DNA, 25 bp, Homo sapien
gacaggcggattgcgctctctcgag

SEQ ID NO: 647050 - DNA, 25 bp, Homo sapien
gagccaactcatcctctttcagttc

SEQ ID NO: 647051 - DNA, 25 bp, Homo sapien
aaagctgctctttcgaatcgtcact

SEQ ID NO: 647052 - DNA, 25 bp, Homo sapien
ctttcgaatcgtcactcagctctca

SEQ ID NO: 647053 - DNA, 25 bp, Homo sapien
aaatgcaggtgtctccgtcttggaa

SEQ ID NO: 647054 - DNA, 25 bp, Homo sapien
ctccgtcttggaagtgcccagagaa

SEQ ID NO: 647055 - DNA, 25 bp, Homo sapien
tgcccagagaaaaccagcctattca

SEQ ID NO: 647056 - DNA, 25 bp, Homo sapien
aaaccagcctattcacagggagaaa

SEQ ID NO: 647057 - DNA, 25 bp, Homo sapien
gtgaagcgctacatcatagaacaca

SEQ ID NO: 647058 - DNA, 25 bp, Homo sapien
taatattgccattagcatgtgtaaa

SEQ ID NO: 647059 - DNA, 25 bp, Homo sapien
gtataaccatattgactgacacaaa

SEQ ID NO: 647060 - DNA, 25 bp, Homo sapien
gttgtatttaggcagtccagtcgag

SEQ ID NO: 647061 - DNA, 25 bp, Homo sapien
ggcagtccagtcgaggtaatgaaat

SEQ ID NO: 647062 - DNA, 25 bp, Homo sapien
aatctacctgaagtaatggcggaac

SEQ ID NO: 647063 - DNA, 25 bp, Homo sapien
tggcggaacaaatctcatacacgaa

SEQ ID NO: 647064 - DNA, 25 bp, Homo sapien
tcatacacgaaagggccggagtcaa

SEQ ID NO: 647065 - DNA, 25 bp, Homo sapien
gtgaaactttaactaatctccagat

SEQ ID NO: 647066 - DNA, 25 bp, Homo sapien
ctaatctccagataatccccattat

SEQ ID NO: 647067 - DNA, 25 bp, Homo sapien
atccccattatatacagctttcacc

SEQ ID NO: 647068 - DNA, 25 bp, Homo sapien
attatatacagctttcacccctctc

SEQ ID NO: 647069 - DNA, 25 bp, Homo sapien
tcgaagcctgaccactttcaccttg

SEQ ID NO: 647070 - DNA, 25 bp, Homo sapien
tttggcctttgagttgctattctat

SEQ ID NO: 647071 - DNA, 25 bp, Homo sapien
gcctttgagttgctattctatgctg

SEQ ID NO: 647072 - DNA, 25 bp, Homo sapien
tgctattctatgctgaagagcctgc

SEQ ID NO: 647073 - DNA, 25 bp, Homo sapien
gagtaccaggagggagccagcattt

SEQ ID NO: 647074 - DNA, 25 bp, Homo sapien
ggagccagcatttcagatctgaagt

SEQ ID NO: 647075 - DNA, 25 bp, Homo sapien
tcagatctgaagtagacgataggaa

SEQ ID NO: 647076 - DNA, 25 bp, Homo sapien
gtggaagaacacatacatagtgctt

SEQ ID NO: 647077 - DNA, 25 bp, Homo sapien
tacatttaacctgttatgtcagtat

SEQ ID NO: 647078 - DNA, 25 bp, Homo sapien
gataattcacttttctgtcattgtt

SEQ ID NO: 647079 - DNA, 25 bp, Homo sapien
gtcattgttaaagcgtacatactgt

SEQ ID NO: 647080 - DNA, 25 bp, Homo sapien
ggaaggtatgagacccacaagcaca

SEQ ID NO: 647081 - DNA, 25 bp, Homo sapien
gaaggtatgagacccacaagcacaa

SEQ ID NO: 647082 - DNA, 25 bp, Homo sapien
gaaacttcagcagaatagatatctg

SEQ ID NO: 647083 - DNA, 25 bp, Homo sapien
gaatagatatctgcatgctttatga

SEQ ID NO: 647084 - DNA, 25 bp, Homo sapien
gttgttgcttcggtaagagcccatg

SEQ ID NO: 647085 - DNA, 25 bp, Homo sapien
ttgcttcggtaagagcccatgggat

SEQ ID NO: 647086 - DNA, 25 bp, Homo sapien
agagcccatgggatgccagaaatta

SEQ ID NO: 647087 - DNA, 25 bp, Homo sapien
agcccatgggatgccagaaattaac

SEQ ID NO: 647088 - DNA, 25 bp, Homo sapien
atgggatgccagaaattaacatttc

SEQ ID NO: 647089 - DNA, 25 bp, Homo sapien
gcttattttagaagtatgacctttt

SEQ ID NO: 647090 - DNA, 25 bp, Homo sapien
aagtatgaccttttggtctgtttga

SEQ ID NO: 647091 - DNA, 25 bp, Homo sapien
tttggaaggtagtgaactccccatc

SEQ ID NO: 647092 - DNA, 25 bp, Homo sapien
aggtagtgaactccccatcactgga

SEQ ID NO: 647093 - DNA, 25 bp, Homo sapien
tccccatcactggaggcatttagca

SEQ ID NO: 647094 - DNA, 25 bp, Homo sapien
ttagcagaggttgagctgccactca

SEQ ID NO: 647095 - DNA, 25 bp, Homo sapien
ggttgagctgccactcaccaaagag

SEQ ID NO: 647096 - DNA, 25 bp, Homo sapien
gagctgccactcaccaaagaggcct

SEQ ID NO: 647097 - DNA, 25 bp, Homo sapien
aagaggcctcttcatgtagggcttg

SEQ ID NO: 647098 - DNA, 25 bp, Homo sapien
cctcttcatgtagggcttgctgcag

SEQ ID NO: 647099 - DNA, 25 bp, Homo sapien
ggagagccccgcctgtttgcaaggg

SEQ ID NO: 647100 - DNA, 25 bp, Homo sapien
tcccttttgggcaaacacgaggtct

SEQ ID NO: 647101 - DNA, 25 bp, Homo sapien
ccttttgggcaaacacgaggtctct

SEQ ID NO: 647102 - DNA, 25 bp, Homo sapien
acactctgctgcctagagcatggag

SEQ ID NO: 647103 - DNA, 25 bp, Homo sapien
actctgctgcctagagcatggaggt

SEQ ID NO: 647104 - DNA, 25 bp, Homo sapien
gggtctgtgccttgagcctcacgga

SEQ ID NO: 647105 - DNA, 25 bp, Homo sapien
tctgtgccttgagcctcacggagag

SEQ ID NO: 647106 - DNA, 25 bp, Homo sapien
agtaggtgtcagtaaatctctcttg

SEQ ID NO: 647107 - DNA, 25 bp, Homo sapien
aggtgtcagtaaatctctcttgact

SEQ ID NO: 647108 - DNA, 25 bp, Homo sapien
tctctcttgacttaagtagatgctg

SEQ ID NO: 647109 - DNA, 25 bp, Homo sapien
agtagatgctgttaggtccacctta

SEQ ID NO: 647110 - DNA, 25 bp, Homo sapien
gatgctgttaggtccaccttacaga

SEQ ID NO: 647111 - DNA, 25 bp, Homo sapien
gctgttaggtccaccttacagataa

SEQ ID NO: 647112 - DNA, 25 bp, Homo sapien
tgttaggtccaccttacagataaag

SEQ ID NO: 647113 - DNA, 25 bp, Homo sapien
caaaagagtacctatggcatggcat

SEQ ID NO: 647114 - DNA, 25 bp, Homo sapien
gagtacctatggcatggcatgcatc

SEQ ID NO: 647115 - DNA, 25 bp, Homo sapien
tggcatgcatctgtatacgcgaaat

SEQ ID NO: 647116 - DNA, 25 bp, Homo sapien
atgcatctgtatacgcgaaattcca

SEQ ID NO: 647117 - DNA, 25 bp, Homo sapien
gtatacgcgaaattccagaataagc

SEQ ID NO: 647118 - DNA, 25 bp, Homo sapien
ataagcaagctaacctatgataaga

SEQ ID NO: 647119 - DNA, 25 bp, Homo sapien
gcaagctaacctatgataagaaaga

SEQ ID NO: 647120 - DNA, 25 bp, Homo sapien
taatagtgtagatcttggctgggca

SEQ ID NO: 647121 - DNA, 25 bp, Homo sapien
cccaacgctttgggattacacgcat

SEQ ID NO: 647122 - DNA, 25 bp, Homo sapien
atttgtgttgaactgcattcaaaac

SEQ ID NO: 647123 - DNA, 25 bp, Homo sapien
aactgcattcaaaactgtcctgggc

SEQ ID NO: 647124 - DNA, 25 bp, Homo sapien
gcacagatggagtacagggacttca

SEQ ID NO: 647125 - DNA, 25 bp, Homo sapien
gggacttcagacattaaccatgaca

SEQ ID NO: 647126 - DNA, 25 bp, Homo sapien
gacaaattcaggcagtactcagcaa

SEQ ID NO: 647127 - DNA, 25 bp, Homo sapien
ttcaggcagtactcagcaaggtaca

SEQ ID NO: 647128 - DNA, 25 bp, Homo sapien
gcaaggtacaactattcttcagtat

SEQ ID NO: 647129 - DNA, 25 bp, Homo sapien
ctattcttcagtatgcacagacctc

SEQ ID NO: 647130 - DNA, 25 bp, Homo sapien
ggacagcagatacttgtgcccagca

SEQ ID NO: 647131 - DNA, 25 bp, Homo sapien
tgtgcccagcaatcaggtggtcgta

SEQ ID NO: 647132 - DNA, 25 bp, Homo sapien
ggtggtcgtacaaactgcatcagga

SEQ ID NO: 647133 - DNA, 25 bp, Homo sapien
atatcagatccgaactacaccttca

SEQ ID NO: 647134 - DNA, 25 bp, Homo sapien
agatccgaactacaccttcagctac

SEQ ID NO: 647135 - DNA, 25 bp, Homo sapien
gagagcaggtttgaacgtcttcggc

SEQ ID NO: 647136 - DNA, 25 bp, Homo sapien
gtttgaacgtcttcggctcctagaa

SEQ ID NO: 647137 - DNA, 25 bp, Homo sapien
tcttcggctcctagaactgcacaag

SEQ ID NO: 647138 - DNA, 25 bp, Homo sapien
ctagaactgcacaagctgtgtcttc

SEQ ID NO: 647139 - DNA, 25 bp, Homo sapien
agaggcggctgcaacgtctccccag

SEQ ID NO: 647140 - DNA, 25 bp, Homo sapien
ccagttctcctctcagaacaatgga

SEQ ID NO: 647141 - DNA, 25 bp, Homo sapien
agaggcgtaataggaaggtttgcat

SEQ ID NO: 647142 - DNA, 25 bp, Homo sapien
aaaatatgttttctttgacctctgt

SEQ ID NO: 647143 - DNA, 25 bp, Homo sapien
ttgacctctgtacttctagctttta

SEQ ID NO: 647144 - DNA, 25 bp, Homo sapien
tagcttttaccagtcagtgttttct

SEQ ID NO: 647145 - DNA, 25 bp, Homo sapien
cagtgttttcttgtaccaaggctaa

SEQ ID NO: 647146 - DNA, 25 bp, Homo sapien
taaaaggaggctttagcgtcctcta

SEQ ID NO: 647147 - DNA, 25 bp, Homo sapien
tttagcgtcctctaaagtttaccat

SEQ ID NO: 647148 - DNA, 25 bp, Homo sapien
tatattcactaaagccaccaccttg

SEQ ID NO: 647149 - DNA, 25 bp, Homo sapien
aagccaccaccttgataaagttact

SEQ ID NO: 647150 - DNA, 25 bp, Homo sapien
aagccaagatgggttacaaagttag

SEQ ID NO: 647151 - DNA, 25 bp, Homo sapien
ttcattaaattcaactccccaaaca

SEQ ID NO: 647152 - DNA, 25 bp, Homo sapien
aacaattacgtttatctatgatgcc

SEQ ID NO: 647153 - DNA, 25 bp, Homo sapien
gtttatctatgatgcctaggcgaga

SEQ ID NO: 647154 - DNA, 25 bp, Homo sapien
ggcgagaaaggcctgtgaatctata

SEQ ID NO: 647155 - DNA, 25 bp, Homo sapien
gaatttttcctagttcccacaagca

SEQ ID NO: 647156 - DNA, 25 bp, Homo sapien
cctagttcccacaagcagctactgt

SEQ ID NO: 647157 - DNA, 25 bp, Homo sapien
gggtccgaagccactctgcggccat

SEQ ID NO: 647158 - DNA, 25 bp, Homo sapien
actctgcggccattgcctttgtcat

SEQ ID NO: 647159 - DNA, 25 bp, Homo sapien
cctttgtcatcctgcagggtggaga

SEQ ID NO: 647160 - DNA, 25 bp, Homo sapien
agggtggagacagctttgcctccct

SEQ ID NO: 647161 - DNA, 25 bp, Homo sapien
ttgcctcccttttgcgtttgggatt

SEQ ID NO: 647162 - DNA, 25 bp, Homo sapien
aataactgtagccagtgcttcctgt

SEQ ID NO: 647163 - DNA, 25 bp, Homo sapien
tagccagtgcttcctgtttatgagt

SEQ ID NO: 647164 - DNA, 25 bp, Homo sapien
gtgcttcctgtttatgagtactgtt

SEQ ID NO: 647165 - DNA, 25 bp, Homo sapien
atgagtactgttcatccaaataatc

SEQ ID NO: 647166 - DNA, 25 bp, Homo sapien
ggagcaacacaaacacccagcaatt

SEQ ID NO: 647167 - DNA, 25 bp, Homo sapien
aacagaagaaaagcaccgagagcag

SEQ ID NO: 647168 - DNA, 25 bp, Homo sapien
ctgttgcagaactaaaaggctctgt

SEQ ID NO: 647169 - DNA, 25 bp, Homo sapien
aaggctctgtggcttacatttcaac

SEQ ID NO: 647170 - DNA, 25 bp, Homo sapien
ctgtggcttacatttcaactcaatt

SEQ ID NO: 647171 - DNA, 25 bp, Homo sapien
actcaatttcacatttgtatgaagt

SEQ ID NO: 647172 - DNA, 25 bp, Homo sapien
aagtttatcctgtttctaagactga

SEQ ID NO: 647173 - DNA, 25 bp, Homo sapien
gactgataaattcatcttctctggg

SEQ ID NO: 647174 - DNA, 25 bp, Homo sapien
ctggtagggaggtgcctcagtctcc

SEQ ID NO: 647175 - DNA, 25 bp, Homo sapien
cccaacccacgctcatgaaagaatt

SEQ ID NO: 647176 - DNA, 25 bp, Homo sapien
gtgaggagtaacaatctgccttgaa

SEQ ID NO: 647177 - DNA, 25 bp, Homo sapien
atctgccttgaagttagcgtcacta

SEQ ID NO: 647178 - DNA, 25 bp, Homo sapien
ttagcgtcactaaggagggttggct

SEQ ID NO: 647179 - DNA, 25 bp, Homo sapien
gtatttgggattttaaatgcctttg

SEQ ID NO: 647180 - DNA, 25 bp, Homo sapien
ttaaaatgtagaattgcaggaccca

SEQ ID NO: 647181 - DNA, 25 bp, Homo sapien
gtagaattgcaggacccaaaaactt

SEQ ID NO: 647182 - DNA, 25 bp, Homo sapien
tgttttttgggcttgctattaatgc

SEQ ID NO: 647183 - DNA, 25 bp, Homo sapien
tttttgggcttgctattaatgcaaa

SEQ ID NO: 647184 - DNA, 25 bp, Homo sapien
caaactctgattgcaaatggatgtc

SEQ ID NO: 647185 - DNA, 25 bp, Homo sapien
ctctgattgcaaatggatgtcatgt

SEQ ID NO: 647186 - DNA, 25 bp, Homo sapien
caaatggatgtcatgtttcatacct

SEQ ID NO: 647187 - DNA, 25 bp, Homo sapien
tggatgtcatgtttcataccttttt

SEQ ID NO: 647188 - DNA, 25 bp, Homo sapien
gatgtcatgtttcatacctttttta

SEQ ID NO: 647189 - DNA, 25 bp, Homo sapien
tgtttcataccttttttatcaggaa

SEQ ID NO: 647190 - DNA, 25 bp, Homo sapien
tgtccttggcgcctccatgttgcgg

SEQ ID NO: 647191 - DNA, 25 bp, Homo sapien
ttggcgcctccatgttgcggctgct

SEQ ID NO: 647192 - DNA, 25 bp, Homo sapien
catgttgcggctgctccatgtcggg

SEQ ID NO: 647193 - DNA, 25 bp, Homo sapien
gctgctggaactggtttagctgctg

SEQ ID NO: 647194 - DNA, 25 bp, Homo sapien
tgctggaactggtttagctgctgct

SEQ ID NO: 647195 - DNA, 25 bp, Homo sapien
ctggaactggtttagctgctgctgt

SEQ ID NO: 647196 - DNA, 25 bp, Homo sapien
gaactggtttagctgctgctgtagt

SEQ ID NO: 647197 - DNA, 25 bp, Homo sapien
actggtttagctgctgctgtagtgc

SEQ ID NO: 647198 - DNA, 25 bp, Homo sapien
tggtttagctgctgctgtagtgcgt

SEQ ID NO: 647199 - DNA, 25 bp, Homo sapien
tttagctgctgctgtagtgcgtggt

SEQ ID NO: 647200 - DNA, 25 bp, Homo sapien
ggcttgctcagcagcggcgggcccg

SEQ ID NO: 647201 - DNA, 25 bp, Homo sapien
tgtgcccagcctgatcgttgttggt

SEQ ID NO: 647202 - DNA, 25 bp, Homo sapien
gcctgatcgttgttggtcttaccca

SEQ ID NO: 647203 - DNA, 25 bp, Homo sapien
atcgttgttggtcttacccactgat

SEQ ID NO: 647204 - DNA, 25 bp, Homo sapien
gttggtcttacccactgattctttt

SEQ ID NO: 647205 - DNA, 25 bp, Homo sapien
gattcttttagatggaagcgggatc

SEQ ID NO: 647206 - DNA, 25 bp, Homo sapien
ttttagatggaagcgggatcttgct

SEQ ID NO: 647207 - DNA, 25 bp, Homo sapien
tcaagcaatccttcttccaggactt

SEQ ID NO: 647208 - DNA, 25 bp, Homo sapien
cttcttccaggacttcccaaagtgc

SEQ ID NO: 647209 - DNA, 25 bp, Homo sapien
caccgtgcccagtcagaactaacta

SEQ ID NO: 647210 - DNA, 25 bp, Homo sapien
ccgtgcccagtcagaactaactact

SEQ ID NO: 647211 - DNA, 25 bp, Homo sapien
aaatatcagggtgggtgccatggct

SEQ ID NO: 647212 - DNA, 25 bp, Homo sapien
acttctctgcattgtgtaagaacca

SEQ ID NO: 647213 - DNA, 25 bp, Homo sapien
ttctctgcattgtgtaagaaccaat

SEQ ID NO: 647214 - DNA, 25 bp, Homo sapien
ctctgcattgtgtaagaaccaattc

SEQ ID NO: 647215 - DNA, 25 bp, Homo sapien
ctgcattgtgtaagaaccaattcaa

SEQ ID NO: 647216 - DNA, 25 bp, Homo sapien
gtgtaagaaccaattcaagaccagg

SEQ ID NO: 647217 - DNA, 25 bp, Homo sapien
gtaagaaccaattcaagaccaggca

SEQ ID NO: 647218 - DNA, 25 bp, Homo sapien
aagaaccaattcaagaccaggcacg

SEQ ID NO: 647219 - DNA, 25 bp, Homo sapien
agaaccaattcaagaccaggcacgg

SEQ ID NO: 647220 - DNA, 25 bp, Homo sapien
gaaccaattcaagaccaggcacggt

SEQ ID NO: 647221 - DNA, 25 bp, Homo sapien
aaccaattcaagaccaggcacggtg

SEQ ID NO: 647222 - DNA, 25 bp, Homo sapien
accaattcaagaccaggcacggtgg

SEQ ID NO: 647223 - DNA, 25 bp, Homo sapien
gatttcatagtccaccaaacggtca

SEQ ID NO: 647224 - DNA, 25 bp, Homo sapien
aaacggtcacggttcacacttggag

SEQ ID NO: 647225 - DNA, 25 bp, Homo sapien
acacttggagacacccaatgcaggt

SEQ ID NO: 647226 - DNA, 25 bp, Homo sapien
gtattcttctccctctgtgaaccat

SEQ ID NO: 647227 - DNA, 25 bp, Homo sapien
tctgtgaaccatcttcttagaagtc

SEQ ID NO: 647228 - DNA, 25 bp, Homo sapien
gaagtcactgaaccaagagtgccag

SEQ ID NO: 647229 - DNA, 25 bp, Homo sapien
gagtgccagaaaaccatcccaagac

SEQ ID NO: 647230 - DNA, 25 bp, Homo sapien
actcacacagagttgttcttccata

SEQ ID NO: 647231 - DNA, 25 bp, Homo sapien
atgttttggccactggacatcagaa

SEQ ID NO: 647232 - DNA, 25 bp, Homo sapien
ctggacatcagaaccacattttggg

SEQ ID NO: 647233 - DNA, 25 bp, Homo sapien
gaatcttctacatgtgatgatccag

SEQ ID NO: 647234 - DNA, 25 bp, Homo sapien
caaagctcgattgaacttccgggga

SEQ ID NO: 647235 - DNA, 25 bp, Homo sapien
aaagctcgattgaacttccggggat

SEQ ID NO: 647236 - DNA, 25 bp, Homo sapien
aagctcgattgaacttccggggatg

SEQ ID NO: 647237 - DNA, 25 bp, Homo sapien
agctcgattgaacttccggggatgc

SEQ ID NO: 647238 - DNA, 25 bp, Homo sapien
gctcgattgaacttccggggatgca

SEQ ID NO: 647239 - DNA, 25 bp, Homo sapien
ctcgattgaacttccggggatgcag

SEQ ID NO: 647240 - DNA, 25 bp, Homo sapien
tcgattgaacttccggggatgcagg

SEQ ID NO: 647241 - DNA, 25 bp, Homo sapien
cgattgaacttccggggatgcaggg

SEQ ID NO: 647242 - DNA, 25 bp, Homo sapien
gattgaacttccggggatgcaggga

SEQ ID NO: 647243 - DNA, 25 bp, Homo sapien
attgaacttccggggatgcagggaa

SEQ ID NO: 647244 - DNA, 25 bp, Homo sapien
gcccagtgtcactaggcgggaacac

SEQ ID NO: 647245 - DNA, 25 bp, Homo sapien
ggagtggcgccctgcaatatttgca

SEQ ID NO: 647246 - DNA, 25 bp, Homo sapien
aatatttgcatgtcgctatgtgttc

SEQ ID NO: 647247 - DNA, 25 bp, Homo sapien
atgtcgctatgtgttctgggaaatc

SEQ ID NO: 647248 - DNA, 25 bp, Homo sapien
caccataaacgtgaaatgtctttgg

SEQ ID NO: 647249 - DNA, 25 bp, Homo sapien
gtctttggatttgggagtcttataa

SEQ ID NO: 647250 - DNA, 25 bp, Homo sapien
aagttctgtgtgagaccatcctttc

SEQ ID NO: 647251 - DNA, 25 bp, Homo sapien
gccacgagctgagtgcgtcctgtca

SEQ ID NO: 647252 - DNA, 25 bp, Homo sapien
ccgccatggaattcgaacgctgacg

SEQ ID NO: 647253 - DNA, 25 bp, Homo sapien
aattcgaacgctgacgtcatcaacc

SEQ ID NO: 647254 - DNA, 25 bp, Homo sapien
atcaacccgctccaaggaatcgcgg

SEQ ID NO: 647255 - DNA, 25 bp, Homo sapien
tttctacgtggccagcttccccgtg

SEQ ID NO: 647256 - DNA, 25 bp, Homo sapien
ggccccggagcgagaactcggcaca

SEQ ID NO: 647257 - DNA, 25 bp, Homo sapien
gaactcggcacaggagagcagccct

SEQ ID NO: 647258 - DNA, 25 bp, Homo sapien
ctcggcacaggagagcagcccttgt

SEQ ID NO: 647259 - DNA, 25 bp, Homo sapien
ttgccggtcaaacttcacccaagca

SEQ ID NO: 647260 - DNA, 25 bp, Homo sapien
ggagaatgggaccttggctctactt

SEQ ID NO: 647261 - DNA, 25 bp, Homo sapien
gaatgggaccttggctctacttcca

SEQ ID NO: 647262 - DNA, 25 bp, Homo sapien
tgggaccttggctctacttccaggg

SEQ ID NO: 647263 - DNA, 25 bp, Homo sapien
cttcccagcctctgtgttgaggttg

SEQ ID NO: 647264 - DNA, 25 bp, Homo sapien
ccagcctctgtgttgaggttgccgg

SEQ ID NO: 647265 - DNA, 25 bp, Homo sapien
gtggggccacacaaatctccaggag

SEQ ID NO: 647266 - DNA, 25 bp, Homo sapien
aattttatgcttttcatccttattt

SEQ ID NO: 647267 - DNA, 25 bp, Homo sapien
attttatgcttttcatccttatttt

SEQ ID NO: 647268 - DNA, 25 bp, Homo sapien
ttatgcttttcatccttattttcca

SEQ ID NO: 647269 - DNA, 25 bp, Homo sapien
tatgcttttcatccttattttccat

SEQ ID NO: 647270 - DNA, 25 bp, Homo sapien
ctctccacaggagggttgaagctgg

SEQ ID NO: 647271 - DNA, 25 bp, Homo sapien
tctccacaggagggttgaagctgga

SEQ ID NO: 647272 - DNA, 25 bp, Homo sapien
ctccacaggagggttgaagctggag

SEQ ID NO: 647273 - DNA, 25 bp, Homo sapien
tccacaggagggttgaagctggagt

SEQ ID NO: 647274 - DNA, 25 bp, Homo sapien
ccacaggagggttgaagctggagtg

SEQ ID NO: 647275 - DNA, 25 bp, Homo sapien
cacaggagggttgaagctggagtgg

SEQ ID NO: 647276 - DNA, 25 bp, Homo sapien
acaggagggttgaagctggagtggt

SEQ ID NO: 647277 - DNA, 25 bp, Homo sapien
tgtttaaaaacatttattggctggg

SEQ ID NO: 647278 - DNA, 25 bp, Homo sapien
taaaaacatttattggctgggtgtg

SEQ ID NO: 647279 - DNA, 25 bp, Homo sapien
aaaaacatttattggctgggtgtgg

SEQ ID NO: 647280 - DNA, 25 bp, Homo sapien
aaacatttattggctgggtgtggtg

SEQ ID NO: 647281 - DNA, 25 bp, Homo sapien
aacatttattggctgggtgtggtgg

SEQ ID NO: 647282 - DNA, 25 bp, Homo sapien
acatttattggctgggtgtggtggc

SEQ ID NO: 647283 - DNA, 25 bp, Homo sapien
catttattggctgggtgtggtggct

SEQ ID NO: 647284 - DNA, 25 bp, Homo sapien
atttattggctgggtgtggtggctc

SEQ ID NO: 647285 - DNA, 25 bp, Homo sapien
gtggtggctcacacccagcactttg

SEQ ID NO: 647286 - DNA, 25 bp, Homo sapien
tggtggctcacacccagcactttgg

SEQ ID NO: 647287 - DNA, 25 bp, Homo sapien
ggtggctcacacccagcactttggg

SEQ ID NO: 647288 - DNA, 25 bp, Homo sapien
gtgtgtctgttcgactcccctcgcc

SEQ ID NO: 647289 - DNA, 25 bp, Homo sapien
tgtgtctgttcgactcccctcgccc

SEQ ID NO: 647290 - DNA, 25 bp, Homo sapien
gtgtctgttcgactcccctcgcccc

SEQ ID NO: 647291 - DNA, 25 bp, Homo sapien
tgtctgttcgactcccctcgcccca

SEQ ID NO: 647292 - DNA, 25 bp, Homo sapien
gtctgttcgactcccctcgccccat

SEQ ID NO: 647293 - DNA, 25 bp, Homo sapien
tctgttcgactcccctcgccccatt

SEQ ID NO: 647294 - DNA, 25 bp, Homo sapien
ctgttcgactcccctcgccccattt

SEQ ID NO: 647295 - DNA, 25 bp, Homo sapien
tgttcgactcccctcgccccatttt

SEQ ID NO: 647296 - DNA, 25 bp, Homo sapien
ttcgactcccctcgccccattttca

SEQ ID NO: 647297 - DNA, 25 bp, Homo sapien
tcgactcccctcgccccattttcac

SEQ ID NO: 647298 - DNA, 25 bp, Homo sapien
cagcttctggtggtcccatgatcca

SEQ ID NO: 647299 - DNA, 25 bp, Homo sapien
gtggtcccatgatccaggagtgcgt

SEQ ID NO: 647300 - DNA, 25 bp, Homo sapien
atgatccaggagtgcgtccagagga

SEQ ID NO: 647301 - DNA, 25 bp, Homo sapien
gtgcgtccagaggaaaccatgccat

SEQ ID NO: 647302 - DNA, 25 bp, Homo sapien
gcccacgccattgtctcataaaaag

SEQ ID NO: 647303 - DNA, 25 bp, Homo sapien
aaaaagcgcgatgaccaggtttatg

SEQ ID NO: 647304 - DNA, 25 bp, Homo sapien
ggtttatggatcactctattctcaa

SEQ ID NO: 647305 - DNA, 25 bp, Homo sapien
tattctcaatgacaggaccttcagt

SEQ ID NO: 647306 - DNA, 25 bp, Homo sapien
gacaggaccttcagtctgtattaag

SEQ ID NO: 647307 - DNA, 25 bp, Homo sapien
gtctgtattaagaagatatggctgc

SEQ ID NO: 647308 - DNA, 25 bp, Homo sapien
gatatggctgcagaaagacaagatg

SEQ ID NO: 647309 - DNA, 25 bp, Homo sapien
gagtggatatgatcgctcaagataa

SEQ ID NO: 647310 - DNA, 25 bp, Homo sapien
agtggatatgatcgctcaagataaa

SEQ ID NO: 647311 - DNA, 25 bp, Homo sapien
ggatatgatcgctcaagataaatct

SEQ ID NO: 647312 - DNA, 25 bp, Homo sapien
atatgatcgctcaagataaatctct

SEQ ID NO: 647313 - DNA, 25 bp, Homo sapien
tatgatcgctcaagataaatctctt

SEQ ID NO: 647314 - DNA, 25 bp, Homo sapien
gatcgctcaagataaatctcttggc

SEQ ID NO: 647315 - DNA, 25 bp, Homo sapien
tcgctcaagataaatctcttggccg

SEQ ID NO: 647316 - DNA, 25 bp, Homo sapien
gctcaagataaatctcttggccggg

SEQ ID NO: 647317 - DNA, 25 bp, Homo sapien
tcaagataaatctcttggccgggcg

SEQ ID NO: 647318 - DNA, 25 bp, Homo sapien
caagataaatctcttggccgggcgc

SEQ ID NO: 647319 - DNA, 25 bp, Homo sapien
agataaatctcttggccgggcgcag

SEQ ID NO: 647320 - DNA, 25 bp, Homo sapien
agattcaacatctgaggctctgatc

SEQ ID NO: 647321 - DNA, 25 bp, Homo sapien
tctgaggctctgatctttttcatta

SEQ ID NO: 647322 - DNA, 25 bp, Homo sapien
gaaaaatcactctcacagggttctg

SEQ ID NO: 647323 - DNA, 25 bp, Homo sapien
aatcactctcacagggttctgctga

SEQ ID NO: 647324 - DNA, 25 bp, Homo sapien
actctcacagggttctgctgagggt

SEQ ID NO: 647325 - DNA, 25 bp, Homo sapien
agatgttgccaaggagcactccggg

SEQ ID NO: 647326 - DNA, 25 bp, Homo sapien
gagcactccgggaacctctaatggg

SEQ ID NO: 647327 - DNA, 25 bp, Homo sapien
ggacacaagacaaagcaaatggaca

SEQ ID NO: 647328 - DNA, 25 bp, Homo sapien
gatgggccccctgccatgaggaagt

SEQ ID NO: 647329 - DNA, 25 bp, Homo sapien
ggaagttcttcaggctgcgtctcct

SEQ ID NO: 647330 - DNA, 25 bp, Homo sapien
caggctgcgtctcctttttgtgttt

SEQ ID NO: 647331 - DNA, 25 bp, Homo sapien
tctaagatagtgtgggccctgtttc

SEQ ID NO: 647332 - DNA, 25 bp, Homo sapien
gtgggccctgtttcacagatgtgaa

SEQ ID NO: 647333 - DNA, 25 bp, Homo sapien
tcacagatgtgaaagccgaggttta

SEQ ID NO: 647334 - DNA, 25 bp, Homo sapien
gaagtcaggagtatgcagcaggcta

SEQ ID NO: 647335 - DNA, 25 bp, Homo sapien
aggctactggctgagctggaattca

SEQ ID NO: 647336 - DNA, 25 bp, Homo sapien
attcaaatatggatcaggtgcgtca

SEQ ID NO: 647337 - DNA, 25 bp, Homo sapien
tcaggtgcgtcaaaatctgttcctt

SEQ ID NO: 647338 - DNA, 25 bp, Homo sapien
gaagctatatactttctgttgggag

SEQ ID NO: 647339 - DNA, 25 bp, Homo sapien
gagaaggtgccttggacccgtatgt

SEQ ID NO: 647340 - DNA, 25 bp, Homo sapien
ggacccgtatgtaaacctggcgata

SEQ ID NO: 647341 - DNA, 25 bp, Homo sapien
acctggcgatatatggtttgcaaaa

SEQ ID NO: 647342 - DNA, 25 bp, Homo sapien
caacagaatttcgaaacttttatat

SEQ ID NO: 647343 - DNA, 25 bp, Homo sapien
tcataaagaacttgagcatacctgg

SEQ ID NO: 647344 - DNA, 25 bp, Homo sapien
ggtccaggaattatcccccttggat

SEQ ID NO: 647345 - DNA, 25 bp, Homo sapien
cttggataataacggagggctgtac

SEQ ID NO: 647346 - DNA, 25 bp, Homo sapien
aacggagggctgtactcatcatcca

SEQ ID NO: 647347 - DNA, 25 bp, Homo sapien
ggctgtactcatcatccaacttcaa

SEQ ID NO: 647348 - DNA, 25 bp, Homo sapien
cttcaacaacagtttgctgcctttc

SEQ ID NO: 647349 - DNA, 25 bp, Homo sapien
agtttgctgcctttctcatttcatg

SEQ ID NO: 647350 - DNA, 25 bp, Homo sapien
ttctcatttcatgtatccctttctg

SEQ ID NO: 647351 - DNA, 25 bp, Homo sapien
tcatgtatccctttctgcatttttt

SEQ ID NO: 647352 - DNA, 25 bp, Homo sapien
aaagcaaatcctggacatcatgtca

SEQ ID NO: 647353 - DNA, 25 bp, Homo sapien
gattcccctgcgtgagcctccagag

SEQ ID NO: 647354 - DNA, 25 bp, Homo sapien
attcccctgcgtgagcctccagagt

SEQ ID NO: 647355 - DNA, 25 bp, Homo sapien
ttcccctgcgtgagcctccagagta

SEQ ID NO: 647356 - DNA, 25 bp, Homo sapien
tcccctgcgtgagcctccagagtag

SEQ ID NO: 647357 - DNA, 25 bp, Homo sapien
cccctgcgtgagcctccagagtagc

SEQ ID NO: 647358 - DNA, 25 bp, Homo sapien
ggaattacaggcacatgacactgtg

SEQ ID NO: 647359 - DNA, 25 bp, Homo sapien
aggcacatgacactgtgcccagcta

SEQ ID NO: 647360 - DNA, 25 bp, Homo sapien
atttttctttattagtagagaccag

SEQ ID NO: 647361 - DNA, 25 bp, Homo sapien
tttttctttattagtagagaccagg

SEQ ID NO: 647362 - DNA, 25 bp, Homo sapien
tttctttattagtagagaccaggtt

SEQ ID NO: 647363 - DNA, 25 bp, Homo sapien
taaaagttgtctatgtttatggtgc

SEQ ID NO: 647364 - DNA, 25 bp, Homo sapien
ttaacagcttatgggcggggagctc

SEQ ID NO: 647365 - DNA, 25 bp, Homo sapien
gggagctcggcaaaactcagactaa

SEQ ID NO: 647366 - DNA, 25 bp, Homo sapien
ggagctcggcaaaactcagactaaa

SEQ ID NO: 647367 - DNA, 25 bp, Homo sapien
gctcggcaaaactcagactaaaaac

SEQ ID NO: 647368 - DNA, 25 bp, Homo sapien
cggcaaaactcagactaaaaacaga

SEQ ID NO: 647369 - DNA, 25 bp, Homo sapien
gcgtcggtcctccagagtttgtgaa

SEQ ID NO: 647370 - DNA, 25 bp, Homo sapien
cgtcggtcctccagagtttgtgaag

SEQ ID NO: 647371 - DNA, 25 bp, Homo sapien
gtcggtcctccagagtttgtgaagg

SEQ ID NO: 647372 - DNA, 25 bp, Homo sapien
tcggtcctccagagtttgtgaaggg

SEQ ID NO: 647373 - DNA, 25 bp, Homo sapien
gggtgtaaacatgtcggagtctggg

SEQ ID NO: 647374 - DNA, 25 bp, Homo sapien
tcatggaattgatagctaaaggcaa

SEQ ID NO: 647375 - DNA, 25 bp, Homo sapien
ggattctgtatttataggcatattt

SEQ ID NO: 647376 - DNA, 25 bp, Homo sapien
aggcatattttatgggtccagctta

SEQ ID NO: 647377 - DNA, 25 bp, Homo sapien
ttatgggtccagcttatgatgttat

SEQ ID NO: 647378 - DNA, 25 bp, Homo sapien
tatgatgttatagggcccagcttat

SEQ ID NO: 647379 - DNA, 25 bp, Homo sapien
tagggcccagcttatgatgttaata

SEQ ID NO: 647380 - DNA, 25 bp, Homo sapien
gatgttaatagtgcttgccctttac

SEQ ID NO: 647381 - DNA, 25 bp, Homo sapien
agtgcttgccctttacttttagatt

SEQ ID NO: 647382 - DNA, 25 bp, Homo sapien
gtgaagttgccctaaattatgtagg

SEQ ID NO: 647383 - DNA, 25 bp, Homo sapien
atgtagggcaaaacagttgaattct

SEQ ID NO: 647384 - DNA, 25 bp, Homo sapien
gaattctggtaatttcaagcagttc

SEQ ID NO: 647385 - DNA, 25 bp, Homo sapien
gcagttcaatctaataaaagctctt

SEQ ID NO: 647386 - DNA, 25 bp, Homo sapien
agcccgttactcctgtagctctgaa

SEQ ID NO: 647387 - DNA, 25 bp, Homo sapien
aacagcagctcacatgtcacctctg

SEQ ID NO: 647388 - DNA, 25 bp, Homo sapien
agctcacatgtcacctctgtgtgac

SEQ ID NO: 647389 - DNA, 25 bp, Homo sapien
cacacaggtgtggttgtcagcgagc

SEQ ID NO: 647390 - DNA, 25 bp, Homo sapien
gtggttgtcagcgagcacctcagga

SEQ ID NO: 647391 - DNA, 25 bp, Homo sapien
tgtcagcgagcacctcaggagaact

SEQ ID NO: 647392 - DNA, 25 bp, Homo sapien
tcaggagaactgagaagctcttttt

SEQ ID NO: 647393 - DNA, 25 bp, Homo sapien
gaagctctttttcaccattctttcc

SEQ ID NO: 647394 - DNA, 25 bp, Homo sapien
caaatcagtcaaaacctttcacaac

SEQ ID NO: 647395 - DNA, 25 bp, Homo sapien
tcacagccactgtctagcaggacac

SEQ ID NO: 647396 - DNA, 25 bp, Homo sapien
tagcaggacacctgtttttcccagc

SEQ ID NO: 647397 - DNA, 25 bp, Homo sapien
cccattcctaaaagagcatcccaag

SEQ ID NO: 647398 - DNA, 25 bp, Homo sapien
attcctaaaagagcatcccaagcct

SEQ ID NO: 647399 - DNA, 25 bp, Homo sapien
tcctaaaagagcatcccaagcctag

SEQ ID NO: 647400 - DNA, 25 bp, Homo sapien
aaaagagcatcccaagcctagaggt

SEQ ID NO: 647401 - DNA, 25 bp, Homo sapien
aaagagcatcccaagcctagaggtt

SEQ ID NO: 647402 - DNA, 25 bp, Homo sapien
aagagcatcccaagcctagaggttg

SEQ ID NO: 647403 - DNA, 25 bp, Homo sapien
agagcatcccaagcctagaggttgc

SEQ ID NO: 647404 - DNA, 25 bp, Homo sapien
agcatcccaagcctagaggttgctt

SEQ ID NO: 647405 - DNA, 25 bp, Homo sapien
gcatcccaagcctagaggttgcttt

SEQ ID NO: 647406 - DNA, 25 bp, Homo sapien
atcccaagcctagaggttgctttga

SEQ ID NO: 647407 - DNA, 25 bp, Homo sapien
tcccaagcctagaggttgctttgag

SEQ ID NO: 647408 - DNA, 25 bp, Homo sapien
tccatttggtctaaaccatagttta

SEQ ID NO: 647409 - DNA, 25 bp, Homo sapien
accatagtttaaatccaatgcttat

SEQ ID NO: 647410 - DNA, 25 bp, Homo sapien
atttgttaattttctatctgatgat

SEQ ID NO: 647411 - DNA, 25 bp, Homo sapien
atctgatgatatgttgaaggctgac

SEQ ID NO: 647412 - DNA, 25 bp, Homo sapien
gacagtgtgatgttgaagaccccaa

SEQ ID NO: 647413 - DNA, 25 bp, Homo sapien
gaagaccccaactgttactatatta

SEQ ID NO: 647414 - DNA, 25 bp, Homo sapien
ctgttactatattagagtctctctc

SEQ ID NO: 647415 - DNA, 25 bp, Homo sapien
agagtctctctctttagatctaata

SEQ ID NO: 647416 - DNA, 25 bp, Homo sapien
gagtcagtccctttatcgttatata

SEQ ID NO: 647417 - DNA, 25 bp, Homo sapien
tatcgttatataatgaccttcatct

SEQ ID NO: 647418 - DNA, 25 bp, Homo sapien
accttcatctctttgtagtttttga

SEQ ID NO: 647419 - DNA, 25 bp, Homo sapien
gtttatcattagtttgtatctgtaa

SEQ ID NO: 647420 - DNA, 25 bp, Homo sapien
atacaactttatactttgaagcttg

SEQ ID NO: 647421 - DNA, 25 bp, Homo sapien
gaagcttgtatctgtgaatttgcaa

SEQ ID NO: 647422 - DNA, 25 bp, Homo sapien
atttattttgccaatgttttctgaa

SEQ ID NO: 647423 - DNA, 25 bp, Homo sapien
ataaagcttctgttgtagcatgcca

SEQ ID NO: 647424 - DNA, 25 bp, Homo sapien
agcttctgttgtagcatgccatgca

SEQ ID NO: 647425 - DNA, 25 bp, Homo sapien
acattattgtgtttgtggttgatga

SEQ ID NO: 647426 - DNA, 25 bp, Homo sapien
tgtggttgatgaattatggctgtaa

SEQ ID NO: 647427 - DNA, 25 bp, Homo sapien
atggctgtaaataacactatagttt

SEQ ID NO: 647428 - DNA, 25 bp, Homo sapien
atagtttaataagcccaccattctg

SEQ ID NO: 647429 - DNA, 25 bp, Homo sapien
ttaataagcccaccattctgagttt

SEQ ID NO: 647430 - DNA, 25 bp, Homo sapien
gaaaatttccaagcatggtatcatc

SEQ ID NO: 647431 - DNA, 25 bp, Homo sapien
ccaagcatggtatcatctcactttt

SEQ ID NO: 647432 - DNA, 25 bp, Homo sapien
cttttctaatttacaggctggaaca

SEQ ID NO: 647433 - DNA, 25 bp, Homo sapien
ggctggaacagatgagagccctcct

SEQ ID NO: 647434 - DNA, 25 bp, Homo sapien
agagaattgggttctagtggactct

SEQ ID NO: 647435 - DNA, 25 bp, Homo sapien
ggactctgctacacttaaacctatg

SEQ ID NO: 647436 - DNA, 25 bp, Homo sapien
taaacctatgtgacaaaccgcccat

SEQ ID NO: 647437 - DNA, 25 bp, Homo sapien
ctatgtgacaaaccgcccattattt

SEQ ID NO: 647438 - DNA, 25 bp, Homo sapien
ttaattatacaatgcctcgttccta

SEQ ID NO: 647439 - DNA, 25 bp, Homo sapien
atacaatgcctcgttcctatatgga

SEQ ID NO: 647440 - DNA, 25 bp, Homo sapien
atgcctcgttcctatatggatttga

SEQ ID NO: 647441 - DNA, 25 bp, Homo sapien
taggattaatctctgtaaaacatac

SEQ ID NO: 647442 - DNA, 25 bp, Homo sapien
atctctgtaaaacatactaaagcaa

SEQ ID NO: 647443 - DNA, 25 bp, Homo sapien
gagataaggaacttttcaattttgt

SEQ ID NO: 647444 - DNA, 25 bp, Homo sapien
cactttaaataaggagctttgagtt

SEQ ID NO: 647445 - DNA, 25 bp, Homo sapien
tttgagtttttaagatagcctggct

SEQ ID NO: 647446 - DNA, 25 bp, Homo sapien
gagtttttaagatagcctggctaaa

SEQ ID NO: 647447 - DNA, 25 bp, Homo sapien
gatagcctggctaaaacctgtgtaa

SEQ ID NO: 647448 - DNA, 25 bp, Homo sapien
atagcctggctaaaacctgtgtaag

SEQ ID NO: 647449 - DNA, 25 bp, Homo sapien
agcctggctaaaacctgtgtaagga

SEQ ID NO: 647450 - DNA, 25 bp, Homo sapien
cctggctaaaacctgtgtaaggaga

SEQ ID NO: 647451 - DNA, 25 bp, Homo sapien
tttctaattttatgatagcaacaat

SEQ ID NO: 647452 - DNA, 25 bp, Homo sapien
ccttcggttcattaaaacccatcag

SEQ ID NO: 647453 - DNA, 25 bp, Homo sapien
cttcggttcattaaaacccatcagt

SEQ ID NO: 647454 - DNA, 25 bp, Homo sapien
ttcggttcattaaaacccatcagtg

SEQ ID NO: 647455 - DNA, 25 bp, Homo sapien
tcggttcattaaaacccatcagtgg

SEQ ID NO: 647456 - DNA, 25 bp, Homo sapien
cggttcattaaaacccatcagtggg

SEQ ID NO: 647457 - DNA, 25 bp, Homo sapien
ggttcattaaaacccatcagtgggc

SEQ ID NO: 647458 - DNA, 25 bp, Homo sapien
ttcattaaaacccatcagtgggccg

SEQ ID NO: 647459 - DNA, 25 bp, Homo sapien
tcattaaaacccatcagtgggccgg

SEQ ID NO: 647460 - DNA, 25 bp, Homo sapien
cattaaaacccatcagtgggccggg

SEQ ID NO: 647461 - DNA, 25 bp, Homo sapien
ttaaaacccatcagtgggccgggcg

SEQ ID NO: 647462 - DNA, 25 bp, Homo sapien
taaaacccatcagtgggccgggcgc

SEQ ID NO: 647463 - DNA, 25 bp, Homo sapien
tttttagcccatagataaacttgct

SEQ ID NO: 647464 - DNA, 25 bp, Homo sapien
gcccatagataaacttgcttaaaaa

SEQ ID NO: 647465 - DNA, 25 bp, Homo sapien
gaaagacactgaaatctcagtctat

SEQ ID NO: 647466 - DNA, 25 bp, Homo sapien
ctgaaatctcagtctatacatagtt

SEQ ID NO: 647467 - DNA, 25 bp, Homo sapien
gtctatacatagtttcatcagtgtt

SEQ ID NO: 647468 - DNA, 25 bp, Homo sapien
catagtttcatcagtgtttattggg

SEQ ID NO: 647469 - DNA, 25 bp, Homo sapien
gtttcatcagtgtttattgggaact

SEQ ID NO: 647470 - DNA, 25 bp, Homo sapien
tcatcagtgtttattgggaactgtg

SEQ ID NO: 647471 - DNA, 25 bp, Homo sapien
tgcctaattctagtgtagtgtcaat

SEQ ID NO: 647472 - DNA, 25 bp, Homo sapien
cctaattctagtgtagtgtcaattt

SEQ ID NO: 647473 - DNA, 25 bp, Homo sapien
gtgtcaatttatagtacacaataaa

SEQ ID NO: 647474 - DNA, 25 bp, Homo sapien
tccacttaaagtgggcaagaatgct

SEQ ID NO: 647475 - DNA, 25 bp, Homo sapien
ccacttaaagtgggcaagaatgctc

SEQ ID NO: 647476 - DNA, 25 bp, Homo sapien
cttaaagtgggcaagaatgctcttt

SEQ ID NO: 647477 - DNA, 25 bp, Homo sapien
ttaaagtgggcaagaatgctctttg

SEQ ID NO: 647478 - DNA, 25 bp, Homo sapien
taaagtgggcaagaatgctctttga

SEQ ID NO: 647479 - DNA, 25 bp, Homo sapien
aaagtgggcaagaatgctctttgag

SEQ ID NO: 647480 - DNA, 25 bp, Homo sapien
aagtgggcaagaatgctctttgagg

SEQ ID NO: 647481 - DNA, 25 bp, Homo sapien
agtgggcaagaatgctctttgaggc

SEQ ID NO: 647482 - DNA, 25 bp, Homo sapien
gtgggcaagaatgctctttgaggct

SEQ ID NO: 647483 - DNA, 25 bp, Homo sapien
gcaagaatgctctttgaggctgggc

SEQ ID NO: 647484 - DNA, 25 bp, Homo sapien
agaatgctctttgaggctgggcgca

SEQ ID NO: 647485 - DNA, 25 bp, Homo sapien
gaggtcccgggcaaacccacagttg

SEQ ID NO: 647486 - DNA, 25 bp, Homo sapien
ttgttcacacacacagatcgctgtg

SEQ ID NO: 647487 - DNA, 25 bp, Homo sapien
acacagatcgctgtgctgtgggcca

SEQ ID NO: 647488 - DNA, 25 bp, Homo sapien
gggccaaatccccacatcagcagga

SEQ ID NO: 647489 - DNA, 25 bp, Homo sapien
aggactgacccaccgctgagagagc

SEQ ID NO: 647490 - DNA, 25 bp, Homo sapien
gctgcagaaaagctggctatgtctc

SEQ ID NO: 647491 - DNA, 25 bp, Homo sapien
ggctatgtctctggaggtcttgaac

SEQ ID NO: 647492 - DNA, 25 bp, Homo sapien
gaggtcttgaacttctaagacgcaa

SEQ ID NO: 647493 - DNA, 25 bp, Homo sapien
taagacgcaaaattgcctgctgaaa

SEQ ID NO: 647494 - DNA, 25 bp, Homo sapien
aaagagacactgctcctacttggag

SEQ ID NO: 647495 - DNA, 25 bp, Homo sapien
caagacgctcgatcaataagttaat

SEQ ID NO: 647496 - DNA, 25 bp, Homo sapien
agagacctcatgacccaatagcctc

SEQ ID NO: 647497 - DNA, 25 bp, Homo sapien
tcttaataccttcacaatggggatt

SEQ ID NO: 647498 - DNA, 25 bp, Homo sapien
tcagaccatagcaattaccaatctt

SEQ ID NO: 647499 - DNA, 25 bp, Homo sapien
catagcaattaccaatctttaaggg

SEQ ID NO: 647500 - DNA, 25 bp, Homo sapien
tactgccctcaaattgcactcaatt

SEQ ID NO: 647501 - DNA, 25 bp, Homo sapien
attgcactcaatttacatcgtatca

SEQ ID NO: 647502 - DNA, 25 bp, Homo sapien
acatcgtatcaattgctataccact

SEQ ID NO: 647503 - DNA, 25 bp, Homo sapien
atcaattgctataccacttaatgga

SEQ ID NO: 647504 - DNA, 25 bp, Homo sapien
gctataccacttaatggacattgtt

SEQ ID NO: 647505 - DNA, 25 bp, Homo sapien
atggacattgttttcatcatataat

SEQ ID NO: 647506 - DNA, 25 bp, Homo sapien
cattgctattgaatatatgccttta

SEQ ID NO: 647507 - DNA, 25 bp, Homo sapien
tgtccttggcgcctccatgttgcgg

SEQ ID NO: 647508 - DNA, 25 bp, Homo sapien
ttggcgcctccatgttgcggctgct

SEQ ID NO: 647509 - DNA, 25 bp, Homo sapien
catgttgcggctgctccatgtcggg

SEQ ID NO: 647510 - DNA, 25 bp, Homo sapien
cgcgccgcccaagctgttgttgttg

SEQ ID NO: 647511 - DNA, 25 bp, Homo sapien
aaatgggatgtttgctgttgctgct

SEQ ID NO: 647512 - DNA, 25 bp, Homo sapien
gctgctggaactggtttagctgctg

SEQ ID NO: 647513 - DNA, 25 bp, Homo sapien
ctggaactggtttagctgctgctgt

SEQ ID NO: 647514 - DNA, 25 bp, Homo sapien
gaactggtttagctgctgctgtagt

SEQ ID NO: 647515 - DNA, 25 bp, Homo sapien
actggtttagctgctgctgtagtgc

SEQ ID NO: 647516 - DNA, 25 bp, Homo sapien
tttagctgctgctgtagtgcgtggt

SEQ ID NO: 647517 - DNA, 25 bp, Homo sapien
ggcttgctcagcagcggcgggcccg

SEQ ID NO: 647518 - DNA, 25 bp, Homo sapien
taatctcaaaattctttaaatcaaa

SEQ ID NO: 647519 - DNA, 25 bp, Homo sapien
tctcaaaattctttaaatcaaaatg

SEQ ID NO: 647520 - DNA, 25 bp, Homo sapien
gctggaactacaagcccgtgtcact

SEQ ID NO: 647521 - DNA, 25 bp, Homo sapien
ctggaactacaagcccgtgtcactg

SEQ ID NO: 647522 - DNA, 25 bp, Homo sapien
tggaactacaagcccgtgtcactgc

SEQ ID NO: 647523 - DNA, 25 bp, Homo sapien
ggaactacaagcccgtgtcactgca

SEQ ID NO: 647524 - DNA, 25 bp, Homo sapien
gaactacaagcccgtgtcactgcac

SEQ ID NO: 647525 - DNA, 25 bp, Homo sapien
aactacaagcccgtgtcactgcacc

SEQ ID NO: 647526 - DNA, 25 bp, Homo sapien
actacaagcccgtgtcactgcaccc

SEQ ID NO: 647527 - DNA, 25 bp, Homo sapien
ctacaagcccgtgtcactgcaccca

SEQ ID NO: 647528 - DNA, 25 bp, Homo sapien
tacaagcccgtgtcactgcacccag

SEQ ID NO: 647529 - DNA, 25 bp, Homo sapien
gaccctacattacataggttacgta

SEQ ID NO: 647530 - DNA, 25 bp, Homo sapien
ggttacgtaagcctactgtggctgt

SEQ ID NO: 647531 - DNA, 25 bp, Homo sapien
atttctcctttctgggcctaatttg

SEQ ID NO: 647532 - DNA, 25 bp, Homo sapien
tctgggcctaatttgcactagatgg

SEQ ID NO: 647533 - DNA, 25 bp, Homo sapien
tgctgaaaacccttgggtcaagttt

SEQ ID NO: 647534 - DNA, 25 bp, Homo sapien
gagtggtttgtcctgtaactgcctt

SEQ ID NO: 647535 - DNA, 25 bp, Homo sapien
agtggtttgtcctgtaactgccttt

SEQ ID NO: 647536 - DNA, 25 bp, Homo sapien
tggtttgtcctgtaactgcctttcc

SEQ ID NO: 647537 - DNA, 25 bp, Homo sapien
gtttgtcctgtaactgcctttccct

SEQ ID NO: 647538 - DNA, 25 bp, Homo sapien
gcctgggggtattgtgaactcaaga

SEQ ID NO: 647539 - DNA, 25 bp, Homo sapien
ttgccagggtaaggccatgaggttt

SEQ ID NO: 647540 - DNA, 25 bp, Homo sapien
agtattctttgatggtcccatatca

SEQ ID NO: 647541 - DNA, 25 bp, Homo sapien
ctttgatggtcccatatcatatgga

SEQ ID NO: 647542 - DNA, 25 bp, Homo sapien
ggaggtcctccatgcagaaggccaa

SEQ ID NO: 647543 - DNA, 25 bp, Homo sapien
atgcagaaggccaatctcttccggg

SEQ ID NO: 647544 - DNA, 25 bp, Homo sapien
agaaggccaatctcttccgggcaaa

SEQ ID NO: 647545 - DNA, 25 bp, Homo sapien
aggccaatctcttccgggcaaataa

SEQ ID NO: 647546 - DNA, 25 bp, Homo sapien
tcttccgggcaaataaccatatgtc

SEQ ID NO: 647547 - DNA, 25 bp, Homo sapien
gggcaaataaccatatgtcaccaag

SEQ ID NO: 647548 - DNA, 25 bp, Homo sapien
aataaccatatgtcaccaagaggtg

SEQ ID NO: 647549 - DNA, 25 bp, Homo sapien
caagaggtgacggttatgcaactaa

SEQ ID NO: 647550 - DNA, 25 bp, Homo sapien
gcaactaaggatggggacctctcat

SEQ ID NO: 647551 - DNA, 25 bp, Homo sapien
gctcccacaatttaacctaagtatc

SEQ ID NO: 647552 - DNA, 25 bp, Homo sapien
ttaacctaagtatcagccctggcat

SEQ ID NO: 647553 - DNA, 25 bp, Homo sapien
taacctaagtatcagccctggcatg

SEQ ID NO: 647554 - DNA, 25 bp, Homo sapien
gcctgttcctcttctttatctaaaa

SEQ ID NO: 647555 - DNA, 25 bp, Homo sapien
gttcctcttctttatctaaaagtgc

SEQ ID NO: 647556 - DNA, 25 bp, Homo sapien
ttgcctcttttaaatagttccaagg

SEQ ID NO: 647557 - DNA, 25 bp, Homo sapien
tcttttaaatagttccaaggtgctg

SEQ ID NO: 647558 - DNA, 25 bp, Homo sapien
caaggtgctggccaatcgggacaaa

SEQ ID NO: 647559 - DNA, 25 bp, Homo sapien
tgaggtcccattccagccctggaaa

SEQ ID NO: 647560 - DNA, 25 bp, Homo sapien
attccagccctggaaactggacaca

SEQ ID NO: 647561 - DNA, 25 bp, Homo sapien
gccctggaaactggacacagcagta

SEQ ID NO: 647562 - DNA, 25 bp, Homo sapien
taaagtcactggaattgaggtagca

SEQ ID NO: 647563 - DNA, 25 bp, Homo sapien
gaggtagcagtgagaagcatcatat

SEQ ID NO: 647564 - DNA, 25 bp, Homo sapien
aagctttgggtcaatatttactgaa

SEQ ID NO: 647565 - DNA, 25 bp, Homo sapien
atatatttcctgtttcgctgacaag

SEQ ID NO: 647566 - DNA, 25 bp, Homo sapien
tcctgtttcgctgacaagagttaat

SEQ ID NO: 647567 - DNA, 25 bp, Homo sapien
taaacttgtttatctttgctcctag

SEQ ID NO: 647568 - DNA, 25 bp, Homo sapien
gtttatctttgctcctagacaaaag

SEQ ID NO: 647569 - DNA, 25 bp, Homo sapien
agttttgttcgaggagattctaaat

SEQ ID NO: 647570 - DNA, 25 bp, Homo sapien
atttctttcttgatactgctatgga

SEQ ID NO: 647571 - DNA, 25 bp, Homo sapien
ggtgaagcacatagcaagccacttt

SEQ ID NO: 647572 - DNA, 25 bp, Homo sapien
agcaagccactttatcttatatttt

SEQ ID NO: 647573 - DNA, 25 bp, Homo sapien
ttgtctcaagatcaatgggtgttac

SEQ ID NO: 647574 - DNA, 25 bp, Homo sapien
ctcaagatcaatgggtgttacaaaa

SEQ ID NO: 647575 - DNA, 25 bp, Homo sapien
caagatcaatgggtgttacaaaaaa

SEQ ID NO: 647576 - DNA, 25 bp, Homo sapien
atgggtgttacaaaaaagagctatc

SEQ ID NO: 647577 - DNA, 25 bp, Homo sapien
gggtgttacaaaaaagagctatcgg

SEQ ID NO: 647578 - DNA, 25 bp, Homo sapien
gtgttacaaaaaagagctatcggct

SEQ ID NO: 647579 - DNA, 25 bp, Homo sapien
tgttacaaaaaagagctatcggctg

SEQ ID NO: 647580 - DNA, 25 bp, Homo sapien
tacaaaaaagagctatcggctggga

SEQ ID NO: 647581 - DNA, 25 bp, Homo sapien
caaaaaagagctatcggctgggagt

SEQ ID NO: 647582 - DNA, 25 bp, Homo sapien
aaaaaagagctatcggctgggagtg

SEQ ID NO: 647583 - DNA, 25 bp, Homo sapien
aagagctatcggctgggagtggtgg

SEQ ID NO: 647584 - DNA, 25 bp, Homo sapien
cagtttgcgatggaaggctgcctcc

SEQ ID NO: 647585 - DNA, 25 bp, Homo sapien
tggaaggctgcctccgaatcgagga

SEQ ID NO: 647586 - DNA, 25 bp, Homo sapien
cgaatcgaggaagccttgaccttgg

SEQ ID NO: 647587 - DNA, 25 bp, Homo sapien
gggcctgccttttcgctgggcttgc

SEQ ID NO: 647588 - DNA, 25 bp, Homo sapien
gcttgcctttctctgggcagcgttc

SEQ ID NO: 647589 - DNA, 25 bp, Homo sapien
gcagcgttcgctcagcacttcagtg

SEQ ID NO: 647590 - DNA, 25 bp, Homo sapien
cctgggactgaattcacaccagcca

SEQ ID NO: 647591 - DNA, 25 bp, Homo sapien
ggctacttcacgttctctatgtttg

SEQ ID NO: 647592 - DNA, 25 bp, Homo sapien
tcacgttctctatgtttgcagctgt

SEQ ID NO: 647593 - DNA, 25 bp, Homo sapien
tttgttagtttctctccctgaacca

SEQ ID NO: 647594 - DNA, 25 bp, Homo sapien
tccctgaaccacattttgagctgag

SEQ ID NO: 647595 - DNA, 25 bp, Homo sapien
ggaaaggcagttacaggacaaacca

SEQ ID NO: 647596 - DNA, 25 bp, Homo sapien
aaggcagttacaggacaaaccactc

SEQ ID NO: 647597 - DNA, 25 bp, Homo sapien
ggcagttacaggacaaaccactcat

SEQ ID NO: 647598 - DNA, 25 bp, Homo sapien
agttacaggacaaaccactcatctt

SEQ ID NO: 647599 - DNA, 25 bp, Homo sapien
ttacaggacaaaccactcatctttc

SEQ ID NO: 647600 - DNA, 25 bp, Homo sapien
tacaggacaaaccactcatctttcc

SEQ ID NO: 647601 - DNA, 25 bp, Homo sapien
aggacaaaccactcatctttcccaa

SEQ ID NO: 647602 - DNA, 25 bp, Homo sapien
ggacaaaccactcatctttcccaaa

SEQ ID NO: 647603 - DNA, 25 bp, Homo sapien
catctttcccaaaacttgacccaag

SEQ ID NO: 647604 - DNA, 25 bp, Homo sapien
ggtcttgagttcacaatacccccag

SEQ ID NO: 647605 - DNA, 25 bp, Homo sapien
tcttgagttcacaatacccccaggc

SEQ ID NO: 647606 - DNA, 25 bp, Homo sapien
gaaatattagtgtgtattcccagtt

SEQ ID NO: 647607 - DNA, 25 bp, Homo sapien
tgtattcccagtttcgactttttat

SEQ ID NO: 647608 - DNA, 25 bp, Homo sapien
ttattttattacacacacactccca

SEQ ID NO: 647609 - DNA, 25 bp, Homo sapien
acactcccacacatagctgtgacaa

SEQ ID NO: 647610 - DNA, 25 bp, Homo sapien
gctgtgacaatgaacttcacatagt

SEQ ID NO: 647611 - DNA, 25 bp, Homo sapien
tggaaaaactcacttttcccatcca

SEQ ID NO: 647612 - DNA, 25 bp, Homo sapien
tcacttttcccatccaacgttatgt

SEQ ID NO: 647613 - DNA, 25 bp, Homo sapien
tcccatccaacgttatgtttcctta

SEQ ID NO: 647614 - DNA, 25 bp, Homo sapien
gttatgtttccttaagatctctcta

SEQ ID NO: 647615 - DNA, 25 bp, Homo sapien
ccttaagatctctctatgttgatat

SEQ ID NO: 647616 - DNA, 25 bp, Homo sapien
atgaatgtaactcatgctaaccatg

SEQ ID NO: 647617 - DNA, 25 bp, Homo sapien
gacatggaagatactcaaacttgga

SEQ ID NO: 647618 - DNA, 25 bp, Homo sapien
ttggagtaaccaagcggtattcttt

SEQ ID NO: 647619 - DNA, 25 bp, Homo sapien
agcggtattctttactcgtcaatta

SEQ ID NO: 647620 - DNA, 25 bp, Homo sapien
ttactcgtcaattatggaacatgtt

SEQ ID NO: 647621 - DNA, 25 bp, Homo sapien
ggaacatgttagtacttgcacgtgt

SEQ ID NO: 647622 - DNA, 25 bp, Homo sapien
gtacttgcacgtgtgattacgattg

SEQ ID NO: 647623 - DNA, 25 bp, Homo sapien
aagctgaagagcaagaacgttttga

SEQ ID NO: 647624 - DNA, 25 bp, Homo sapien
aaattattagctatgcgcggtacag

SEQ ID NO: 647625 - DNA, 25 bp, Homo sapien
tagctatgcgcggtacagaaaatgc

SEQ ID NO: 647626 - DNA, 25 bp, Homo sapien
tgcatataaattacaccgtgaactt

SEQ ID NO: 647627 - DNA, 25 bp, Homo sapien
gcaaatgtaactgttgttcgtgaaa

SEQ ID NO: 647628 - DNA, 25 bp, Homo sapien
cagtgtgcaattctaattatgggac

SEQ ID NO: 647629 - DNA, 25 bp, Homo sapien
ggtcatgcaattattactaaatatg

SEQ ID NO: 647630 - DNA, 25 bp, Homo sapien
gtcatgcaattattactaaatatgg

SEQ ID NO: 647631 - DNA, 25 bp, Homo sapien
tcatgcaattattactaaatatgga

SEQ ID NO: 647632 - DNA, 25 bp, Homo sapien
tcaaggcccagagctttatgggatc

SEQ ID NO: 647633 - DNA, 25 bp, Homo sapien
gtccccagagtaaccctgtaggcct

SEQ ID NO: 647634 - DNA, 25 bp, Homo sapien
tccccagagtaaccctgtaggccta

SEQ ID NO: 647635 - DNA, 25 bp, Homo sapien
ccagagtaaccctgtaggcctaaag

SEQ ID NO: 647636 - DNA, 25 bp, Homo sapien
cagagtaaccctgtaggcctaaagt

SEQ ID NO: 647637 - DNA, 25 bp, Homo sapien
aaccctgtaggcctaaagtactcag

SEQ ID NO: 647638 - DNA, 25 bp, Homo sapien
accctgtaggcctaaagtactcagt

SEQ ID NO: 647639 - DNA, 25 bp, Homo sapien
atggactcccaccttcaggcaggat

SEQ ID NO: 647640 - DNA, 25 bp, Homo sapien
ccttcaggcaggattgggtagtaca

SEQ ID NO: 647641 - DNA, 25 bp, Homo sapien
gtttgtaactacctggcattgcctt

SEQ ID NO: 647642 - DNA, 25 bp, Homo sapien
acctggcattgccttttgttgaggt

SEQ ID NO: 647643 - DNA, 25 bp, Homo sapien
ttgccttttgttgaggtggcagaca

SEQ ID NO: 647644 - DNA, 25 bp, Homo sapien
gtggcagacaagaaacatggattat

SEQ ID NO: 647645 - DNA, 25 bp, Homo sapien
acatggattattgcgtggagttcca

SEQ ID NO: 647646 - DNA, 25 bp, Homo sapien
gactcattctacattcttgttgttc

SEQ ID NO: 647647 - DNA, 25 bp, Homo sapien
tctacattcttgttgttcttagtgt

SEQ ID NO: 647648 - DNA, 25 bp, Homo sapien
ggaattgtatcagcacaaggcaata

SEQ ID NO: 647649 - DNA, 25 bp, Homo sapien
aaggcaatattctaacatgacaatg

SEQ ID NO: 647650 - DNA, 25 bp, Homo sapien
gcgttacgcacaaagccgccgatcc

SEQ ID NO: 647651 - DNA, 25 bp, Homo sapien
tgagcagagcgaccaccgcccggga

SEQ ID NO: 647652 - DNA, 25 bp, Homo sapien
gagcagcgcggcgagacgcacggtg

SEQ ID NO: 647653 - DNA, 25 bp, Homo sapien
cagccgaagcgcagcgagagaacgc

SEQ ID NO: 647654 - DNA, 25 bp, Homo sapien
aagcgcagcgagagaacgcgccacc

SEQ ID NO: 647655 - DNA, 25 bp, Homo sapien
gggcccgggtgcagctagcgaccct

SEQ ID NO: 647656 - DNA, 25 bp, Homo sapien
tgttgtcttgtatgctcagcgaggc

SEQ ID NO: 647657 - DNA, 25 bp, Homo sapien
ttgtcttgtatgctcagcgaggccc

SEQ ID NO: 647658 - DNA, 25 bp, Homo sapien
tcttgtatgctcagcgaggcccgga

SEQ ID NO: 647659 - DNA, 25 bp, Homo sapien
tatgctcagcgaggcccggagagac

SEQ ID NO: 647660 - DNA, 25 bp, Homo sapien
gggagagagctaggccgagtccacc

SEQ ID NO: 647661 - DNA, 25 bp, Homo sapien
agccccgactttccgtgcaataaag

SEQ ID NO: 647662 - DNA, 25 bp, Homo sapien
gactttccgtgcaataaagcagcag

SEQ ID NO: 647663 - DNA, 25 bp, Homo sapien
agagtaattaagtggctgacgcaca

SEQ ID NO: 647664 - DNA, 25 bp, Homo sapien
agtggctgacgcacagaagaagccg

SEQ ID NO: 647665 - DNA, 25 bp, Homo sapien
gaagaagccgttacaaagaattgac

SEQ ID NO: 647666 - DNA, 25 bp, Homo sapien
gaattgactaaattgcccattcatt

SEQ ID NO: 647667 - DNA, 25 bp, Homo sapien
aattgcccattcattagcagctcgg

SEQ ID NO: 647668 - DNA, 25 bp, Homo sapien
tcattagcagctcggcatggaagga

SEQ ID NO: 647669 - DNA, 25 bp, Homo sapien
gaattacaaatagacggcggagccc

SEQ ID NO: 647670 - DNA, 25 bp, Homo sapien
cggagcccgcagtaattcaatctaa

SEQ ID NO: 647671 - DNA, 25 bp, Homo sapien
ttcaatctaaccttgtacttacaga

SEQ ID NO: 647672 - DNA, 25 bp, Homo sapien
aagctggcctggaaagacaagccaa

SEQ ID NO: 647673 - DNA, 25 bp, Homo sapien
gacaagccaaagtctagtgcaggac

SEQ ID NO: 647674 - DNA, 25 bp, Homo sapien
gcgtatatacgggacaaaacctagg

SEQ ID NO: 647675 - DNA, 25 bp, Homo sapien
gacaaaacctaggacaaggccaggc

SEQ ID NO: 647676 - DNA, 25 bp, Homo sapien
gccaggcagccactcagattattta

SEQ ID NO: 647677 - DNA, 25 bp, Homo sapien
ttggcacttttcacacacagacaaa

SEQ ID NO: 647678 - DNA, 25 bp, Homo sapien
tttcacacacagacaaattcccctg

SEQ ID NO: 647679 - DNA, 25 bp, Homo sapien
agaactgttcaggaccactcaaaaa

SEQ ID NO: 647680 - DNA, 25 bp, Homo sapien
aaaagctctattgtttaggcctcga

SEQ ID NO: 647681 - DNA, 25 bp, Homo sapien
attgtttaggcctcgaatccttcat

SEQ ID NO: 647682 - DNA, 25 bp, Homo sapien
cctcgaatccttcatcaaccattgt

SEQ ID NO: 647683 - DNA, 25 bp, Homo sapien
atggcaacggcgcatctcaagtcag

SEQ ID NO: 647684 - DNA, 25 bp, Homo sapien
tcaagtcagccttcctgaaatccaa

SEQ ID NO: 647685 - DNA, 25 bp, Homo sapien
aagccccgcgcttcggagatgagaa

SEQ ID NO: 647686 - DNA, 25 bp, Homo sapien
gggattgtattttaaacactctgtg

SEQ ID NO: 647687 - DNA, 25 bp, Homo sapien
cactctgtgtaaggtctgttgtatc

SEQ ID NO: 647688 - DNA, 25 bp, Homo sapien
aggtctgttgtatctccatatcctt

SEQ ID NO: 647689 - DNA, 25 bp, Homo sapien
atccttttgatactcaactttcctt

SEQ ID NO: 647690 - DNA, 25 bp, Homo sapien
gatctggaaaaaagccccatctcac

SEQ ID NO: 647691 - DNA, 25 bp, Homo sapien
ccatctcactgtctggaggtgcgag

SEQ ID NO: 647692 - DNA, 25 bp, Homo sapien
gaatacagaggaggcgcaacaaagg

SEQ ID NO: 647693 - DNA, 25 bp, Homo sapien
ctgccagcgccggaaaataaataaa

SEQ ID NO: 647694 - DNA, 25 bp, Homo sapien
tctggatcattgaagcgcttggaag

SEQ ID NO: 647695 - DNA, 25 bp, Homo sapien
gaagcgcttggaagatactactgca

SEQ ID NO: 647696 - DNA, 25 bp, Homo sapien
gcgcttggaagatactactgcacga

SEQ ID NO: 647697 - DNA, 25 bp, Homo sapien
gcttggaagatactactgcacgatt

SEQ ID NO: 647698 - DNA, 25 bp, Homo sapien
tggaagatactactgcacgatttac

SEQ ID NO: 647699 - DNA, 25 bp, Homo sapien
gatactactgcacgatttacaaatg

SEQ ID NO: 647700 - DNA, 25 bp, Homo sapien
tactgcacgatttacaaatgcaaat

SEQ ID NO: 647701 - DNA, 25 bp, Homo sapien
gtctctgcacacacctctagtggaa

SEQ ID NO: 647702 - DNA, 25 bp, Homo sapien
ctctgcacacacctctagtggaaaa

SEQ ID NO: 647703 - DNA, 25 bp, Homo sapien
tgcacacacctctagtggaaaagat

SEQ ID NO: 647704 - DNA, 25 bp, Homo sapien
acacacctctagtggaaaagatgtt

SEQ ID NO: 647705 - DNA, 25 bp, Homo sapien
aactttaaatttttgatcaaccatg

SEQ ID NO: 647706 - DNA, 25 bp, Homo sapien
gagcaaagattgaattatccttctg

SEQ ID NO: 647707 - DNA, 25 bp, Homo sapien
gcaaagattgaattatccttctgtt

SEQ ID NO: 647708 - DNA, 25 bp, Homo sapien
caaagattgaattatccttctgttc

SEQ ID NO: 647709 - DNA, 25 bp, Homo sapien
tgttctctctacagaaatgatataa

SEQ ID NO: 647710 - DNA, 25 bp, Homo sapien
tatttgatatattcgtaagcttttg

SEQ ID NO: 647711 - DNA, 25 bp, Homo sapien
tttgatatattcgtaagcttttgtt

SEQ ID NO: 647712 - DNA, 25 bp, Homo sapien
gatatattcgtaagcttttgttaag

SEQ ID NO: 647713 - DNA, 25 bp, Homo sapien
tattcgtaagcttttgttaagtttg

SEQ ID NO: 647714 - DNA, 25 bp, Homo sapien
gttaagtttgtaatttgttgcaatt

SEQ ID NO: 647715 - DNA, 25 bp, Homo sapien
aataaatattcacttacgtgtctaa

SEQ ID NO: 647716 - DNA, 25 bp, Homo sapien
gctcccacctggtgctcactgccca

SEQ ID NO: 647717 - DNA, 25 bp, Homo sapien
acctggtgctcactgcccacactga

SEQ ID NO: 647718 - DNA, 25 bp, Homo sapien
ccacactgaggctctcctgcagaag

SEQ ID NO: 647719 - DNA, 25 bp, Homo sapien
cacactgaggctctcctgcagaagg

SEQ ID NO: 647720 - DNA, 25 bp, Homo sapien
acactgaggctctcctgcagaaggc

SEQ ID NO: 647721 - DNA, 25 bp, Homo sapien
tgaggctctcctgcagaaggcacgg

SEQ ID NO: 647722 - DNA, 25 bp, Homo sapien
aggctctcctgcagaaggcacggtg

SEQ ID NO: 647723 - DNA, 25 bp, Homo sapien
gctctcctgcagaaggcacggtggc

SEQ ID NO: 647724 - DNA, 25 bp, Homo sapien
ctctcctgcagaaggcacggtggct

SEQ ID NO: 647725 - DNA, 25 bp, Homo sapien
tctcctgcagaaggcacggtggctc

SEQ ID NO: 647726 - DNA, 25 bp, Homo sapien
ctcctgcagaaggcacggtggctca

SEQ ID NO: 647727 - DNA, 25 bp, Homo sapien
tttgccttatgatgcacactgctcc

SEQ ID NO: 647728 - DNA, 25 bp, Homo sapien
tcccagggtctgcagagatgaacta

SEQ ID NO: 647729 - DNA, 25 bp, Homo sapien
gaactatgctgttttaggtctcatt

SEQ ID NO: 647730 - DNA, 25 bp, Homo sapien
gctgttttaggtctcattggtcctt

SEQ ID NO: 647731 - DNA, 25 bp, Homo sapien
tcattggtccttataccttccctaa

SEQ ID NO: 647732 - DNA, 25 bp, Homo sapien
actttggagcctgctgacacaggga

SEQ ID NO: 647733 - DNA, 25 bp, Homo sapien
tgctgacacagggagttctacatgt

SEQ ID NO: 647734 - DNA, 25 bp, Homo sapien
gttctacatgtctaagcacgcagct

SEQ ID NO: 647735 - DNA, 25 bp, Homo sapien
agagtcctcagccatctgagctaaa

SEQ ID NO: 647736 - DNA, 25 bp, Homo sapien
agctgctcagagacaattagtacac

SEQ ID NO: 647737 - DNA, 25 bp, Homo sapien
aactgaagtccaaacaagccaagct

SEQ ID NO: 647738 - DNA, 25 bp, Homo sapien
aaaacaaatcagccgggcggctact

SEQ ID NO: 647739 - DNA, 25 bp, Homo sapien
aaacaaatcagccgggcggctactc

SEQ ID NO: 647740 - DNA, 25 bp, Homo sapien
aacaaatcagccgggcggctactca

SEQ ID NO: 647741 - DNA, 25 bp, Homo sapien
acaaatcagccgggcggctactcag

SEQ ID NO: 647742 - DNA, 25 bp, Homo sapien
caaatcagccgggcggctactcagg

SEQ ID NO: 647743 - DNA, 25 bp, Homo sapien
aaatcagccgggcggctactcagga

SEQ ID NO: 647744 - DNA, 25 bp, Homo sapien
aatcagccgggcggctactcaggag

SEQ ID NO: 647745 - DNA, 25 bp, Homo sapien
atcagccgggcggctactcaggagg

SEQ ID NO: 647746 - DNA, 25 bp, Homo sapien
gaggctgggcccacaacaaggagat

SEQ ID NO: 647747 - DNA, 25 bp, Homo sapien
caacaaggagatggccaggcaggat

SEQ ID NO: 647748 - DNA, 25 bp, Homo sapien
acactctgctgcctagagcatggag

SEQ ID NO: 647749 - DNA, 25 bp, Homo sapien
actctgctgcctagagcatggaggt

SEQ ID NO: 647750 - DNA, 25 bp, Homo sapien
gggtctgtgccttgagcctcacgga

SEQ ID NO: 647751 - DNA, 25 bp, Homo sapien
tctgtgccttgagcctcacggagag

SEQ ID NO: 647752 - DNA, 25 bp, Homo sapien
gtaggtgtcagtaaatctctcttga

SEQ ID NO: 647753 - DNA, 25 bp, Homo sapien
tctctcttgacttaagtagatgctg

SEQ ID NO: 647754 - DNA, 25 bp, Homo sapien
agtagatgctgttaggtccacctta

SEQ ID NO: 647755 - DNA, 25 bp, Homo sapien
gatgctgttaggtccaccttacaga

SEQ ID NO: 647756 - DNA, 25 bp, Homo sapien
tgttaggtccaccttacagataaag

SEQ ID NO: 647757 - DNA, 25 bp, Homo sapien
atttaacctttgtcttcttggcatg

SEQ ID NO: 647758 - DNA, 25 bp, Homo sapien
tttaacctttgtcttcttggcatgt

SEQ ID NO: 647759 - DNA, 25 bp, Homo sapien
ttaacctttgtcttcttggcatgtt

SEQ ID NO: 647760 - DNA, 25 bp, Homo sapien
taacctttgtcttcttggcatgtta

SEQ ID NO: 647761 - DNA, 25 bp, Homo sapien
aacctttgtcttcttggcatgttaa

SEQ ID NO: 647762 - DNA, 25 bp, Homo sapien
tcttggcatgttaaaaatatcttct

SEQ ID NO: 647763 - DNA, 25 bp, Homo sapien
cttggcatgttaaaaatatcttctg

SEQ ID NO: 647764 - DNA, 25 bp, Homo sapien
ttggcatgttaaaaatatcttctgg

SEQ ID NO: 647765 - DNA, 25 bp, Homo sapien
aaaatatcttctggcggctgggcgc

SEQ ID NO: 647766 - DNA, 25 bp, Homo sapien
aaatatcttctggcggctgggcgcg

SEQ ID NO: 647767 - DNA, 25 bp, Homo sapien
atatcttctggcggctgggcgcggt

SEQ ID NO: 647768 - DNA, 25 bp, Homo sapien
gaggcttaattgaaggctgggccct

SEQ ID NO: 647769 - DNA, 25 bp, Homo sapien
taattgaaggctgggccctacttcc

SEQ ID NO: 647770 - DNA, 25 bp, Homo sapien
cttaccccagatctttttggaccat

SEQ ID NO: 647771 - DNA, 25 bp, Homo sapien
agatctttttggaccatcaccaggt

SEQ ID NO: 647772 - DNA, 25 bp, Homo sapien
atcaccaggtctcttctagactttt

SEQ ID NO: 647773 - DNA, 25 bp, Homo sapien
aggtctcttctagactttttcttct

SEQ ID NO: 647774 - DNA, 25 bp, Homo sapien
tctagactttttcttctcccgagta

SEQ ID NO: 647775 - DNA, 25 bp, Homo sapien
tttcttctcccgagtaacttgaaat

SEQ ID NO: 647776 - DNA, 25 bp, Homo sapien
gtaacttgaaattgcctggtcccag

SEQ ID NO: 647777 - DNA, 25 bp, Homo sapien
tggtcccaggcaccttgacttggag

SEQ ID NO: 647778 - DNA, 25 bp, Homo sapien
tcccaggcaccttgacttggagaag

SEQ ID NO: 647779 - DNA, 25 bp, Homo sapien
cggacgtgcctgacgtgccagccag

SEQ ID NO: 647780 - DNA, 25 bp, Homo sapien
gacctgatccgccagctgctgtgtc

SEQ ID NO: 647781 - DNA, 25 bp, Homo sapien
cagctgctgtgtcgccaggaagagc

SEQ ID NO: 647782 - DNA, 25 bp, Homo sapien
tcgccaggaagagcggctaggccgt

SEQ ID NO: 647783 - DNA, 25 bp, Homo sapien
ctaggccgtggtgggctggatgact

SEQ ID NO: 647784 - DNA, 25 bp, Homo sapien
ttccggaaccatcctttcttcgaag

SEQ ID NO: 647785 - DNA, 25 bp, Homo sapien
ctttcttcgaaggcgtggactggga

SEQ ID NO: 647786 - DNA, 25 bp, Homo sapien
ggccccctatattcctgagctgcgg

SEQ ID NO: 647787 - DNA, 25 bp, Homo sapien
gggacccatggacacctccaacttt

SEQ ID NO: 647788 - DNA, 25 bp, Homo sapien
ccatggacacctccaactttgatgt

SEQ ID NO: 647789 - DNA, 25 bp, Homo sapien
actttgatgtggatgacgacaccct

SEQ ID NO: 647790 - DNA, 25 bp, Homo sapien
tttagcatttctctttgactctttt

SEQ ID NO: 647791 - DNA, 25 bp, Homo sapien
tagttctctgaaattccccatctgt

SEQ ID NO: 647792 - DNA, 25 bp, Homo sapien
gaaattccccatctgtttatgtaat

SEQ ID NO: 647793 - DNA, 25 bp, Homo sapien
atggttgttttaaacaccctgtctg

SEQ ID NO: 647794 - DNA, 25 bp, Homo sapien
aaacaccctgtctgatagttccaat

SEQ ID NO: 647795 - DNA, 25 bp, Homo sapien
gatagttccaatctctggttcatct

SEQ ID NO: 647796 - DNA, 25 bp, Homo sapien
aatctctggttcatctctgactttg

SEQ ID NO: 647797 - DNA, 25 bp, Homo sapien
catctctgactttggttcagctgat

SEQ ID NO: 647798 - DNA, 25 bp, Homo sapien
tcagctgattgctttatctcttgac

SEQ ID NO: 647799 - DNA, 25 bp, Homo sapien
ttatctcttgacaatggtttgggtt

SEQ ID NO: 647800 - DNA, 25 bp, Homo sapien
tttcctgttttttgtagatctcata

SEQ ID NO: 647801 - DNA, 25 bp, Homo sapien
gaggatattttccatttggcagcaa

SEQ ID NO: 647802 - DNA, 25 bp, Homo sapien
tttccatttggcagcaaccttgtat

SEQ ID NO: 647803 - DNA, 25 bp, Homo sapien
gcagcaaccttgtatgtctgtgtct

SEQ ID NO: 647804 - DNA, 25 bp, Homo sapien
gctccccaggatgttcaacctgata

SEQ ID NO: 647805 - DNA, 25 bp, Homo sapien
gacacgataatgttcctatggcaga

SEQ ID NO: 647806 - DNA, 25 bp, Homo sapien
taatgttcctatggcagaaatgcaa

SEQ ID NO: 647807 - DNA, 25 bp, Homo sapien
gcaaattaggaattcagcggctcaa

SEQ ID NO: 647808 - DNA, 25 bp, Homo sapien
tcagcggctcaatatatccagaaat

SEQ ID NO: 647809 - DNA, 25 bp, Homo sapien
gaaatgactatgcaaaattcaccca

SEQ ID NO: 647810 - DNA, 25 bp, Homo sapien
cattgacattgtggtagtggcagaa

SEQ ID NO: 647811 - DNA, 25 bp, Homo sapien
ggcagaagtcacattacggttaagt

SEQ ID NO: 647812 - DNA, 25 bp, Homo sapien
tgatttctaatggattgtggaaatt

SEQ ID NO: 647813 - DNA, 25 bp, Homo sapien
gattgtggaaatttattgtcactct

SEQ ID NO: 647814 - DNA, 25 bp, Homo sapien
attgtggaaatttattgtcactcta

SEQ ID NO: 647815 - DNA, 25 bp, Homo sapien
ttgtggaaatttattgtcactctat

SEQ ID NO: 647816 - DNA, 25 bp, Homo sapien
tgtggaaatttattgtcactctata

SEQ ID NO: 647817 - DNA, 25 bp, Homo sapien
gtggaaatttattgtcactctatag

SEQ ID NO: 647818 - DNA, 25 bp, Homo sapien
tggaaatttattgtcactctataga

SEQ ID NO: 647819 - DNA, 25 bp, Homo sapien
tctttaaatgataggtttgatttct

SEQ ID NO: 647820 - DNA, 25 bp, Homo sapien
ctttaaatgataggtttgatttcta

SEQ ID NO: 647821 - DNA, 25 bp, Homo sapien
aaatgataggtttgatttctaatgg

SEQ ID NO: 647822 - DNA, 25 bp, Homo sapien
aatgataggtttgatttctaatgga

SEQ ID NO: 647823 - DNA, 25 bp, Homo sapien
accttcaacctcttccgcctcctca

SEQ ID NO: 647824 - DNA, 25 bp, Homo sapien
ccttcaacctcttccgcctcctcac

SEQ ID NO: 647825 - DNA, 25 bp, Homo sapien
cttcaacctcttccgcctcctcacg

SEQ ID NO: 647826 - DNA, 25 bp, Homo sapien
ttcaacctcttccgcctcctcacgc

SEQ ID NO: 647827 - DNA, 25 bp, Homo sapien
aacctcttccgcctcctcacgcgag

SEQ ID NO: 647828 - DNA, 25 bp, Homo sapien
acctcttccgcctcctcacgcgaga

SEQ ID NO: 647829 - DNA, 25 bp, Homo sapien
cctcttccgcctcctcacgcgagac

SEQ ID NO: 647830 - DNA, 25 bp, Homo sapien
ctcttccgcctcctcacgcgagacc

SEQ ID NO: 647831 - DNA, 25 bp, Homo sapien
tcttccgcctcctcacgcgagacct

SEQ ID NO: 647832 - DNA, 25 bp, Homo sapien
gtggcagtaccttaactatatgcgt

SEQ ID NO: 647833 - DNA, 25 bp, Homo sapien
atatgcgtgtcgtcaggcccaaggg

SEQ ID NO: 647834 - DNA, 25 bp, Homo sapien
aagggcctcttccatccttgtcaag

SEQ ID NO: 647835 - DNA, 25 bp, Homo sapien
taaccttctctcctttcatacaatc

SEQ ID NO: 647836 - DNA, 25 bp, Homo sapien
atacaatccagctctcttattttga

SEQ ID NO: 647837 - DNA, 25 bp, Homo sapien
atacatgttggttgagaccggtgca

SEQ ID NO: 647838 - DNA, 25 bp, Homo sapien
gtctggtaggttcgaggactaactc

SEQ ID NO: 647839 - DNA, 25 bp, Homo sapien
cgaggactaactccatcgcttggga

SEQ ID NO: 647840 - DNA, 25 bp, Homo sapien
catcgcttgggagcatgtggccttg

SEQ ID NO: 647841 - DNA, 25 bp, Homo sapien
gcaagttacttaatccactgggaac

SEQ ID NO: 647842 - DNA, 25 bp, Homo sapien
gggatactgtctgggattcccatcc

SEQ ID NO: 647843 - DNA, 25 bp, Homo sapien
ggctgctatgcttagaaagacctgc

SEQ ID NO: 647844 - DNA, 25 bp, Homo sapien
aggcatggccgtcatctgggaactt

SEQ ID NO: 647845 - DNA, 25 bp, Homo sapien
accttccccagaattgataagcgtg

SEQ ID NO: 647846 - DNA, 25 bp, Homo sapien
gataagcgtggctcacagtacctaa

SEQ ID NO: 647847 - DNA, 25 bp, Homo sapien
ggctcacagtacctaaacagacgat

SEQ ID NO: 647848 - DNA, 25 bp, Homo sapien
gtggtatatgttgaacttctgcttt

SEQ ID NO: 647849 - DNA, 25 bp, Homo sapien
gcagacaataaaagccttgggccct

SEQ ID NO: 647850 - DNA, 25 bp, Homo sapien
gggccctgagtctctaagaagtatt

SEQ ID NO: 647851 - DNA, 25 bp, Homo sapien
gaagtattcctggtagacagcattt

SEQ ID NO: 647852 - DNA, 25 bp, Homo sapien
ggtagacagcatttaacacatggca

SEQ ID NO: 647853 - DNA, 25 bp, Homo sapien
acacatggcatgacttgttgctgga

SEQ ID NO: 647854 - DNA, 25 bp, Homo sapien
aaggctctgggccagccagtccctg

SEQ ID NO: 647855 - DNA, 25 bp, Homo sapien
agtccctgttttactggcaccacgg

SEQ ID NO: 647856 - DNA, 25 bp, Homo sapien
tgttttactggcaccacggtccctc

SEQ ID NO: 647857 - DNA, 25 bp, Homo sapien
cggtccctcctaggcgaggacgaag

SEQ ID NO: 647858 - DNA, 25 bp, Homo sapien
agacctccaccttctctgcgtgtgg

SEQ ID NO: 647859 - DNA, 25 bp, Homo sapien
gtggctgcgtccctttacagaatga

SEQ ID NO: 647860 - DNA, 25 bp, Homo sapien
tttacagaatgacaggcccttactt

SEQ ID NO: 647861 - DNA, 25 bp, Homo sapien
gaatgacaggcccttacttccgagg

SEQ ID NO: 647862 - DNA, 25 bp, Homo sapien
gggactaatgtgtaaggcttaacag

SEQ ID NO: 647863 - DNA, 25 bp, Homo sapien
gcttaacagatccaattccagaaat

SEQ ID NO: 647864 - DNA, 25 bp, Homo sapien
tctgtgtttttttcaatcaccctct

SEQ ID NO: 647865 - DNA, 25 bp, Homo sapien
ggaagcctctataacaaggctgctc

SEQ ID NO: 647866 - DNA, 25 bp, Homo sapien
ccaagcacatcattctgatgcaggt

SEQ ID NO: 647867 - DNA, 25 bp, Homo sapien
ctgtaaaaggccaaatagactgtat

SEQ ID NO: 647868 - DNA, 25 bp, Homo sapien
aaggccaaatagactgtatggacca

SEQ ID NO: 647869 - DNA, 25 bp, Homo sapien
tacagtctctgttaaaactacagta

SEQ ID NO: 647870 - DNA, 25 bp, Homo sapien
aactacagtagtcacttctgctaga

SEQ ID NO: 647871 - DNA, 25 bp, Homo sapien
agtagtcacttctgctagagtgaaa

SEQ ID NO: 647872 - DNA, 25 bp, Homo sapien
agagtgaaagcagccttacatatgt

SEQ ID NO: 647873 - DNA, 25 bp, Homo sapien
aaatgagtcaggtatggctaggttc

SEQ ID NO: 647874 - DNA, 25 bp, Homo sapien
gtcaggtatggctaggttccaataa

SEQ ID NO: 647875 - DNA, 25 bp, Homo sapien
gtatggctaggttccaataaattat

SEQ ID NO: 647876 - DNA, 25 bp, Homo sapien
ttcacaacagccatgaacgcctttg

SEQ ID NO: 647877 - DNA, 25 bp, Homo sapien
acaacagccatgaacgcctttggag

SEQ ID NO: 647878 - DNA, 25 bp, Homo sapien
aacagccatgaacgcctttggagac

SEQ ID NO: 647879 - DNA, 25 bp, Homo sapien
acacgtgaccacagtttagatgaac

SEQ ID NO: 647880 - DNA, 25 bp, Homo sapien
cacgtgaccacagtttagatgaaca

SEQ ID NO: 647881 - DNA, 25 bp, Homo sapien
acgtgaccacagtttagatgaacaa

SEQ ID NO: 647882 - DNA, 25 bp, Homo sapien
cgtgaccacagtttagatgaacaat

SEQ ID NO: 647883 - DNA, 25 bp, Homo sapien
gtgaccacagtttagatgaacaatg

SEQ ID NO: 647884 - DNA, 25 bp, Homo sapien
gaccacagtttagatgaacaatgga

SEQ ID NO: 647885 - DNA, 25 bp, Homo sapien
acagtttagatgaacaatggaccaa

SEQ ID NO: 647886 - DNA, 25 bp, Homo sapien
gtttagatgaacaatggaccaagtg

SEQ ID NO: 647887 - DNA, 25 bp, Homo sapien
ccgctcagctgaagcccctccagat

SEQ ID NO: 647888 - DNA, 25 bp, Homo sapien
tccagatgccacaggcgcccctgca

SEQ ID NO: 647889 - DNA, 25 bp, Homo sapien
acaggcgcccctgcagccgcttgct

SEQ ID NO: 647890 - DNA, 25 bp, Homo sapien
gcagatgcccccgattcctgttgtg

SEQ ID NO: 647891 - DNA, 25 bp, Homo sapien
agatgcccccgattcctgttgtgcc

SEQ ID NO: 647892 - DNA, 25 bp, Homo sapien
catcacgcccctggcgggaatcgac

SEQ ID NO: 647893 - DNA, 25 bp, Homo sapien
gcccctggcgggaatcgacggcctc

SEQ ID NO: 647894 - DNA, 25 bp, Homo sapien
tggcgggaatcgacggcctccctcc

SEQ ID NO: 647895 - DNA, 25 bp, Homo sapien
ccagacctgccgaccgcgactgtgc

SEQ ID NO: 647896 - DNA, 25 bp, Homo sapien
gaccgcgactgtgcctcccgtgcca

SEQ ID NO: 647897 - DNA, 25 bp, Homo sapien
gtgccaccacctcagtatttctctc

SEQ ID NO: 647898 - DNA, 25 bp, Homo sapien
tgtgccccccacaggggactccgag

SEQ ID NO: 647899 - DNA, 25 bp, Homo sapien
gtgccccccacaggggactccgagg

SEQ ID NO: 647900 - DNA, 25 bp, Homo sapien
gactccgaggccactcccgtgcccc

SEQ ID NO: 647901 - DNA, 25 bp, Homo sapien
tgccccccacgggtgactccgagac

SEQ ID NO: 647902 - DNA, 25 bp, Homo sapien
gggtgactccgagaccgcccccgtg

SEQ ID NO: 647903 - DNA, 25 bp, Homo sapien
gcccccgtgccgcccacgggtgact

SEQ ID NO: 647904 - DNA, 25 bp, Homo sapien
cgtgccgcccacgggtgactccggg

SEQ ID NO: 647905 - DNA, 25 bp, Homo sapien
gtgccgcccacgggtgactccgggg

SEQ ID NO: 647906 - DNA, 25 bp, Homo sapien
tgccgcccacgggtgactccggggc

SEQ ID NO: 647907 - DNA, 25 bp, Homo sapien
gatttcaaacttgtgactttcaagg

SEQ ID NO: 647908 - DNA, 25 bp, Homo sapien
gtgactttcaaggtttttatgctgt

SEQ ID NO: 647909 - DNA, 25 bp, Homo sapien
aaggtttttatgctgtctttctcac

SEQ ID NO: 647910 - DNA, 25 bp, Homo sapien
tatgctgtctttctcacccaataag

SEQ ID NO: 647911 - DNA, 25 bp, Homo sapien
tttctcacccaataagttcttacag

SEQ ID NO: 647912 - DNA, 25 bp, Homo sapien
acaagactactgcagtcatagattt

SEQ ID NO: 647913 - DNA, 25 bp, Homo sapien
ttctgcttctggtgttcttttggat

SEQ ID NO: 647914 - DNA, 25 bp, Homo sapien
tggattatcctttttctatgttcaa

SEQ ID NO: 647915 - DNA, 25 bp, Homo sapien
gtactgcatgtaaaccatgctcttt

SEQ ID NO: 647916 - DNA, 25 bp, Homo sapien
gagtattttccatcactagagcata

SEQ ID NO: 647917 - DNA, 25 bp, Homo sapien
ttgtacacagtgagtccttaataaa

SEQ ID NO: 647918 - DNA, 25 bp, Homo sapien
aaaaaagcccacattcgacaagact

SEQ ID NO: 647919 - DNA, 25 bp, Homo sapien
tcctgttggagcagtctggaattga

SEQ ID NO: 647920 - DNA, 25 bp, Homo sapien
gagcagtctggaattgatatcctta

SEQ ID NO: 647921 - DNA, 25 bp, Homo sapien
tgatatccttaacaaaattagtgaa

SEQ ID NO: 647922 - DNA, 25 bp, Homo sapien
agtggcctcgttcctgtctgataga

SEQ ID NO: 647923 - DNA, 25 bp, Homo sapien
gcctcgttcctgtctgatagaattg

SEQ ID NO: 647924 - DNA, 25 bp, Homo sapien
gaattgtggatgaaatcctggatgc

SEQ ID NO: 647925 - DNA, 25 bp, Homo sapien
ctctcacattgccatcataaactgg

SEQ ID NO: 647926 - DNA, 25 bp, Homo sapien
atcataaactggctgaccatttcag

SEQ ID NO: 647927 - DNA, 25 bp, Homo sapien
ctgaccatttcagcagacgtggcaa

SEQ ID NO: 647928 - DNA, 25 bp, Homo sapien
tttcagcagacgtggcaagaccctt

SEQ ID NO: 647929 - DNA, 25 bp, Homo sapien
atcccatattccgacctgactgagg

SEQ ID NO: 647930 - DNA, 25 bp, Homo sapien
gacctgactgaggagttttatccag

SEQ ID NO: 647931 - DNA, 25 bp, Homo sapien
tatccagtcacttctgtgttacctg

SEQ ID NO: 647932 - DNA, 25 bp, Homo sapien
tcacttctgtgttacctgtcatttc

SEQ ID NO: 647933 - DNA, 25 bp, Homo sapien
acccttagtgccttgtagatttgga

SEQ ID NO: 647934 - DNA, 25 bp, Homo sapien
atggtagaatattcttctcgctctt

SEQ ID NO: 647935 - DNA, 25 bp, Homo sapien
atattcttctcgctcttttgtgttg

SEQ ID NO: 647936 - DNA, 25 bp, Homo sapien
tctcgctcttttgtgttggtttatg

SEQ ID NO: 647937 - DNA, 25 bp, Homo sapien
ttttgtctttcaatgaggcttgtgt

SEQ ID NO: 647938 - DNA, 25 bp, Homo sapien
gaggcttgtgttttgcactctcaat

SEQ ID NO: 647939 - DNA, 25 bp, Homo sapien
tgtgttttgcactctcaattttaaa

SEQ ID NO: 647940 - DNA, 25 bp, Homo sapien
atctcctcttcactagattctatag

SEQ ID NO: 647941 - DNA, 25 bp, Homo sapien
tatagaagcatagccatgcctgccc

SEQ ID NO: 647942 - DNA, 25 bp, Homo sapien
tttctctactgacttgttgcaatga

SEQ ID NO: 647943 - DNA, 25 bp, Homo sapien
atatcctaccttggtgcttgcttag

SEQ ID NO: 647944 - DNA, 25 bp, Homo sapien
gcttgcttagataactccacactgt

SEQ ID NO: 647945 - DNA, 25 bp, Homo sapien
ccacactgtgatgcctaatgaccta

SEQ ID NO: 647946 - DNA, 25 bp, Homo sapien
aatgacctacacagggctttctagc

SEQ ID NO: 647947 - DNA, 25 bp, Homo sapien
acagggctttctagcaaggagtgac

SEQ ID NO: 647948 - DNA, 25 bp, Homo sapien
aaggagtgactttctttctgctacg

SEQ ID NO: 647949 - DNA, 25 bp, Homo sapien
gactttctttctgctacgtgtaata

SEQ ID NO: 647950 - DNA, 25 bp, Homo sapien
atatttccagcagacggtttcttga

SEQ ID NO: 647951 - DNA, 25 bp, Homo sapien
tttgctggggaaagtgatagtctaa

SEQ ID NO: 647952 - DNA, 25 bp, Homo sapien
aagtgatagtctaagagaaagaaac

SEQ ID NO: 647953 - DNA, 25 bp, Homo sapien
agtgatagtctaagagaaagaaaca

SEQ ID NO: 647954 - DNA, 25 bp, Homo sapien
gtgatagtctaagagaaagaaacat

SEQ ID NO: 647955 - DNA, 25 bp, Homo sapien
gatagtctaagagaaagaaacatag

SEQ ID NO: 647956 - DNA, 25 bp, Homo sapien
agaaacatagattgtgatatttggg

SEQ ID NO: 647957 - DNA, 25 bp, Homo sapien
gaaacatagattgtgatatttggga

SEQ ID NO: 647958 - DNA, 25 bp, Homo sapien
aaacatagattgtgatatttgggag

SEQ ID NO: 647959 - DNA, 25 bp, Homo sapien
aacatagattgtgatatttgggagg

SEQ ID NO: 647960 - DNA, 25 bp, Homo sapien
acatagattgtgatatttgggaggc

SEQ ID NO: 647961 - DNA, 25 bp, Homo sapien
gggaggacctgtctgaccacaaaca

SEQ ID NO: 647962 - DNA, 25 bp, Homo sapien
tgaccacaaacaacccacctgagga

SEQ ID NO: 647963 - DNA, 25 bp, Homo sapien
aaacaacccacctgaggaggccctg

SEQ ID NO: 647964 - DNA, 25 bp, Homo sapien
agagttctcctagttccttgcaagg

SEQ ID NO: 647965 - DNA, 25 bp, Homo sapien
ttctcctagttccttgcaaggagcc

SEQ ID NO: 647966 - DNA, 25 bp, Homo sapien
ggacttttaaaccaatgcccagcta

SEQ ID NO: 647967 - DNA, 25 bp, Homo sapien
aaacatctcaggcagttcgcggata

SEQ ID NO: 647968 - DNA, 25 bp, Homo sapien
atctcaggcagttcgcggatagaag

SEQ ID NO: 647969 - DNA, 25 bp, Homo sapien
ggaaataatattaagagcctgccat

SEQ ID NO: 647970 - DNA, 25 bp, Homo sapien
aagagcctgccatatgttgaatgtt

SEQ ID NO: 647971 - DNA, 25 bp, Homo sapien
gttgaatgtttactatgtctcagca

SEQ ID NO: 647972 - DNA, 25 bp, Homo sapien
cctcacgcgagacctcaaatatgtg

SEQ ID NO: 647973 - DNA, 25 bp, Homo sapien
acctcaaatatgtggccgatgggaa

SEQ ID NO: 647974 - DNA, 25 bp, Homo sapien
tatgtggccgatgggaacctgtgtc

SEQ ID NO: 647975 - DNA, 25 bp, Homo sapien
acctgtgtctgagaacgtcaaccca

SEQ ID NO: 647976 - DNA, 25 bp, Homo sapien
tgagaacgtcaacccaccctgagtc

SEQ ID NO: 647977 - DNA, 25 bp, Homo sapien
tgacaccccacaccttatttatgcg

SEQ ID NO: 647978 - DNA, 25 bp, Homo sapien
cccacaccttatttatgcgctgagc

SEQ ID NO: 647979 - DNA, 25 bp, Homo sapien
caccttatttatgcgctgagcccta

SEQ ID NO: 647980 - DNA, 25 bp, Homo sapien
ttatttcctctcaccctttatttat

SEQ ID NO: 647981 - DNA, 25 bp, Homo sapien
tttcctctcaccctttatttatgaa

SEQ ID NO: 647982 - DNA, 25 bp, Homo sapien
cctctcaccctttatttatgaagct

SEQ ID NO: 647983 - DNA, 25 bp, Homo sapien
gttggtttgcctatgaaaggagtac

SEQ ID NO: 647984 - DNA, 25 bp, Homo sapien
gtttgcctatgaaaggagtactcaa

SEQ ID NO: 647985 - DNA, 25 bp, Homo sapien
gcctatgaaaggagtactcaaaggt

SEQ ID NO: 647986 - DNA, 25 bp, Homo sapien
aaaggtgagtttactatctctaatg

SEQ ID NO: 647987 - DNA, 25 bp, Homo sapien
tctctaatgaaaaagctaatcctgg

SEQ ID NO: 647988 - DNA, 25 bp, Homo sapien
aatgaaaaagctaatcctggcaggg

SEQ ID NO: 647989 - DNA, 25 bp, Homo sapien
gtgtcagcaaggaccctgatgtcaa

SEQ ID NO: 647990 - DNA, 25 bp, Homo sapien
aggaccctgatgtcaaaacatcaaa

SEQ ID NO: 647991 - DNA, 25 bp, Homo sapien
aaaagacatgcttaatacagaagtt

SEQ ID NO: 647992 - DNA, 25 bp, Homo sapien
gacatgcttaatacagaagttaata

SEQ ID NO: 647993 - DNA, 25 bp, Homo sapien
aacaatggaggaaatcaatgaaacc

SEQ ID NO: 647994 - DNA, 25 bp, Homo sapien
tatttttgaggtcttatcctaaaag

SEQ ID NO: 647995 - DNA, 25 bp, Homo sapien
ttttgaggtcttatcctaaaaggca

SEQ ID NO: 647996 - DNA, 25 bp, Homo sapien
gaggtcttatcctaaaaggcatcta

SEQ ID NO: 647997 - DNA, 25 bp, Homo sapien
ggtcttatcctaaaaggcatctaag

SEQ ID NO: 647998 - DNA, 25 bp, Homo sapien
aaggcatctaaggtacatgaatgga

SEQ ID NO: 647999 - DNA, 25 bp, Homo sapien
gcatctaaggtacatgaatggagta

SEQ ID NO: 648000 - DNA, 25 bp, Homo sapien
gaatggagtatggtgattttataac

SEQ ID NO: 648001 - DNA, 25 bp, Homo sapien
taacattttttatcagaatggaaaa

SEQ ID NO: 648002 - DNA, 25 bp, Homo sapien
ttttttgcttactctggtaatgatt

SEQ ID NO: 648003 - DNA, 25 bp, Homo sapien
gcttactctggtaatgattttctac

SEQ ID NO: 648004 - DNA, 25 bp, Homo sapien
actctggtaatgattttctacaaat

SEQ ID NO: 648005 - DNA, 25 bp, Homo sapien
caggttggttgtcttggtatcgttt

SEQ ID NO: 648006 - DNA, 25 bp, Homo sapien
gttggttgtcttggtatcgtttagt

SEQ ID NO: 648007 - DNA, 25 bp, Homo sapien
ttggttgtcttggtatcgtttagta

SEQ ID NO: 648008 - DNA, 25 bp, Homo sapien
tggttgtcttggtatcgtttagtaa

SEQ ID NO: 648009 - DNA, 25 bp, Homo sapien
ggttgtcttggtatcgtttagtaag

SEQ ID NO: 648010 - DNA, 25 bp, Homo sapien
gttgtcttggtatcgtttagtaaga

SEQ ID NO: 648011 - DNA, 25 bp, Homo sapien
tcttggtatcgtttagtaagaaaca

SEQ ID NO: 648012 - DNA, 25 bp, Homo sapien
tgcacacctgtagtgtcaccagtgg

SEQ ID NO: 648013 - DNA, 25 bp, Homo sapien
gcacacctgtagtgtcaccagtggc

SEQ ID NO: 648014 - DNA, 25 bp, Homo sapien
cacacctgtagtgtcaccagtggca

SEQ ID NO: 648015 - DNA, 25 bp, Homo sapien
acacctgtagtgtcaccagtggcac

SEQ ID NO: 648016 - DNA, 25 bp, Homo sapien
acaaaagtggccaggagcggtagct

SEQ ID NO: 648017 - DNA, 25 bp, Homo sapien
caaaagtggccaggagcggtagctc

SEQ ID NO: 648018 - DNA, 25 bp, Homo sapien
aaaagtggccaggagcggtagctca

SEQ ID NO: 648019 - DNA, 25 bp, Homo sapien
aaagtggccaggagcggtagctcat

SEQ ID NO: 648020 - DNA, 25 bp, Homo sapien
aagtggccaggagcggtagctcata

SEQ ID NO: 648021 - DNA, 25 bp, Homo sapien
tggccaggagcggtagctcatactt

SEQ ID NO: 648022 - DNA, 25 bp, Homo sapien
ggccaggagcggtagctcatacttg

SEQ ID NO: 648023 - DNA, 25 bp, Homo sapien
gctgggtgtgatggccacttgggag

SEQ ID NO: 648024 - DNA, 25 bp, Homo sapien
ctgggtgtgatggccacttgggagg

SEQ ID NO: 648025 - DNA, 25 bp, Homo sapien
tgggtgtgatggccacttgggaggc

SEQ ID NO: 648026 - DNA, 25 bp, Homo sapien
gggtgtgatggccacttgggaggct

SEQ ID NO: 648027 - DNA, 25 bp, Homo sapien
agagatcaaggcatcccctgcaaga

SEQ ID NO: 648028 - DNA, 25 bp, Homo sapien
tgcaagacagcagtggttccaaaat

SEQ ID NO: 648029 - DNA, 25 bp, Homo sapien
gtggttccaaaattcgtcagcctga

SEQ ID NO: 648030 - DNA, 25 bp, Homo sapien
cagcctgaaaggaatcgttctggaa

SEQ ID NO: 648031 - DNA, 25 bp, Homo sapien
gtactgtctttgatccaagtcttcc

SEQ ID NO: 648032 - DNA, 25 bp, Homo sapien
ctctctctactggtggcagtatgat

SEQ ID NO: 648033 - DNA, 25 bp, Homo sapien
ggcagtatgattcttggacgtcaac

SEQ ID NO: 648034 - DNA, 25 bp, Homo sapien
ggacgtcaacaacctgccacagaga

SEQ ID NO: 648035 - DNA, 25 bp, Homo sapien
agtattgttcgtttcatgcctgata

SEQ ID NO: 648036 - DNA, 25 bp, Homo sapien
tgcctgatagcccacaagtacctaa

SEQ ID NO: 648037 - DNA, 25 bp, Homo sapien
tttcttttattcctgagggtggcat

SEQ ID NO: 648038 - DNA, 25 bp, Homo sapien
tttcactgaggccatctatccgatt

SEQ ID NO: 648039 - DNA, 25 bp, Homo sapien
ttcactgaggccatctatccgattt

SEQ ID NO: 648040 - DNA, 25 bp, Homo sapien
actgaggccatctatccgatttcaa

SEQ ID NO: 648041 - DNA, 25 bp, Homo sapien
tgaggccatctatccgatttcaagg

SEQ ID NO: 648042 - DNA, 25 bp, Homo sapien
gaggccatctatccgatttcaagga

SEQ ID NO: 648043 - DNA, 25 bp, Homo sapien
ggccatctatccgatttcaaggaag

SEQ ID NO: 648044 - DNA, 25 bp, Homo sapien
atctatccgatttcaaggaagccaa

SEQ ID NO: 648045 - DNA, 25 bp, Homo sapien
tccgatttcaaggaagccaagggca

SEQ ID NO: 648046 - DNA, 25 bp, Homo sapien
cgatttcaaggaagccaagggcaca

SEQ ID NO: 648047 - DNA, 25 bp, Homo sapien
tttcaaggaagccaagggcacatct

SEQ ID NO: 648048 - DNA, 25 bp, Homo sapien
caaggaagccaagggcacatctcca

SEQ ID NO: 648049 - DNA, 25 bp, Homo sapien
ttgtcactctatagacatgagaatc

SEQ ID NO: 648050 - DNA, 25 bp, Homo sapien
gagaatctctgataccagctaatgt

SEQ ID NO: 648051 - DNA, 25 bp, Homo sapien
tcatttctttctttgttgatttcaa

SEQ ID NO: 648052 - DNA, 25 bp, Homo sapien
tttatgcaaacctgggccaaaggac

SEQ ID NO: 648053 - DNA, 25 bp, Homo sapien
gcaaacctgggccaaaggacagtta

SEQ ID NO: 648054 - DNA, 25 bp, Homo sapien
ggacagttagaagacgacggagttt

SEQ ID NO: 648055 - DNA, 25 bp, Homo sapien
gttagaagacgacggagtttcactc

SEQ ID NO: 648056 - DNA, 25 bp, Homo sapien
aaagcacagaaagccgaacaagacc

SEQ ID NO: 648057 - DNA, 25 bp, Homo sapien
ggtaattcatccgattcaaaattgt

SEQ ID NO: 648058 - DNA, 25 bp, Homo sapien
aattcatccgattcaaaattgtttt

SEQ ID NO: 648059 - DNA, 25 bp, Homo sapien
gtgtttcgtagtttttgaaatctga

SEQ ID NO: 648060 - DNA, 25 bp, Homo sapien
tggccctgacgctgaaggttctgga

SEQ ID NO: 648061 - DNA, 25 bp, Homo sapien
ccgctgacactgacccagccctggg

SEQ ID NO: 648062 - DNA, 25 bp, Homo sapien
cagccctgggggatgtcttggacca

SEQ ID NO: 648063 - DNA, 25 bp, Homo sapien
gggatgtcttggaccagccccttca

SEQ ID NO: 648064 - DNA, 25 bp, Homo sapien
cctcacgcgagacctgaattgtgtt

SEQ ID NO: 648065 - DNA, 25 bp, Homo sapien
ctcacgcgagacctgaattgtgttg

SEQ ID NO: 648066 - DNA, 25 bp, Homo sapien
tcacgcgagacctgaattgtgttgc

SEQ ID NO: 648067 - DNA, 25 bp, Homo sapien
cacgcgagacctgaattgtgttgcc

SEQ ID NO: 648068 - DNA, 25 bp, Homo sapien
gcgagacctgaattgtgttgccagc

SEQ ID NO: 648069 - DNA, 25 bp, Homo sapien
agacctgaattgtgttgccagcggg

SEQ ID NO: 648070 - DNA, 25 bp, Homo sapien
aattgtgttgccagcggggacctgt

SEQ ID NO: 648071 - DNA, 25 bp, Homo sapien
gtatttgggattttaaatgcctttg

SEQ ID NO: 648072 - DNA, 25 bp, Homo sapien
ttaaaatgtagaattgcaggaccca

SEQ ID NO: 648073 - DNA, 25 bp, Homo sapien
gtagaattgcaggacccaaaaactt

SEQ ID NO: 648074 - DNA, 25 bp, Homo sapien
tgttttttgggcttgctattaatgc

SEQ ID NO: 648075 - DNA, 25 bp, Homo sapien
caaactctgattgcaaatggatgtc

SEQ ID NO: 648076 - DNA, 25 bp, Homo sapien
caaatggatgtcatgtttcatacct

SEQ ID NO: 648077 - DNA, 25 bp, Homo sapien
ggatgtcatgtttcatacctttttt

SEQ ID NO: 648078 - DNA, 25 bp, Homo sapien
tgtttcataccttttttatcaggaa

SEQ ID NO: 648079 - DNA, 25 bp, Homo sapien
gatgcctgacacaattgagctggac

SEQ ID NO: 648080 - DNA, 25 bp, Homo sapien
ttgagctggactttatgctgctctt

SEQ ID NO: 648081 - DNA, 25 bp, Homo sapien
gggactatgtgcactggcgtctaag

SEQ ID NO: 648082 - DNA, 25 bp, Homo sapien
gggcccgcgggcgacggaagagaga

SEQ ID NO: 648083 - DNA, 25 bp, Homo sapien
ctcctgagaaggcacctgtgtgtgt

SEQ ID NO: 648084 - DNA, 25 bp, Homo sapien
agagggcggcgttggccccaggcgg

SEQ ID NO: 648085 - DNA, 25 bp, Homo sapien
ccccaggcgggcatctgtttctggt

SEQ ID NO: 648086 - DNA, 25 bp, Homo sapien
ttctggtgggttgtcaggcctctta

SEQ ID NO: 648087 - DNA, 25 bp, Homo sapien
tggtgggttgtcaggcctcttacag

SEQ ID NO: 648088 - DNA, 25 bp, Homo sapien
gggttgtcaggcctcttacagcaag

SEQ ID NO: 648089 - DNA, 25 bp, Homo sapien
ttgtcaggcctcttacagcaagtac

SEQ ID NO: 648090 - DNA, 25 bp, Homo sapien
gtcaggcctcttacagcaagtactt

SEQ ID NO: 648091 - DNA, 25 bp, Homo sapien
ggcctcttacagcaagtacttaaca

SEQ ID NO: 648092 - DNA, 25 bp, Homo sapien
gtacttaacaaacttagatttccat

SEQ ID NO: 648093 - DNA, 25 bp, Homo sapien
tgggcgtattttgtgttggcatctc

SEQ ID NO: 648094 - DNA, 25 bp, Homo sapien
tgttggcatctctggcagttgtgaa

SEQ ID NO: 648095 - DNA, 25 bp, Homo sapien
gcagttgtgaagatcttgtaccaga

SEQ ID NO: 648096 - DNA, 25 bp, Homo sapien
atcttgtaccagagcgtggcgttgc

SEQ ID NO: 648097 - DNA, 25 bp, Homo sapien
tggcgttgctgtacgtgtcaggaac

SEQ ID NO: 648098 - DNA, 25 bp, Homo sapien
gaacacagtgcggtggctgtctgca

SEQ ID NO: 648099 - DNA, 25 bp, Homo sapien
gaaagacacgtgctcagtggcctga

SEQ ID NO: 648100 - DNA, 25 bp, Homo sapien
tggcctgagtcattcacttgtgtca

SEQ ID NO: 648101 - DNA, 25 bp, Homo sapien
agctggtaaaacactgaacacggca

SEQ ID NO: 648102 - DNA, 25 bp, Homo sapien
gaacacggcaacacacatggaaagg

SEQ ID NO: 648103 - DNA, 25 bp, Homo sapien
acttacacgttcatgcttctttgag

SEQ ID NO: 648104 - DNA, 25 bp, Homo sapien
agcagcagctaaaccagttccagca

SEQ ID NO: 648105 - DNA, 25 bp, Homo sapien
agcaacagcaaacatcccatttcca

SEQ ID NO: 648106 - DNA, 25 bp, Homo sapien
aacagcaaacatcccatttccaaca

SEQ ID NO: 648107 - DNA, 25 bp, Homo sapien
agcaaacatcccatttccaacaaca

SEQ ID NO: 648108 - DNA, 25 bp, Homo sapien
acaacaacagcttgggcggcgcggg

SEQ ID NO: 648109 - DNA, 25 bp, Homo sapien
ccgacatggagcagccgcaacatgg

SEQ ID NO: 648110 - DNA, 25 bp, Homo sapien
agcagccgcaacatggaggcgccaa

SEQ ID NO: 648111 - DNA, 25 bp, Homo sapien
gcagccgcaacatggaggcgccaag

SEQ ID NO: 648112 - DNA, 25 bp, Homo sapien
tggaggcgccaaggacagtgctgcg

SEQ ID NO: 648113 - DNA, 25 bp, Homo sapien
caaggacagtgctgcgggcggccag

SEQ ID NO: 648114 - DNA, 25 bp, Homo sapien
gctgctgagcaagccgggcgacgag

SEQ ID NO: 648115 - DNA, 25 bp, Homo sapien
ggtagataggactacaggttacaga

SEQ ID NO: 648116 - DNA, 25 bp, Homo sapien
gtagataggactacaggttacagat

SEQ ID NO: 648117 - DNA, 25 bp, Homo sapien
tagataggactacaggttacagata

SEQ ID NO: 648118 - DNA, 25 bp, Homo sapien
agataggactacaggttacagatat

SEQ ID NO: 648119 - DNA, 25 bp, Homo sapien
gataggactacaggttacagatata

SEQ ID NO: 648120 - DNA, 25 bp, Homo sapien
ataggactacaggttacagatatat

SEQ ID NO: 648121 - DNA, 25 bp, Homo sapien
taggactacaggttacagatatatg

SEQ ID NO: 648122 - DNA, 25 bp, Homo sapien
aggactacaggttacagatatatgc

SEQ ID NO: 648123 - DNA, 25 bp, Homo sapien
ggttgaccagcaaggacaaacatga

SEQ ID NO: 648124 - DNA, 25 bp, Homo sapien
caaagacaatctgcagggtggacat

SEQ ID NO: 648125 - DNA, 25 bp, Homo sapien
caatctgcagggtggacatggatgt

SEQ ID NO: 648126 - DNA, 25 bp, Homo sapien
ggacatggatgtattcgtttctgat

SEQ ID NO: 648127 - DNA, 25 bp, Homo sapien
gatgtattcgtttctgatcatgaga

SEQ ID NO: 648128 - DNA, 25 bp, Homo sapien
attcgtttctgatcatgagaagagg

SEQ ID NO: 648129 - DNA, 25 bp, Homo sapien
gaagaggctcttgtcatacatatcg

SEQ ID NO: 648130 - DNA, 25 bp, Homo sapien
ggctcttgtcatacatatcgttcca

SEQ ID NO: 648131 - DNA, 25 bp, Homo sapien
gtcatacatatcgttccatttttat

SEQ ID NO: 648132 - DNA, 25 bp, Homo sapien
ttctgaggtaaactgatttcttgga

SEQ ID NO: 648133 - DNA, 25 bp, Homo sapien
aactgatttcttggatgtacttaat

SEQ ID NO: 648134 - DNA, 25 bp, Homo sapien
atgaatcctgccttcacgctttcaa

SEQ ID NO: 648135 - DNA, 25 bp, Homo sapien
acgctttcaaatgccgagatggttt

SEQ ID NO: 648136 - DNA, 25 bp, Homo sapien
ggaattgagtaccatcctcctattt

SEQ ID NO: 648137 - DNA, 25 bp, Homo sapien
atcctcctatttttggtcgtgacac

SEQ ID NO: 648138 - DNA, 25 bp, Homo sapien
acacttggaacataatccctgtccc

SEQ ID NO: 648139 - DNA, 25 bp, Homo sapien
ccccaaggttgttcagtagttgaga

SEQ ID NO: 648140 - DNA, 25 bp, Homo sapien
gtctggtaccagatgcttaaattca

SEQ ID NO: 648141 - DNA, 25 bp, Homo sapien
agactagatctgacatttgtaagcc

SEQ ID NO: 648142 - DNA, 25 bp, Homo sapien
taagccattgtctctgggcaaatca

SEQ ID NO: 648143 - DNA, 25 bp, Homo sapien
caaatcatgtaactctgtgcctcag

SEQ ID NO: 648144 - DNA, 25 bp, Homo sapien
atatctctctcataaagctgttgtg

SEQ ID NO: 648145 - DNA, 25 bp, Homo sapien
gaccacacttagaaccacggctcta

SEQ ID NO: 648146 - DNA, 25 bp, Homo sapien
acacttagaaccacggctctacaag

SEQ ID NO: 648147 - DNA, 25 bp, Homo sapien
agaaccacggctctacaagaaagga

SEQ ID NO: 648148 - DNA, 25 bp, Homo sapien
cacggctctacaagaaaggagggtt

SEQ ID NO: 648149 - DNA, 25 bp, Homo sapien
aaggagggttatttgtcactgtgct

SEQ ID NO: 648150 - DNA, 25 bp, Homo sapien
gagggttatttgtcactgtgcttgc

SEQ ID NO: 648151 - DNA, 25 bp, Homo sapien
cactgtgcttgcctatgtacaacca

SEQ ID NO: 648152 - DNA, 25 bp, Homo sapien
gtgcttgcctatgtacaaccaccaa

SEQ ID NO: 648153 - DNA, 25 bp, Homo sapien
tgcctatgtacaaccaccaagaaag

SEQ ID NO: 648154 - DNA, 25 bp, Homo sapien
cctgagagttggcatttctgccaag

SEQ ID NO: 648155 - DNA, 25 bp, Homo sapien
tctgccaagtttccaggtgacgttg

SEQ ID NO: 648156 - DNA, 25 bp, Homo sapien
aggaagttgcagagtggattagcca

SEQ ID NO: 648157 - DNA, 25 bp, Homo sapien
agttgcagagtggattagccagcta

SEQ ID NO: 648158 - DNA, 25 bp, Homo sapien
tgcagagtggattagccagctaggc

SEQ ID NO: 648159 - DNA, 25 bp, Homo sapien
gagtggattagccagctaggcttcc

SEQ ID NO: 648160 - DNA, 25 bp, Homo sapien
gtggattagccagctaggcttccct

SEQ ID NO: 648161 - DNA, 25 bp, Homo sapien
ggattagccagctaggcttccctca

SEQ ID NO: 648162 - DNA, 25 bp, Homo sapien
attagccagctaggcttccctcaat

SEQ ID NO: 648163 - DNA, 25 bp, Homo sapien
agctaggcttccctcaatacaaggt

SEQ ID NO: 648164 - DNA, 25 bp, Homo sapien
gctaggcttccctcaatacaaggta

SEQ ID NO: 648165 - DNA, 25 bp, Homo sapien
taggcttccctcaatacaaggtata

SEQ ID NO: 648166 - DNA, 25 bp, Homo sapien
ggcttccctcaatacaaggtataca

SEQ ID NO: 648167 - DNA, 25 bp, Homo sapien
gaggcaggcactgaataaggtccca

SEQ ID NO: 648168 - DNA, 25 bp, Homo sapien
tgaataaggtcccaggcgctccttg

SEQ ID NO: 648169 - DNA, 25 bp, Homo sapien
gggcatcagaatgcggtgaccagca

SEQ ID NO: 648170 - DNA, 25 bp, Homo sapien
tgaccagcagcacacagcaaccagt

SEQ ID NO: 648171 - DNA, 25 bp, Homo sapien
ggctttaggcatggtcacttgggct

SEQ ID NO: 648172 - DNA, 25 bp, Homo sapien
ggcatggtcacttgggcttgcccag

SEQ ID NO: 648173 - DNA, 25 bp, Homo sapien
agggaacctcatcccggaggatctt

SEQ ID NO: 648174 - DNA, 25 bp, Homo sapien
aagcctgaggtctcctactaatgga

SEQ ID NO: 648175 - DNA, 25 bp, Homo sapien
tactaatggaactgtgactggctca

SEQ ID NO: 648176 - DNA, 25 bp, Homo sapien
ggaactgtgactggctcacccagag

SEQ ID NO: 648177 - DNA, 25 bp, Homo sapien
gaagcaaatgggattgactctaata

SEQ ID NO: 648178 - DNA, 25 bp, Homo sapien
ggatactctgatgtttcactgtgac

SEQ ID NO: 648179 - DNA, 25 bp, Homo sapien
gatgtttcactgtgacctttccatt

SEQ ID NO: 648180 - DNA, 25 bp, Homo sapien
gtattaagttgagcctacaagttca

SEQ ID NO: 648181 - DNA, 25 bp, Homo sapien
tatgattgcactacttgcattccag

SEQ ID NO: 648182 - DNA, 25 bp, Homo sapien
ctgtggttccctaaaaatagcttca

SEQ ID NO: 648183 - DNA, 25 bp, Homo sapien
gttttctgtgtgatgggaatggttt

SEQ ID NO: 648184 - DNA, 25 bp, Homo sapien
gttttactgattagatgactcactg

SEQ ID NO: 648185 - DNA, 25 bp, Homo sapien
atgactcactgtgggccattagata

SEQ ID NO: 648186 - DNA, 25 bp, Homo sapien
cactgtgggccattagatagcttta

SEQ ID NO: 648187 - DNA, 25 bp, Homo sapien
gtgggccattagatagctttaggat

SEQ ID NO: 648188 - DNA, 25 bp, Homo sapien
gctttaggatgggaactgccctcca

SEQ ID NO: 648189 - DNA, 25 bp, Homo sapien
aaaatctggcaaatcatttcaaaat

SEQ ID NO: 648190 - DNA, 25 bp, Homo sapien
gacatgttaacaaaattatctgact

SEQ ID NO: 648191 - DNA, 25 bp, Homo sapien
aattatctgacttactatattgaca

SEQ ID NO: 648192 - DNA, 25 bp, Homo sapien
attgctttgtttcttaaatcagttt

SEQ ID NO: 648193 - DNA, 25 bp, Homo sapien
gaacaatgatttcagacagtaccaa

SEQ ID NO: 648194 - DNA, 25 bp, Homo sapien
gatttcagacagtaccaagtcctag

SEQ ID NO: 648195 - DNA, 25 bp, Homo sapien
gacagtaccaagtcctagtaactta

SEQ ID NO: 648196 - DNA, 25 bp, Homo sapien
gtaccaagtcctagtaacttagaag

SEQ ID NO: 648197 - DNA, 25 bp, Homo sapien
gtattattaatgactgaagccatgt

SEQ ID NO: 648198 - DNA, 25 bp, Homo sapien
tacaattacattactacattcctat

SEQ ID NO: 648199 - DNA, 25 bp, Homo sapien
actacattcctatgtaccctaataa

SEQ ID NO: 648200 - DNA, 25 bp, Homo sapien
ggaggaagctgagtgcccgaaaact

SEQ ID NO: 648201 - DNA, 25 bp, Homo sapien
agctgagtgcccgaaaactcgccag

SEQ ID NO: 648202 - DNA, 25 bp, Homo sapien
gtgcccgaaaactcgccagagcaga

SEQ ID NO: 648203 - DNA, 25 bp, Homo sapien
aaaactcgccagagcagagtcggcc

SEQ ID NO: 648204 - DNA, 25 bp, Homo sapien
aaggatgctggccagcactgtccag

SEQ ID NO: 648205 - DNA, 25 bp, Homo sapien
gatgctggccagcactgtccagtag

SEQ ID NO: 648206 - DNA, 25 bp, Homo sapien
tggccagcactgtccagtagctgag

SEQ ID NO: 648207 - DNA, 25 bp, Homo sapien
agcactgtccagtagctgaggccac

SEQ ID NO: 648208 - DNA, 25 bp, Homo sapien
actgtccagtagctgaggccactac

SEQ ID NO: 648209 - DNA, 25 bp, Homo sapien
agtagctgaggccactactgacctg

SEQ ID NO: 648210 - DNA, 25 bp, Homo sapien
gaggccactactgacctgccaggga

SEQ ID NO: 648211 - DNA, 25 bp, Homo sapien
aaaggagatcacacctctgtccagc

SEQ ID NO: 648212 - DNA, 25 bp, Homo sapien
ggccccttggcatgccctgaagaca

SEQ ID NO: 648213 - DNA, 25 bp, Homo sapien
ccttggcatgccctgaagacacaag

SEQ ID NO: 648214 - DNA, 25 bp, Homo sapien
ttggcatgccctgaagacacaaggc

SEQ ID NO: 648215 - DNA, 25 bp, Homo sapien
gcatgccctgaagacacaaggccta

SEQ ID NO: 648216 - DNA, 25 bp, Homo sapien
atgccctgaagacacaaggcctaaa

SEQ ID NO: 648217 - DNA, 25 bp, Homo sapien
ccctgaagacacaaggcctaaatca

SEQ ID NO: 648218 - DNA, 25 bp, Homo sapien
gacacaaggcctaaatcaaggtcaa

SEQ ID NO: 648219 - DNA, 25 bp, Homo sapien
aaatcaaggtcaaagacacagccct

SEQ ID NO: 648220 - DNA, 25 bp, Homo sapien
gctgcatgaggagggttacccagaa

SEQ ID NO: 648221 - DNA, 25 bp, Homo sapien
atgaggagggttacccagaatgtca

SEQ ID NO: 648222 - DNA, 25 bp, Homo sapien
tagagagagtaagacagccctgttt

SEQ ID NO: 648223 - DNA, 25 bp, Homo sapien
gggcttccttatatgttttatctga

SEQ ID NO: 648224 - DNA, 25 bp, Homo sapien
gttttatctgatttctctccaagtc

SEQ ID NO: 648225 - DNA, 25 bp, Homo sapien
tgatttctctccaagtcttcagtgc

SEQ ID NO: 648226 - DNA, 25 bp, Homo sapien
ctctccaagtcttcagtgctactaa

SEQ ID NO: 648227 - DNA, 25 bp, Homo sapien
gtgctactaaatgtaatactcaaca

SEQ ID NO: 648228 - DNA, 25 bp, Homo sapien
agcactttaacaatgttagctgcta

SEQ ID NO: 648229 - DNA, 25 bp, Homo sapien
gttagctgctattattataaggcat

SEQ ID NO: 648230 - DNA, 25 bp, Homo sapien
taattttattactccctccttggat

SEQ ID NO: 648231 - DNA, 25 bp, Homo sapien
tattactccctccttggatttttat

SEQ ID NO: 648232 - DNA, 25 bp, Homo sapien
agaatgttataacctctgagtcaca

SEQ ID NO: 648233 - DNA, 25 bp, Homo sapien
agactccaaagcgtccccaagaggt

SEQ ID NO: 648234 - DNA, 25 bp, Homo sapien
aagcgtccccaagaggtcagggaga

SEQ ID NO: 648235 - DNA, 25 bp, Homo sapien
agggagaggctctgtgcccctgacc

SEQ ID NO: 648236 - DNA, 25 bp, Homo sapien
agagcccccgctagacagcaggagc

SEQ ID NO: 648237 - DNA, 25 bp, Homo sapien
gtaaggcaggcaggtcttgagcccc

SEQ ID NO: 648238 - DNA, 25 bp, Homo sapien
cacaagacagcaggatacaacataa

SEQ ID NO: 648239 - DNA, 25 bp, Homo sapien
agcaggatacaacataacccttttt

SEQ ID NO: 648240 - DNA, 25 bp, Homo sapien
gaagtgtagacttcatcctcacgtt

SEQ ID NO: 648241 - DNA, 25 bp, Homo sapien
gtagacttcatcctcacgttagaaa

SEQ ID NO: 648242 - DNA, 25 bp, Homo sapien
gacttcatcctcacgttagaaaact

SEQ ID NO: 648243 - DNA, 25 bp, Homo sapien
cctcacgttagaaaactccatcttt

SEQ ID NO: 648244 - DNA, 25 bp, Homo sapien
ggatgctttagaaagttctccatta

SEQ ID NO: 648245 - DNA, 25 bp, Homo sapien
ttagaaagttctccattactgcccg

SEQ ID NO: 648246 - DNA, 25 bp, Homo sapien
tagaaagttctccattactgcccgg

SEQ ID NO: 648247 - DNA, 25 bp, Homo sapien
agaaagttctccattactgcccggc

SEQ ID NO: 648248 - DNA, 25 bp, Homo sapien
aagttctccattactgcccggccat

SEQ ID NO: 648249 - DNA, 25 bp, Homo sapien
ttactgcccggccatggtgacttac

SEQ ID NO: 648250 - DNA, 25 bp, Homo sapien
actgcccggccatggtgacttacac

SEQ ID NO: 648251 - DNA, 25 bp, Homo sapien
catcactgcaccctggtgtaggcaa

SEQ ID NO: 648252 - DNA, 25 bp, Homo sapien
actgcaccctggtgtaggcaactga

SEQ ID NO: 648253 - DNA, 25 bp, Homo sapien
tgcaccctggtgtaggcaactgagt

SEQ ID NO: 648254 - DNA, 25 bp, Homo sapien
caccctggtgtaggcaactgagtga

SEQ ID NO: 648255 - DNA, 25 bp, Homo sapien
gtttgaacttaaaaacttggtgcat

SEQ ID NO: 648256 - DNA, 25 bp, Homo sapien
tttgaacttaaaaacttggtgcatg

SEQ ID NO: 648257 - DNA, 25 bp, Homo sapien
ttgaacttaaaaacttggtgcatgt

SEQ ID NO: 648258 - DNA, 25 bp, Homo sapien
aacttggtgcatgttggctgggcac

SEQ ID NO: 648259 - DNA, 25 bp, Homo sapien
acttggtgcatgttggctgggcaca

SEQ ID NO: 648260 - DNA, 25 bp, Homo sapien
cttggtgcatgttggctgggcacag

SEQ ID NO: 648261 - DNA, 25 bp, Homo sapien
ttggtgcatgttggctgggcacagt

SEQ ID NO: 648262 - DNA, 25 bp, Homo sapien
tggtgcatgttggctgggcacagtg

SEQ ID NO: 648263 - DNA, 25 bp, Homo sapien
aggcaggtggatcacaagttcagtg

SEQ ID NO: 648264 - DNA, 25 bp, Homo sapien
aagttcagtggttctagaccagcct

SEQ ID NO: 648265 - DNA, 25 bp, Homo sapien
agttcagtggttctagaccagcctg

SEQ ID NO: 648266 - DNA, 25 bp, Homo sapien
ggttttgtggtgcttcatctatgag

SEQ ID NO: 648267 - DNA, 25 bp, Homo sapien
atctatgagctttcaatttcagcca

SEQ ID NO: 648268 - DNA, 25 bp, Homo sapien
gccatcatgggttgtagcttctctg

SEQ ID NO: 648269 - DNA, 25 bp, Homo sapien
tctctgctccgtgtttgatctttgc

SEQ ID NO: 648270 - DNA, 25 bp, Homo sapien
tttgatctttgctccacgtgggtat

SEQ ID NO: 648271 - DNA, 25 bp, Homo sapien
acgtgggtatctctggctgttgcca

SEQ ID NO: 648272 - DNA, 25 bp, Homo sapien
ggctgttgccatgggtctgaagaac

SEQ ID NO: 648273 - DNA, 25 bp, Homo sapien
gaacatgcgcatggtcacgtaggac

SEQ ID NO: 648274 - DNA, 25 bp, Homo sapien
gtaggacaaccacagtcttcaacag

SEQ ID NO: 648275 - DNA, 25 bp, Homo sapien
gtcttcaacagaaagcgccatctct

SEQ ID NO: 648276 - DNA, 25 bp, Homo sapien
gcttcatgcccgtggttgattttat

SEQ ID NO: 648277 - DNA, 25 bp, Homo sapien
aaggttatcaggcaacaccgtgcct

SEQ ID NO: 648278 - DNA, 25 bp, Homo sapien
acaccgtgcctggtagaatatcgat

SEQ ID NO: 648279 - DNA, 25 bp, Homo sapien
gaatatcgattctttgcccttgtga

SEQ ID NO: 648280 - DNA, 25 bp, Homo sapien
tttgcccttgtgatcactgggagct

SEQ ID NO: 648281 - DNA, 25 bp, Homo sapien
gctgctgtggcctagcattgtgaga

SEQ ID NO: 648282 - DNA, 25 bp, Homo sapien
gagagagtatcctaccacgtattac

SEQ ID NO: 648283 - DNA, 25 bp, Homo sapien
accacgtattactagcccaggtgaa

SEQ ID NO: 648284 - DNA, 25 bp, Homo sapien
aaagttcggtttctactggatgtgt

SEQ ID NO: 648285 - DNA, 25 bp, Homo sapien
ctggatgtgtatggttttctcagca

SEQ ID NO: 648286 - DNA, 25 bp, Homo sapien
aagtcacttaggaccctgcctggta

SEQ ID NO: 648287 - DNA, 25 bp, Homo sapien
gcctggtactcaggtgcagcctaaa

SEQ ID NO: 648288 - DNA, 25 bp, Homo sapien
cagaaaaagacatctgcctagtgga

SEQ ID NO: 648289 - DNA, 25 bp, Homo sapien
tctgcctagtggaaagtggctgctt

SEQ ID NO: 648290 - DNA, 25 bp, Homo sapien
tgcctagtggaaagtggctgcttca

SEQ ID NO: 648291 - DNA, 25 bp, Homo sapien
aaagtggctgcttcagagtagcagg

SEQ ID NO: 648292 - DNA, 25 bp, Homo sapien
agggaaagagtcaaggctgtcagct

SEQ ID NO: 648293 - DNA, 25 bp, Homo sapien
tttccctctgccttttagccctatt

SEQ ID NO: 648294 - DNA, 25 bp, Homo sapien
ctctgccttttagccctatttgatt

SEQ ID NO: 648295 - DNA, 25 bp, Homo sapien
tgccttttagccctatttgattttt

SEQ ID NO: 648296 - DNA, 25 bp, Homo sapien
gatttttaactatgggtatgggtca

SEQ ID NO: 648297 - DNA, 25 bp, Homo sapien
aactatgggtatgggtcaccttaat

SEQ ID NO: 648298 - DNA, 25 bp, Homo sapien
tatgggtatgggtcaccttaataaa

SEQ ID NO: 648299 - DNA, 25 bp, Homo sapien
gtggcaggaggtctcaaagccccaa

SEQ ID NO: 648300 - DNA, 25 bp, Homo sapien
gtctcaaagccccaaagcgtatctt

SEQ ID NO: 648301 - DNA, 25 bp, Homo sapien
agcgtatcttcccagagcatcaagt

SEQ ID NO: 648302 - DNA, 25 bp, Homo sapien
ctaagaagagctaccctagagggtc

SEQ ID NO: 648303 - DNA, 25 bp, Homo sapien
ttcttgagcctcatggtcacagtag

SEQ ID NO: 648304 - DNA, 25 bp, Homo sapien
tgcccctgcagaaatgcactgatta

SEQ ID NO: 648305 - DNA, 25 bp, Homo sapien
gcactgattagcatgtgggcgtcat

SEQ ID NO: 648306 - DNA, 25 bp, Homo sapien
gtgggcgtcatactcatccataaga

SEQ ID NO: 648307 - DNA, 25 bp, Homo sapien
cagggcctctaaatgtgctgttgag

SEQ ID NO: 648308 - DNA, 25 bp, Homo sapien
aaatgtgctgttgaggaccgtgacc

SEQ ID NO: 648309 - DNA, 25 bp, Homo sapien
aggaccgtgaccattgcctcactgg

SEQ ID NO: 648310 - DNA, 25 bp, Homo sapien
gatctcatgtcactgcaaactcacc

SEQ ID NO: 648311 - DNA, 25 bp, Homo sapien
gcccctgcaaccatggcactagtga

SEQ ID NO: 648312 - DNA, 25 bp, Homo sapien
ctgcaaccatggcactagtgatcct

SEQ ID NO: 648313 - DNA, 25 bp, Homo sapien
aaccatggcactagtgatcctccag

SEQ ID NO: 648314 - DNA, 25 bp, Homo sapien
catggcactagtgatcctccagaag

SEQ ID NO: 648315 - DNA, 25 bp, Homo sapien
ggcactagtgatcctccagaagagc

SEQ ID NO: 648316 - DNA, 25 bp, Homo sapien
actagtgatcctccagaagagctgg

SEQ ID NO: 648317 - DNA, 25 bp, Homo sapien
tgatcctccagaagagctggaacta

SEQ ID NO: 648318 - DNA, 25 bp, Homo sapien
ggaactacagagaggacatcttgct

SEQ ID NO: 648319 - DNA, 25 bp, Homo sapien
actacagagaggacatcttgctgtg

SEQ ID NO: 648320 - DNA, 25 bp, Homo sapien
gagaggacatcttgctgtgttttcc

SEQ ID NO: 648321 - DNA, 25 bp, Homo sapien
gctgccatcaggacagggagattct

SEQ ID NO: 648322 - DNA, 25 bp, Homo sapien
gacagggagattctcgtccagccca

SEQ ID NO: 648323 - DNA, 25 bp, Homo sapien
agattctcgtccagcccagacgagg

SEQ ID NO: 648324 - DNA, 25 bp, Homo sapien
tgcttctcacaccacccaggtaggt

SEQ ID NO: 648325 - DNA, 25 bp, Homo sapien
acaccacccaggtaggtccttagag

SEQ ID NO: 648326 - DNA, 25 bp, Homo sapien
gtaggtccttagaggcctggacaat

SEQ ID NO: 648327 - DNA, 25 bp, Homo sapien
gcctggacaataatagccccttagc

SEQ ID NO: 648328 - DNA, 25 bp, Homo sapien
aatagccccttagctgatgacagca

SEQ ID NO: 648329 - DNA, 25 bp, Homo sapien
tgacaattcacgttgctgagcactc

SEQ ID NO: 648330 - DNA, 25 bp, Homo sapien
aattcacgttgctgagcactccacc

SEQ ID NO: 648331 - DNA, 25 bp, Homo sapien
ctcatattcccatgtgcggacagga

SEQ ID NO: 648332 - DNA, 25 bp, Homo sapien
gagccactatacccggccctattcc

SEQ ID NO: 648333 - DNA, 25 bp, Homo sapien
agccactatacccggccctattcct

SEQ ID NO: 648334 - DNA, 25 bp, Homo sapien
gccactatacccggccctattcctc

SEQ ID NO: 648335 - DNA, 25 bp, Homo sapien
ccactatacccggccctattcctct

SEQ ID NO: 648336 - DNA, 25 bp, Homo sapien
cactatacccggccctattcctctg

SEQ ID NO: 648337 - DNA, 25 bp, Homo sapien
actatacccggccctattcctctga

SEQ ID NO: 648338 - DNA, 25 bp, Homo sapien
ctatacccggccctattcctctgaa

SEQ ID NO: 648339 - DNA, 25 bp, Homo sapien
tatacccggccctattcctctgaaa

SEQ ID NO: 648340 - DNA, 25 bp, Homo sapien
tacccggccctattcctctgaaaag

SEQ ID NO: 648341 - DNA, 25 bp, Homo sapien
catgaaccaccgtggccaggtgcct

SEQ ID NO: 648342 - DNA, 25 bp, Homo sapien
atgaaccaccgtggccaggtgcctt

SEQ ID NO: 648343 - DNA, 25 bp, Homo sapien
tgaaccaccgtggccaggtgccttt

SEQ ID NO: 648344 - DNA, 25 bp, Homo sapien
gaaccaccgtggccaggtgcctttt

SEQ ID NO: 648345 - DNA, 25 bp, Homo sapien
gctgaggtagtagagtcgcctgaac

SEQ ID NO: 648346 - DNA, 25 bp, Homo sapien
ctgaggtagtagagtcgcctgaacc

SEQ ID NO: 648347 - DNA, 25 bp, Homo sapien
tgaggtagtagagtcgcctgaacct

SEQ ID NO: 648348 - DNA, 25 bp, Homo sapien
gaggtagtagagtcgcctgaacctg

SEQ ID NO: 648349 - DNA, 25 bp, Homo sapien
aggtagtagagtcgcctgaacctgg

SEQ ID NO: 648350 - DNA, 25 bp, Homo sapien
ggtagtagagtcgcctgaacctggg

SEQ ID NO: 648351 - DNA, 25 bp, Homo sapien
atcccttctgcaaactcacaggaca

SEQ ID NO: 648352 - DNA, 25 bp, Homo sapien
ttctgcaaactcacaggacaggatt

SEQ ID NO: 648353 - DNA, 25 bp, Homo sapien
tgcaaactcacaggacaggattgat

SEQ ID NO: 648354 - DNA, 25 bp, Homo sapien
aaactcacaggacaggattgatggg

SEQ ID NO: 648355 - DNA, 25 bp, Homo sapien
gagagcccaggcgaaacgaagctga

SEQ ID NO: 648356 - DNA, 25 bp, Homo sapien
gagcccaggcgaaacgaagctgacc

SEQ ID NO: 648357 - DNA, 25 bp, Homo sapien
ggctctggaacaggcccgggaccgg

SEQ ID NO: 648358 - DNA, 25 bp, Homo sapien
cccgggaccggtggcctggagacag

SEQ ID NO: 648359 - DNA, 25 bp, Homo sapien
tggcctggagacagtggtcctttct

SEQ ID NO: 648360 - DNA, 25 bp, Homo sapien
gtcagccctttaggagtttgtccag

SEQ ID NO: 648361 - DNA, 25 bp, Homo sapien
agtgcctccagaaagctgttttttg

SEQ ID NO: 648362 - DNA, 25 bp, Homo sapien
ttatattttatagcgtgtagttgac

SEQ ID NO: 648363 - DNA, 25 bp, Homo sapien
ccttgaacaatttgagtgccaacct

SEQ ID NO: 648364 - DNA, 25 bp, Homo sapien
gaacaatttgagtgccaacctcctg

SEQ ID NO: 648365 - DNA, 25 bp, Homo sapien
aatttgagtgccaacctcctgtgca

SEQ ID NO: 648366 - DNA, 25 bp, Homo sapien
ttgagtgccaacctcctgtgcagct

SEQ ID NO: 648367 - DNA, 25 bp, Homo sapien
caacctcctgtgcagctgaaattca

SEQ ID NO: 648368 - DNA, 25 bp, Homo sapien
cctcctgtgcagctgaaattcatgt

SEQ ID NO: 648369 - DNA, 25 bp, Homo sapien
cctgtgcagctgaaattcatgtata

SEQ ID NO: 648370 - DNA, 25 bp, Homo sapien
aaagacatttattctgcatcatgat

SEQ ID NO: 648371 - DNA, 25 bp, Homo sapien
gacatttattctgcatcatgatcag

SEQ ID NO: 648372 - DNA, 25 bp, Homo sapien
attctgcatcatgatcagacttaca

SEQ ID NO: 648373 - DNA, 25 bp, Homo sapien
tccaagaggctggaggccccacagg

SEQ ID NO: 648374 - DNA, 25 bp, Homo sapien
ggtgcggtgttggtggccagcccct

SEQ ID NO: 648375 - DNA, 25 bp, Homo sapien
agactggtccagttggtggacctca

SEQ ID NO: 648376 - DNA, 25 bp, Homo sapien
gtccagttggtggacctcatgcctg

SEQ ID NO: 648377 - DNA, 25 bp, Homo sapien
gtacttccttggtccttttggtgct

SEQ ID NO: 648378 - DNA, 25 bp, Homo sapien
ttccttggtccttttggtgctgttg

SEQ ID NO: 648379 - DNA, 25 bp, Homo sapien
tggtgctgttggcacagcctttcca

SEQ ID NO: 648380 - DNA, 25 bp, Homo sapien
tgttggcacagcctttccagagcag

SEQ ID NO: 648381 - DNA, 25 bp, Homo sapien
acagcctttccagagcagcgaatgg

SEQ ID NO: 648382 - DNA, 25 bp, Homo sapien
agcagcgaatggatgccagtctcct

SEQ ID NO: 648383 - DNA, 25 bp, Homo sapien
gcgaatggatgccagtctcctccca

SEQ ID NO: 648384 - DNA, 25 bp, Homo sapien
ctcattgcaactaatctttaaggaa

SEQ ID NO: 648385 - DNA, 25 bp, Homo sapien
ctttaaggaactatcacttgttgaa

SEQ ID NO: 648386 - DNA, 25 bp, Homo sapien
gaacatcggcaattttttgagaagc

SEQ ID NO: 648387 - DNA, 25 bp, Homo sapien
gagaagcattgaaacctcccttttc

SEQ ID NO: 648388 - DNA, 25 bp, Homo sapien
accagacgtgtctgtctgagcctgg

SEQ ID NO: 648389 - DNA, 25 bp, Homo sapien
tttctttacatatacttgaaccaga

SEQ ID NO: 648390 - DNA, 25 bp, Homo sapien
aaccagaatagcatatcacagcaag

SEQ ID NO: 648391 - DNA, 25 bp, Homo sapien
atcacagcaagttgaacacagaagc

SEQ ID NO: 648392 - DNA, 25 bp, Homo sapien
cacagaagcatgtcggcagatccgc

SEQ ID NO: 648393 - DNA, 25 bp, Homo sapien
gtacaacatggccattttctcgctg

SEQ ID NO: 648394 - DNA, 25 bp, Homo sapien
cattttctcgctggtttctttttga

SEQ ID NO: 648395 - DNA, 25 bp, Homo sapien
aaactgtcaggagtcaatggcctca

SEQ ID NO: 648396 - DNA, 25 bp, Homo sapien
ggattagaggcatgccactaccact

SEQ ID NO: 648397 - DNA, 25 bp, Homo sapien
gattagaggcatgccactaccactc

SEQ ID NO: 648398 - DNA, 25 bp, Homo sapien
actaccactcctagctaatttcgta

SEQ ID NO: 648399 - DNA, 25 bp, Homo sapien
accactcctagctaatttcgtatct

SEQ ID NO: 648400 - DNA, 25 bp, Homo sapien
ccactcctagctaatttcgtatctt

SEQ ID NO: 648401 - DNA, 25 bp, Homo sapien
ctagctaatttcgtatctttataga

SEQ ID NO: 648402 - DNA, 25 bp, Homo sapien
tagctaatttcgtatctttatagag

SEQ ID NO: 648403 - DNA, 25 bp, Homo sapien
agctaatttcgtatctttatagaga

SEQ ID NO: 648404 - DNA, 25 bp, Homo sapien
taatttcgtatctttatagagacgg

SEQ ID NO: 648405 - DNA, 25 bp, Homo sapien
tttctccgggttggtccaggctggc

SEQ ID NO: 648406 - DNA, 25 bp, Homo sapien
agcctctgtcactctatagagcctg

SEQ ID NO: 648407 - DNA, 25 bp, Homo sapien
actctatagagcctgcccttcaaca

SEQ ID NO: 648408 - DNA, 25 bp, Homo sapien
gcccttcaacaagccacataataat

SEQ ID NO: 648409 - DNA, 25 bp, Homo sapien
aaaatagagtgtttgatcagatgaa

SEQ ID NO: 648410 - DNA, 25 bp, Homo sapien
tttgatcagatgaatgccaaggtcc

SEQ ID NO: 648411 - DNA, 25 bp, Homo sapien
aatgccaaggtcctttccagatcca

SEQ ID NO: 648412 - DNA, 25 bp, Homo sapien
tttccagatccaaaatattatacct

SEQ ID NO: 648413 - DNA, 25 bp, Homo sapien
gtgcatgttatttaggcatgtttta

SEQ ID NO: 648414 - DNA, 25 bp, Homo sapien
tataggcatcaaatgggtacttttc

SEQ ID NO: 648415 - DNA, 25 bp, Homo sapien
ggcatcaaatgggtacttttcatct

SEQ ID NO: 648416 - DNA, 25 bp, Homo sapien
caaatgggtacttttcatcttattt

SEQ ID NO: 648417 - DNA, 25 bp, Homo sapien
ttcaacacagctgtggtcttcctct

SEQ ID NO: 648418 - DNA, 25 bp, Homo sapien
cagctgtggtcttcctctgaatatt

SEQ ID NO: 648419 - DNA, 25 bp, Homo sapien
tttcttattcaaaggcctcctccca

SEQ ID NO: 648420 - DNA, 25 bp, Homo sapien
tcaaaggcctcctcccagaagaagt

SEQ ID NO: 648421 - DNA, 25 bp, Homo sapien
ctgttgctattgatagtcattgtat

SEQ ID NO: 648422 - DNA, 25 bp, Homo sapien
attcaggacaatttggtcaattcca

SEQ ID NO: 648423 - DNA, 25 bp, Homo sapien
tggtcaattccaatgcaagtacgga

SEQ ID NO: 648424 - DNA, 25 bp, Homo sapien
gtacggaaactgagttgtcccaaat

SEQ ID NO: 648425 - DNA, 25 bp, Homo sapien
gaaactgagttgtcccaaattgatg

SEQ ID NO: 648426 - DNA, 25 bp, Homo sapien
cccaaattgatgtgacagtcaggct

SEQ ID NO: 648427 - DNA, 25 bp, Homo sapien
cagtcaggctgtttcatcttttttg

SEQ ID NO: 648428 - DNA, 25 bp, Homo sapien
ttgtgtgtgtgacctctacatttaa

SEQ ID NO: 648429 - DNA, 25 bp, Homo sapien
atcaggcatagtcacttggtcgtta

SEQ ID NO: 648430 - DNA, 25 bp, Homo sapien
aaactttacagttccaccagctaat

SEQ ID NO: 648431 - DNA, 25 bp, Homo sapien
cagctaattacatctgctatttctg

SEQ ID NO: 648432 - DNA, 25 bp, Homo sapien
tctgcttcacagatatgctttgagt

SEQ ID NO: 648433 - DNA, 25 bp, Homo sapien
tatgctttgagttgctttggctttg

SEQ ID NO: 648434 - DNA, 25 bp, Homo sapien
tttcttttccttgtaaacatctcgt

SEQ ID NO: 648435 - DNA, 25 bp, Homo sapien
aacatctcgtttgcagttttgggag

SEQ ID NO: 648436 - DNA, 25 bp, Homo sapien
gggagacgactttgcaactctgtat

SEQ ID NO: 648437 - DNA, 25 bp, Homo sapien
atatatctgacttgcctttccatac

SEQ ID NO: 648438 - DNA, 25 bp, Homo sapien
tgacttgcctttccatacagctact

SEQ ID NO: 648439 - DNA, 25 bp, Homo sapien
gatctacatcattattagttgttgc

SEQ ID NO: 648440 - DNA, 25 bp, Homo sapien
ttattagttgttgcttggtgggcca

SEQ ID NO: 648441 - DNA, 25 bp, Homo sapien
tggtgggccactgcatgaatggtta

SEQ ID NO: 648442 - DNA, 25 bp, Homo sapien
agaatatatctttgcatacttgctt

SEQ ID NO: 648443 - DNA, 25 bp, Homo sapien
tgttaaaccaagaaatacgcatatt

SEQ ID NO: 648444 - DNA, 25 bp, Homo sapien
atgttttgtcaaatgatcctcagaa

SEQ ID NO: 648445 - DNA, 25 bp, Homo sapien
atgatcctcagaaagaatgtttatt

SEQ ID NO: 648446 - DNA, 25 bp, Homo sapien
taattcacatttccactagcactac

SEQ ID NO: 648447 - DNA, 25 bp, Homo sapien
catttccactagcactacacgatag

SEQ ID NO: 648448 - DNA, 25 bp, Homo sapien
tagcactacacgatagaactattgg

SEQ ID NO: 648449 - DNA, 25 bp, Homo sapien
attttttatgctgttacctttgctg

SEQ ID NO: 648450 - DNA, 25 bp, Homo sapien
taggactccaggacactcctactgt

SEQ ID NO: 648451 - DNA, 25 bp, Homo sapien
ctccaggacactcctactgtggtct

SEQ ID NO: 648452 - DNA, 25 bp, Homo sapien
acatcccagctgtgttctgaatgat

SEQ ID NO: 648453 - DNA, 25 bp, Homo sapien
tgtgttctgaatgattgtcccttac

SEQ ID NO: 648454 - DNA, 25 bp, Homo sapien
gattgtcccttacatagaattccag

SEQ ID NO: 648455 - DNA, 25 bp, Homo sapien
ctgctgctgggttctgagatttttt

SEQ ID NO: 648456 - DNA, 25 bp, Homo sapien
ggttctgagattttttccccttatg

SEQ ID NO: 648457 - DNA, 25 bp, Homo sapien
tttccccttatgtaggattccagaa

SEQ ID NO: 648458 - DNA, 25 bp, Homo sapien
tgtcccacaaataggattccagaat

SEQ ID NO: 648459 - DNA, 25 bp, Homo sapien
ggattccagaatacttctactgtgg

SEQ ID NO: 648460 - DNA, 25 bp, Homo sapien
gaatacttctactgtggtctgaaag

SEQ ID NO: 648461 - DNA, 25 bp, Homo sapien
tgggaagcgtttgcaataatccaga

SEQ ID NO: 648462 - DNA, 25 bp, Homo sapien
tgtcttcagaagttcatggcactag

SEQ ID NO: 648463 - DNA, 25 bp, Homo sapien
gtagcattactgtcattagccacac

SEQ ID NO: 648464 - DNA, 25 bp, Homo sapien
gtcattagccacacattctttacag

SEQ ID NO: 648465 - DNA, 25 bp, Homo sapien
atattgttacgttttgaaattctgc

SEQ ID NO: 648466 - DNA, 25 bp, Homo sapien
tgaaattctgcatctggtaggtcca

SEQ ID NO: 648467 - DNA, 25 bp, Homo sapien
gcatctggtaggtccaaggtagttt

SEQ ID NO: 648468 - DNA, 25 bp, Homo sapien
gaagtagcaggatcgccttaataat

SEQ ID NO: 648469 - DNA, 25 bp, Homo sapien
gttttgtagcatgaagcctgagcat

SEQ ID NO: 648470 - DNA, 25 bp, Homo sapien
tgaagcctgagcattgtccaaagtt

SEQ ID NO: 648471 - DNA, 25 bp, Homo sapien
tgtgaacgctgatagtcacatctgt

SEQ ID NO: 648472 - DNA, 25 bp, Homo sapien
gtgagacctcatcttctactcaaat

SEQ ID NO: 648473 - DNA, 25 bp, Homo sapien
gagacctcatcttctactcaaattt

SEQ ID NO: 648474 - DNA, 25 bp, Homo sapien
gacctcatcttctactcaaatttaa

SEQ ID NO: 648475 - DNA, 25 bp, Homo sapien
cagtgagcccagatatgctcatgaa

SEQ ID NO: 648476 - DNA, 25 bp, Homo sapien
gtgagcccagatatgctcatgaagc

SEQ ID NO: 648477 - DNA, 25 bp, Homo sapien
agcccagatatgctcatgaagcact

SEQ ID NO: 648478 - DNA, 25 bp, Homo sapien
gatatgctcatgaagcactgtgggt

SEQ ID NO: 648479 - DNA, 25 bp, Homo sapien
tatgctcatgaagcactgtgggttt

SEQ ID NO: 648480 - DNA, 25 bp, Homo sapien
tgctcatgaagcactgtgggtttct

SEQ ID NO: 648481 - DNA, 25 bp, Homo sapien
tcatgaagcactgtgggtttctcct

SEQ ID NO: 648482 - DNA, 25 bp, Homo sapien
atgaagcactgtgggtttctcctgc

SEQ ID NO: 648483 - DNA, 25 bp, Homo sapien
tcctggctcacacatttttgaaggc

SEQ ID NO: 648484 - DNA, 25 bp, Homo sapien
taatcccttcaaatggctcaaaccc

SEQ ID NO: 648485 - DNA, 25 bp, Homo sapien
ggctcaaacccgtcagaggatcatt

SEQ ID NO: 648486 - DNA, 25 bp, Homo sapien
gaggatcattgttgttactggcatt

SEQ ID NO: 648487 - DNA, 25 bp, Homo sapien
atattggtatgcttatgttgtctcc

SEQ ID NO: 648488 - DNA, 25 bp, Homo sapien
atgttgtctccttttagtctgcaga

SEQ ID NO: 648489 - DNA, 25 bp, Homo sapien
ttttagtctgcagatgcctctaagg

SEQ ID NO: 648490 - DNA, 25 bp, Homo sapien
atgcctctaaggagtccgaaaccaa

SEQ ID NO: 648491 - DNA, 25 bp, Homo sapien
gagtccgaaaccaagtccgaagtca

SEQ ID NO: 648492 - DNA, 25 bp, Homo sapien
aagtccgaagtcaacaacaagcaat

SEQ ID NO: 648493 - DNA, 25 bp, Homo sapien
gatggcgatggcgattctagttaat

SEQ ID NO: 648494 - DNA, 25 bp, Homo sapien
ggtaggtctggaggctgcgggagaa

SEQ ID NO: 648495 - DNA, 25 bp, Homo sapien
ggagaaggcggcatgttatttcact

SEQ ID NO: 648496 - DNA, 25 bp, Homo sapien
aaggcggcatgttatttcactggag

SEQ ID NO: 648497 - DNA, 25 bp, Homo sapien
gcggcatgttatttcactggaggaa

SEQ ID NO: 648498 - DNA, 25 bp, Homo sapien
ctggaggaaagtgtactggtgattc

SEQ ID NO: 648499 - DNA, 25 bp, Homo sapien
ctggtgattcagttcaattgaggat

SEQ ID NO: 648500 - DNA, 25 bp, Homo sapien
gattcagttcaattgaggatgactt

SEQ ID NO: 648501 - DNA, 25 bp, Homo sapien
gtatttaatctctgaatgctttgaa

SEQ ID NO: 648502 - DNA, 25 bp, Homo sapien
tttaatctctgaatgctttgaagca

SEQ ID NO: 648503 - DNA, 25 bp, Homo sapien
agcattcatgttgtcattgtcccca

SEQ ID NO: 648504 - DNA, 25 bp, Homo sapien
attcatgttgtcattgtccccagtg

SEQ ID NO: 648505 - DNA, 25 bp, Homo sapien
gcatacatgactttaatagaaggga

SEQ ID NO: 648506 - DNA, 25 bp, Homo sapien
actaaccatgtataagtgctgtgtt

SEQ ID NO: 648507 - DNA, 25 bp, Homo sapien
gctgtgttacaatttaggttccctt

SEQ ID NO: 648508 - DNA, 25 bp, Homo sapien
tgttacaatttaggttcccttggag

SEQ ID NO: 648509 - DNA, 25 bp, Homo sapien
ccttggaggctgtctctaagatgga

SEQ ID NO: 648510 - DNA, 25 bp, Homo sapien
gatggagcatgcagagcgtttgttt

SEQ ID NO: 648511 - DNA, 25 bp, Homo sapien
gcgtttgtttggaagtgctcttgag

SEQ ID NO: 648512 - DNA, 25 bp, Homo sapien
gtgctcttgagaataacacctctgc

SEQ ID NO: 648513 - DNA, 25 bp, Homo sapien
gaataacacctctgcgtgtgctggg

SEQ ID NO: 648514 - DNA, 25 bp, Homo sapien
gaaagggaaagctatggaaccattg

SEQ ID NO: 648515 - DNA, 25 bp, Homo sapien
aataattaggcaggaggctgaattt

SEQ ID NO: 648516 - DNA, 25 bp, Homo sapien
ggtcttggaatgacgcttaccagta

SEQ ID NO: 648517 - DNA, 25 bp, Homo sapien
ttggaatgacgcttaccagtaagtg

SEQ ID NO: 648518 - DNA, 25 bp, Homo sapien
cgcttaccagtaagtgttctgtggg

SEQ ID NO: 648519 - DNA, 25 bp, Homo sapien
ctgtggggtgacttcgggcatttcc

SEQ ID NO: 648520 - DNA, 25 bp, Homo sapien
gtcctaaatttgctcatcgctaaaa

SEQ ID NO: 648521 - DNA, 25 bp, Homo sapien
tttgctcatcgctaaaatgaaagca

SEQ ID NO: 648522 - DNA, 25 bp, Homo sapien
aatgaaagcatctcccaggcatctc

SEQ ID NO: 648523 - DNA, 25 bp, Homo sapien
aggcatctcctaatttccatgtcta

SEQ ID NO: 648524 - DNA, 25 bp, Homo sapien
atctcctaatttccatgtctacctc

SEQ ID NO: 648525 - DNA, 25 bp, Homo sapien
taatttccatgtctacctccccttt

SEQ ID NO: 648526 - DNA, 25 bp, Homo sapien
tttctccttataggccctggatgtc

SEQ ID NO: 648527 - DNA, 25 bp, Homo sapien
tcctccactttagcctctcgagtac

SEQ ID NO: 648528 - DNA, 25 bp, Homo sapien
tggctaattttatgtcatgcaaatc

SEQ ID NO: 648529 - DNA, 25 bp, Homo sapien
ggctaattttatgtcatgcaaatct

SEQ ID NO: 648530 - DNA, 25 bp, Homo sapien
ttttatgtcatgcaaatcttatccc

SEQ ID NO: 648531 - DNA, 25 bp, Homo sapien
tttatgtcatgcaaatcttatcccc

SEQ ID NO: 648532 - DNA, 25 bp, Homo sapien
ttatgtcatgcaaatcttatcccca

SEQ ID NO: 648533 - DNA, 25 bp, Homo sapien
tatgtcatgcaaatcttatccccat

SEQ ID NO: 648534 - DNA, 25 bp, Homo sapien
atgtcatgcaaatcttatccccatc

SEQ ID NO: 648535 - DNA, 25 bp, Homo sapien
tgtcatgcaaatcttatccccatca

SEQ ID NO: 648536 - DNA, 25 bp, Homo sapien
gtcatgcaaatcttatccccatcaa

SEQ ID NO: 648537 - DNA, 25 bp, Homo sapien
tcatgcaaatcttatccccatcaaa

SEQ ID NO: 648538 - DNA, 25 bp, Homo sapien
gaaatcctgacagcgagagttgctt

SEQ ID NO: 648539 - DNA, 25 bp, Homo sapien
tcctgacagcgagagttgctttgta

SEQ ID NO: 648540 - DNA, 25 bp, Homo sapien
gcgagagttgctttgtaaattaact

SEQ ID NO: 648541 - DNA, 25 bp, Homo sapien
acttatgagggatatagtggattaa

SEQ ID NO: 648542 - DNA, 25 bp, Homo sapien
cagcaagaaataaagcacacagctt

SEQ ID NO: 648543 - DNA, 25 bp, Homo sapien
acagctttgcactcctaaaaaatct

SEQ ID NO: 648544 - DNA, 25 bp, Homo sapien
gaagataggctataaagggctataa

SEQ ID NO: 648545 - DNA, 25 bp, Homo sapien
taaagtttagtttatgaccagggag

SEQ ID NO: 648546 - DNA, 25 bp, Homo sapien
ttatgaccagggaggttgttcagaa

SEQ ID NO: 648547 - DNA, 25 bp, Homo sapien
gaggttgttcagaaggatgatagtt

SEQ ID NO: 648548 - DNA, 25 bp, Homo sapien
gttgagaggaagctaacctttattg

SEQ ID NO: 648549 - DNA, 25 bp, Homo sapien
gatatcctgaaataagacatccaat

SEQ ID NO: 648550 - DNA, 25 bp, Homo sapien
agacatccaattaaggtacctgcta

SEQ ID NO: 648551 - DNA, 25 bp, Homo sapien
tccaattaaggtacctgctatctca

SEQ ID NO: 648552 - DNA, 25 bp, Homo sapien
ctgctatctcatgtaacacagaaga

SEQ ID NO: 648553 - DNA, 25 bp, Homo sapien
gttgagcatagaggttaaacattac

SEQ ID NO: 648554 - DNA, 25 bp, Homo sapien
tacctaatattgttggaaaagcttc

SEQ ID NO: 648555 - DNA, 25 bp, Homo sapien
tggaaaagcttcgaagcgttcattt

SEQ ID NO: 648556 - DNA, 25 bp, Homo sapien
taatgtaaaccatgataatcactag

SEQ ID NO: 648557 - DNA, 25 bp, Homo sapien
gataatcactagtagcactatgcca

SEQ ID NO: 648558 - DNA, 25 bp, Homo sapien
cactagtagcactatgccattttaa

SEQ ID NO: 648559 - DNA, 25 bp, Homo sapien
ttatttgcctaaacagtgttagaca

SEQ ID NO: 648560 - DNA, 25 bp, Homo sapien
aatgacttttgggttgggcgccaca

SEQ ID NO: 648561 - DNA, 25 bp, Homo sapien
atgacttttgggttgggcgccacag

SEQ ID NO: 648562 - DNA, 25 bp, Homo sapien
gacttttgggttgggcgccacagct

SEQ ID NO: 648563 - DNA, 25 bp, Homo sapien
tgggaggatcagtggagcctcagag

SEQ ID NO: 648564 - DNA, 25 bp, Homo sapien
gaggatcagtggagcctcagaggtt

SEQ ID NO: 648565 - DNA, 25 bp, Homo sapien
aggatcagtggagcctcagaggttg

SEQ ID NO: 648566 - DNA, 25 bp, Homo sapien
gatcagtggagcctcagaggttgag

SEQ ID NO: 648567 - DNA, 25 bp, Homo sapien
atcagtggagcctcagaggttgagg

SEQ ID NO: 648568 - DNA, 25 bp, Homo sapien
tcagtggagcctcagaggttgaggc

SEQ ID NO: 648569 - DNA, 25 bp, Homo sapien
gctgtagtgacccatgttcacacca

SEQ ID NO: 648570 - DNA, 25 bp, Homo sapien
ctgtagtgacccatgttcacaccac

SEQ ID NO: 648571 - DNA, 25 bp, Homo sapien
aaaaaaagtgaagtggcatgatctc

SEQ ID NO: 648572 - DNA, 25 bp, Homo sapien
aaaaaagtgaagtggcatgatctcg

SEQ ID NO: 648573 - DNA, 25 bp, Homo sapien
aaaaagtgaagtggcatgatctcga

SEQ ID NO: 648574 - DNA, 25 bp, Homo sapien
aaaagtgaagtggcatgatctcgac

SEQ ID NO: 648575 - DNA, 25 bp, Homo sapien
actacgggtgcctgccaccatgccc

SEQ ID NO: 648576 - DNA, 25 bp, Homo sapien
ctcctgatctgaaatgatccaccca

SEQ ID NO: 648577 - DNA, 25 bp, Homo sapien
tcctgatctgaaatgatccacccac

SEQ ID NO: 648578 - DNA, 25 bp, Homo sapien
cctgatctgaaatgatccacccact

SEQ ID NO: 648579 - DNA, 25 bp, Homo sapien
aagtcagtcaaaccagagccatgtc

SEQ ID NO: 648580 - DNA, 25 bp, Homo sapien
gttcctaagggccagaggccacatc

SEQ ID NO: 648581 - DNA, 25 bp, Homo sapien
agaggccacatccactggtagatga

SEQ ID NO: 648582 - DNA, 25 bp, Homo sapien
gatgacagaacaaccatacttcaga

SEQ ID NO: 648583 - DNA, 25 bp, Homo sapien
cttcagatggcaaaaccggtcagtt

SEQ ID NO: 648584 - DNA, 25 bp, Homo sapien
tcagtttggtttgcgttgtgtgcct

SEQ ID NO: 648585 - DNA, 25 bp, Homo sapien
cgttgtgtgcctatcctctttctgt

SEQ ID NO: 648586 - DNA, 25 bp, Homo sapien
tctttctgtgtgcttcagctgaatt

SEQ ID NO: 648587 - DNA, 25 bp, Homo sapien
gtgcttggagagctcaaatagttca

SEQ ID NO: 648588 - DNA, 25 bp, Homo sapien
agatgaccaattctgccaggtggca

SEQ ID NO: 648589 - DNA, 25 bp, Homo sapien
gtggcagcctgatcttgcaattttg

SEQ ID NO: 648590 - DNA, 25 bp, Homo sapien
agggcagggagcactggctagccga

SEQ ID NO: 648591 - DNA, 25 bp, Homo sapien
cactggctagccgagagcaggacaa

SEQ ID NO: 648592 - DNA, 25 bp, Homo sapien
tagccgagagcaggacaatgtccct

SEQ ID NO: 648593 - DNA, 25 bp, Homo sapien
gacaatgtccctattgattcgggtc

SEQ ID NO: 648594 - DNA, 25 bp, Homo sapien
aatgtccctattgattcgggtctcc

SEQ ID NO: 648595 - DNA, 25 bp, Homo sapien
gtccctattgattcgggtctcctca

SEQ ID NO: 648596 - DNA, 25 bp, Homo sapien
tcctcactcctgcttagaagcctga

SEQ ID NO: 648597 - DNA, 25 bp, Homo sapien
actcctgcttagaagcctgacagtg

SEQ ID NO: 648598 - DNA, 25 bp, Homo sapien
gtgcctgtgtctcctgtggaccaat

SEQ ID NO: 648599 - DNA, 25 bp, Homo sapien
gtgtctcctgtggaccaatctcgac

SEQ ID NO: 648600 - DNA, 25 bp, Homo sapien
tctcgaccctgctctttgggagact

SEQ ID NO: 648601 - DNA, 25 bp, Homo sapien
ggtaagcatgtgatgactattaaca

SEQ ID NO: 648602 - DNA, 25 bp, Homo sapien
taaacagctgtgacaagacaggcag

SEQ ID NO: 648603 - DNA, 25 bp, Homo sapien
agagtccctgccctattggatctca

SEQ ID NO: 648604 - DNA, 25 bp, Homo sapien
gccctattggatctcatgttctcat

SEQ ID NO: 648605 - DNA, 25 bp, Homo sapien
ggatctcatgttctcatgagggaga

SEQ ID NO: 648606 - DNA, 25 bp, Homo sapien
catgagggagacaggcaacaagcaa

SEQ ID NO: 648607 - DNA, 25 bp, Homo sapien
ggcaacaagcaaataaatctacaat

SEQ ID NO: 648608 - DNA, 25 bp, Homo sapien
aatctacaatataatgtgtcaggga

SEQ ID NO: 648609 - DNA, 25 bp, Homo sapien
gtcagggatagaagccataagaaca

SEQ ID NO: 648610 - DNA, 25 bp, Homo sapien
acagagctatatgaagagacagact

SEQ ID NO: 648611 - DNA, 25 bp, Homo sapien
gactgaatagcacactgtttaccta

SEQ ID NO: 648612 - DNA, 25 bp, Homo sapien
gaagttaaagtaccaccaatacatt

SEQ ID NO: 648613 - DNA, 25 bp, Homo sapien
aatacattccaccagatcagaaggg

SEQ ID NO: 648614 - DNA, 25 bp, Homo sapien
atgagccgcagatggactctaacta

SEQ ID NO: 648615 - DNA, 25 bp, Homo sapien
agcagctgttcctgcaactgcagat

SEQ ID NO: 648616 - DNA, 25 bp, Homo sapien
gagtcagcagaagcagcactacaac

SEQ ID NO: 648617 - DNA, 25 bp, Homo sapien
agcagcactacaactaccagaccat

SEQ ID NO: 648618 - DNA, 25 bp, Homo sapien
ctgcaccattcaagccactcaatga

SEQ ID NO: 648619 - DNA, 25 bp, Homo sapien
attcaagccactcaatgacaaaaat

SEQ ID NO: 648620 - DNA, 25 bp, Homo sapien
aatagtaacagtgggaattcagctt

SEQ ID NO: 648621 - DNA, 25 bp, Homo sapien
gaattcagctttgaacaatgccaca

SEQ ID NO: 648622 - DNA, 25 bp, Homo sapien
tttgaacaatgccacacctatcaca

SEQ ID NO: 648623 - DNA, 25 bp, Homo sapien
taggactccaggacactcctactgt

SEQ ID NO: 648624 - DNA, 25 bp, Homo sapien
gactccaggacactcctactgtggt

SEQ ID NO: 648625 - DNA, 25 bp, Homo sapien
ctccaggacactcctactgtggtct

SEQ ID NO: 648626 - DNA, 25 bp, Homo sapien
acatcccagctgtgttctgaatgat

SEQ ID NO: 648627 - DNA, 25 bp, Homo sapien
tcccagctgtgttctgaatgattgt

SEQ ID NO: 648628 - DNA, 25 bp, Homo sapien
ctgctgctgggttctgagatttttt

SEQ ID NO: 648629 - DNA, 25 bp, Homo sapien
tgctgctgggttctgagattttttc

SEQ ID NO: 648630 - DNA, 25 bp, Homo sapien
tttttccccttatgtaggattccag

SEQ ID NO: 648631 - DNA, 25 bp, Homo sapien
tccccttatgtaggattccagaaca

SEQ ID NO: 648632 - DNA, 25 bp, Homo sapien
aggattccagaatacttctactgtg

SEQ ID NO: 648633 - DNA, 25 bp, Homo sapien
gattccagaatacttctactgtggt

SEQ ID NO: 648634 - DNA, 25 bp, Homo sapien
tattttgctaatttagtggttgctt

SEQ ID NO: 648635 - DNA, 25 bp, Homo sapien
tagtggttgctttagggtttatagt

SEQ ID NO: 648636 - DNA, 25 bp, Homo sapien
gtaaacatcttcaacttatcacatt

SEQ ID NO: 648637 - DNA, 25 bp, Homo sapien
ttatcacattctatgttctagtcat

SEQ ID NO: 648638 - DNA, 25 bp, Homo sapien
actttcattttcctccagtaattgt

SEQ ID NO: 648639 - DNA, 25 bp, Homo sapien
tttcctccagtaattgtgcgattct

SEQ ID NO: 648640 - DNA, 25 bp, Homo sapien
gtaattgtgcgattcttgtcatcta

SEQ ID NO: 648641 - DNA, 25 bp, Homo sapien
tgtgcgattcttgtcatctattttg

SEQ ID NO: 648642 - DNA, 25 bp, Homo sapien
gtcatctattttgcttctacatgtt

SEQ ID NO: 648643 - DNA, 25 bp, Homo sapien
gcttctacatgttataaactccaca

SEQ ID NO: 648644 - DNA, 25 bp, Homo sapien
tgttataaactccacatgattttgt

SEQ ID NO: 648645 - DNA, 25 bp, Homo sapien
gacctcaaatgattcccccacttcg

SEQ ID NO: 648646 - DNA, 25 bp, Homo sapien
cctcaaatgattcccccacttcggc

SEQ ID NO: 648647 - DNA, 25 bp, Homo sapien
tgagccatcgcaccgggcctaatat

SEQ ID NO: 648648 - DNA, 25 bp, Homo sapien
agccatcgcaccgggcctaatattt

SEQ ID NO: 648649 - DNA, 25 bp, Homo sapien
gccatcgcaccgggcctaatatttt

SEQ ID NO: 648650 - DNA, 25 bp, Homo sapien
ccatcgcaccgggcctaatatttta

SEQ ID NO: 648651 - DNA, 25 bp, Homo sapien
atcgcaccgggcctaatattttatt

SEQ ID NO: 648652 - DNA, 25 bp, Homo sapien
tcgcaccgggcctaatattttattt

SEQ ID NO: 648653 - DNA, 25 bp, Homo sapien
tttctccagggtttatagaaaaatg

SEQ ID NO: 648654 - DNA, 25 bp, Homo sapien
ttctccagggtttatagaaaaatgt

SEQ ID NO: 648655 - DNA, 25 bp, Homo sapien
tctccagggtttatagaaaaatgtg

SEQ ID NO: 648656 - DNA, 25 bp, Homo sapien
gaagttaaagtaccaccaatacatt

SEQ ID NO: 648657 - DNA, 25 bp, Homo sapien
caccaatacattccaccagatcaga

SEQ ID NO: 648658 - DNA, 25 bp, Homo sapien
aatacattccaccagatcagaaggg

SEQ ID NO: 648659 - DNA, 25 bp, Homo sapien
attccaccagatcagaagggtgaga

SEQ ID NO: 648660 - DNA, 25 bp, Homo sapien
tgagaagaatgagccgcagatggac

SEQ ID NO: 648661 - DNA, 25 bp, Homo sapien
aagaatgagccgcagatggactcta

SEQ ID NO: 648662 - DNA, 25 bp, Homo sapien
gaatgagccgcagatggactctaac

SEQ ID NO: 648663 - DNA, 25 bp, Homo sapien
atgagccgcagatggactctaacta

SEQ ID NO: 648664 - DNA, 25 bp, Homo sapien
gcagctgttcctgcaactgcagatc

SEQ ID NO: 648665 - DNA, 25 bp, Homo sapien
gctgttcctgcaactgcagatcctg

SEQ ID NO: 648666 - DNA, 25 bp, Homo sapien
agcagcactacaactaccagaccat

SEQ ID NO: 648667 - DNA, 25 bp, Homo sapien
aacagaacttgcctgcttctggcgt

SEQ ID NO: 648668 - DNA, 25 bp, Homo sapien
agaacttgcctgcttctggcgtgct

SEQ ID NO: 648669 - DNA, 25 bp, Homo sapien
tctggcgtgctctacgatggcaaga

SEQ ID NO: 648670 - DNA, 25 bp, Homo sapien
gcgtgctctacgatggcaagaaaat

SEQ ID NO: 648671 - DNA, 25 bp, Homo sapien
aaaattgcctatcctttctgtaact

SEQ ID NO: 648672 - DNA, 25 bp, Homo sapien
attgcctatcctttctgtaactttc

SEQ ID NO: 648673 - DNA, 25 bp, Homo sapien
tgtgttttcttgacaaaaggagggt

SEQ ID NO: 648674 - DNA, 25 bp, Homo sapien
gaaaagcagcagtatatcattgtaa

SEQ ID NO: 648675 - DNA, 25 bp, Homo sapien
aatgtgcagacatttcagtgagttc

SEQ ID NO: 648676 - DNA, 25 bp, Homo sapien
agttccatacaacctgaatgtaaaa

SEQ ID NO: 648677 - DNA, 25 bp, Homo sapien
gtttcccagaaacacaatataaaga

SEQ ID NO: 648678 - DNA, 25 bp, Homo sapien
agtaatttggccaagctgacacagt

SEQ ID NO: 648679 - DNA, 25 bp, Homo sapien
taatttggccaagctgacacagtga

SEQ ID NO: 648680 - DNA, 25 bp, Homo sapien
cagtgagtggccaagctagaatttt

SEQ ID NO: 648681 - DNA, 25 bp, Homo sapien
ccaagctagaattttgaacctagat

SEQ ID NO: 648682 - DNA, 25 bp, Homo sapien
gaacctagatctgtttgacttcaaa

SEQ ID NO: 648683 - DNA, 25 bp, Homo sapien
gacttcaaatccaatattttcactt

SEQ ID NO: 648684 - DNA, 25 bp, Homo sapien
gctaatcatgttttctttgtgagga

SEQ ID NO: 648685 - DNA, 25 bp, Homo sapien
gttttctttgtgaggactacatggg

SEQ ID NO: 648686 - DNA, 25 bp, Homo sapien
ggactacatgggtttttatttcagc

SEQ ID NO: 648687 - DNA, 25 bp, Homo sapien
tgggtttttatttcagctaaatgga

SEQ ID NO: 648688 - DNA, 25 bp, Homo sapien
cacagcatagaattcaggtgacatg

SEQ ID NO: 648689 - DNA, 25 bp, Homo sapien
cagcaacatgcttgggaggccatca

SEQ ID NO: 648690 - DNA, 25 bp, Homo sapien
agcaacatgcttgggaggccatcaa

SEQ ID NO: 648691 - DNA, 25 bp, Homo sapien
caacatgcttgggaggccatcaaga

SEQ ID NO: 648692 - DNA, 25 bp, Homo sapien
gaggccatcaagaagccatagcagt

SEQ ID NO: 648693 - DNA, 25 bp, Homo sapien
aggccatcaagaagccatagcagtg

SEQ ID NO: 648694 - DNA, 25 bp, Homo sapien
ggccatcaagaagccatagcagtgt

SEQ ID NO: 648695 - DNA, 25 bp, Homo sapien
ccatcaagaagccatagcagtgtgc

SEQ ID NO: 648696 - DNA, 25 bp, Homo sapien
catcaagaagccatagcagtgtgct

SEQ ID NO: 648697 - DNA, 25 bp, Homo sapien
atcaagaagccatagcagtgtgctt

SEQ ID NO: 648698 - DNA, 25 bp, Homo sapien
tcaagaagccatagcagtgtgctta

SEQ ID NO: 648699 - DNA, 25 bp, Homo sapien
caagaagccatagcagtgtgcttac

SEQ ID NO: 648700 - DNA, 25 bp, Homo sapien
aatacactgcaaagtatagcctaga

SEQ ID NO: 648701 - DNA, 25 bp, Homo sapien
cggtggttcacagagttttaaatag

SEQ ID NO: 648702 - DNA, 25 bp, Homo sapien
agcttcacaagatttacactccgag

SEQ ID NO: 648703 - DNA, 25 bp, Homo sapien
atttacactccgagattgactcgtt

SEQ ID NO: 648704 - DNA, 25 bp, Homo sapien
gattctgatgcaagtggtctctcca

SEQ ID NO: 648705 - DNA, 25 bp, Homo sapien
gatgcaagtggtctctccagcctgt

SEQ ID NO: 648706 - DNA, 25 bp, Homo sapien
gcctgtctggagaaactggctccgt

SEQ ID NO: 648707 - DNA, 25 bp, Homo sapien
gagaaactggctccgttgcacaatc

SEQ ID NO: 648708 - DNA, 25 bp, Homo sapien
gctccgttgcacaatctagttgctt

SEQ ID NO: 648709 - DNA, 25 bp, Homo sapien
tactgttaaatgcaagacatgtctc

SEQ ID NO: 648710 - DNA, 25 bp, Homo sapien
caagacatgtctcaaatttcaccaa

SEQ ID NO: 648711 - DNA, 25 bp, Homo sapien
gcttctgccctgtggccaccgggaa

SEQ ID NO: 648712 - DNA, 25 bp, Homo sapien
tgccctgtggccaccgggaagtcca

SEQ ID NO: 648713 - DNA, 25 bp, Homo sapien
gaggggattctagggccaggaccct

SEQ ID NO: 648714 - DNA, 25 bp, Homo sapien
ttgtcactgtgaagcacaagagaag

SEQ ID NO: 648715 - DNA, 25 bp, Homo sapien
actgtgaagcacaagagaagcaaaa

SEQ ID NO: 648716 - DNA, 25 bp, Homo sapien
gagaagcaaaattgctttgcccagt

SEQ ID NO: 648717 - DNA, 25 bp, Homo sapien
gaagcaaaattgctttgcccagttc

SEQ ID NO: 648718 - DNA, 25 bp, Homo sapien
aagcaaaattgctttgcccagttcc

SEQ ID NO: 648719 - DNA, 25 bp, Homo sapien
agcaaaattgctttgcccagttccc

SEQ ID NO: 648720 - DNA, 25 bp, Homo sapien
gcaaaattgctttgcccagttcccg

SEQ ID NO: 648721 - DNA, 25 bp, Homo sapien
caaaattgctttgcccagttcccgg

SEQ ID NO: 648722 - DNA, 25 bp, Homo sapien
taccgctatctcagtaaattagctc

SEQ ID NO: 648723 - DNA, 25 bp, Homo sapien
aaattagctctatctgtgcagttgg

SEQ ID NO: 648724 - DNA, 25 bp, Homo sapien
tagctctatctgtgcagttggcaag

SEQ ID NO: 648725 - DNA, 25 bp, Homo sapien
agttggcaagaagaactggtcaggt

SEQ ID NO: 648726 - DNA, 25 bp, Homo sapien
gaactggtcaggtggttaaaacact

SEQ ID NO: 648727 - DNA, 25 bp, Homo sapien
ggtcaggtggttaaaacactacaga

SEQ ID NO: 648728 - DNA, 25 bp, Homo sapien
ggttaaaacactacagataggcatt

SEQ ID NO: 648729 - DNA, 25 bp, Homo sapien
acactacagataggcattgttaaac

SEQ ID NO: 648730 - DNA, 25 bp, Homo sapien
aaaacaatggactaagcccctgcac

SEQ ID NO: 648731 - DNA, 25 bp, Homo sapien
aacaatggactaagcccctgcacta

SEQ ID NO: 648732 - DNA, 25 bp, Homo sapien
gtcactcatgctaaatgtcatataa

SEQ ID NO: 648733 - DNA, 25 bp, Homo sapien
aattgtacatccacctttaatcagt

SEQ ID NO: 648734 - DNA, 25 bp, Homo sapien
caacacagattgaaacttcccttcc

SEQ ID NO: 648735 - DNA, 25 bp, Homo sapien
gaggatgtgataaccctgctgccga

SEQ ID NO: 648736 - DNA, 25 bp, Homo sapien
acgtgctctctgtaagccgtgggct

SEQ ID NO: 648737 - DNA, 25 bp, Homo sapien
gtgggctttgcatcatacgaatcat

SEQ ID NO: 648738 - DNA, 25 bp, Homo sapien
cgaatcatcgcatctcgttagtgaa

SEQ ID NO: 648739 - DNA, 25 bp, Homo sapien
atctcgttagtgaagcggcctcatc

SEQ ID NO: 648740 - DNA, 25 bp, Homo sapien
agcggcctcatcttgacactgaaga

SEQ ID NO: 648741 - DNA, 25 bp, Homo sapien
aagatgtcttagtgcctgacacggt

SEQ ID NO: 648742 - DNA, 25 bp, Homo sapien
gacacggtgggtcttatcagctcaa

SEQ ID NO: 648743 - DNA, 25 bp, Homo sapien
gggtcttatcagctcaagatcctct

SEQ ID NO: 648744 - DNA, 25 bp, Homo sapien
aaaggtaaggatggtttcaagcatt

SEQ ID NO: 648745 - DNA, 25 bp, Homo sapien
aaggatggtttcaagcatttgtcta

SEQ ID NO: 648746 - DNA, 25 bp, Homo sapien
gatggtttcaagcatttgtctaaaa

SEQ ID NO: 648747 - DNA, 25 bp, Homo sapien
aaacttctgtaggaggaatactgtt

SEQ ID NO: 648748 - DNA, 25 bp, Homo sapien
ggaggaatactgttggcgttcaaaa

SEQ ID NO: 648749 - DNA, 25 bp, Homo sapien
aggaatactgttggcgttcaaaagc

SEQ ID NO: 648750 - DNA, 25 bp, Homo sapien
tactgttggcgttcaaaagcattgc

SEQ ID NO: 648751 - DNA, 25 bp, Homo sapien
gttggcgttcaaaagcattgctgtt

SEQ ID NO: 648752 - DNA, 25 bp, Homo sapien
agcattgctgtttcaacaatggcca

SEQ ID NO: 648753 - DNA, 25 bp, Homo sapien
tgctgtttcaacaatggccaagaac

SEQ ID NO: 648754 - DNA, 25 bp, Homo sapien
ttcaacaatggccaagaacaaatta

SEQ ID NO: 648755 - DNA, 25 bp, Homo sapien
tattaaaagaatatgccggctgggc

SEQ ID NO: 648756 - DNA, 25 bp, Homo sapien
attaaaagaatatgccggctgggcg

SEQ ID NO: 648757 - DNA, 25 bp, Homo sapien
ttaaaagaatatgccggctgggcgc

SEQ ID NO: 648758 - DNA, 25 bp, Homo sapien
taaaagaatatgccggctgggcgcg

SEQ ID NO: 648759 - DNA, 25 bp, Homo sapien
cactccagcccgcacgatagtgtaa

SEQ ID NO: 648760 - DNA, 25 bp, Homo sapien
actccagcccgcacgatagtgtaag

SEQ ID NO: 648761 - DNA, 25 bp, Homo sapien
ctccagcccgcacgatagtgtaaga

SEQ ID NO: 648762 - DNA, 25 bp, Homo sapien
tccagcccgcacgatagtgtaagac

SEQ ID NO: 648763 - DNA, 25 bp, Homo sapien
ccagcccgcacgatagtgtaagact

SEQ ID NO: 648764 - DNA, 25 bp, Homo sapien
cagcccgcacgatagtgtaagactc

SEQ ID NO: 648765 - DNA, 25 bp, Homo sapien
agcccgcacgatagtgtaagactcc

SEQ ID NO: 648766 - DNA, 25 bp, Homo sapien
gtctgcttgcctgttaagccattga

SEQ ID NO: 648767 - DNA, 25 bp, Homo sapien
cttgcctgttaagccattgactgtt

SEQ ID NO: 648768 - DNA, 25 bp, Homo sapien
agccattgactgttatatactcttg

SEQ ID NO: 648769 - DNA, 25 bp, Homo sapien
gactgttatatactcttgggtttga

SEQ ID NO: 648770 - DNA, 25 bp, Homo sapien
gtactgcatttacttttatcccatt

SEQ ID NO: 648771 - DNA, 25 bp, Homo sapien
gcatttacttttatcccatttctgt

SEQ ID NO: 648772 - DNA, 25 bp, Homo sapien
atttctgttttcacggctacccaag

SEQ ID NO: 648773 - DNA, 25 bp, Homo sapien
tgttttcacggctacccaagaggaa

SEQ ID NO: 648774 - DNA, 25 bp, Homo sapien
tcacggctacccaagaggaaataat

SEQ ID NO: 648775 - DNA, 25 bp, Homo sapien
atatatttcctgcaacatgagttaa

SEQ ID NO: 648776 - DNA, 25 bp, Homo sapien
gagttaatgaaattccgttccttct

SEQ ID NO: 648777 - DNA, 25 bp, Homo sapien
aatatagaagtaacatagtaggctg

SEQ ID NO: 648778 - DNA, 25 bp, Homo sapien
atatagaagtaacatagtaggctgg

SEQ ID NO: 648779 - DNA, 25 bp, Homo sapien
tatagaagtaacatagtaggctggg

SEQ ID NO: 648780 - DNA, 25 bp, Homo sapien
atagaagtaacatagtaggctgggc

SEQ ID NO: 648781 - DNA, 25 bp, Homo sapien
tagaagtaacatagtaggctgggcg

SEQ ID NO: 648782 - DNA, 25 bp, Homo sapien
agaagtaacatagtaggctgggcgc

SEQ ID NO: 648783 - DNA, 25 bp, Homo sapien
gaagtaacatagtaggctgggcgcg

SEQ ID NO: 648784 - DNA, 25 bp, Homo sapien
aagtaacatagtaggctgggcgcgg

SEQ ID NO: 648785 - DNA, 25 bp, Homo sapien
agtaacatagtaggctgggcgcggt

SEQ ID NO: 648786 - DNA, 25 bp, Homo sapien
gtaacatagtaggctgggcgcggtg

SEQ ID NO: 648787 - DNA, 25 bp, Homo sapien
taacatagtaggctgggcgcggtga

SEQ ID NO: 648788 - DNA, 25 bp, Homo sapien
atatcatcattggctggttgtggtg

SEQ ID NO: 648789 - DNA, 25 bp, Homo sapien
tatcatcattggctggttgtggtgt

SEQ ID NO: 648790 - DNA, 25 bp, Homo sapien
atcatcattggctggttgtggtgtc

SEQ ID NO: 648791 - DNA, 25 bp, Homo sapien
tcatcattggctggttgtggtgtct

SEQ ID NO: 648792 - DNA, 25 bp, Homo sapien
catcattggctggttgtggtgtctc

SEQ ID NO: 648793 - DNA, 25 bp, Homo sapien
atcattggctggttgtggtgtctca

SEQ ID NO: 648794 - DNA, 25 bp, Homo sapien
tcattggctggttgtggtgtctcac

SEQ ID NO: 648795 - DNA, 25 bp, Homo sapien
cagttcaagaccggcctggccaacg

SEQ ID NO: 648796 - DNA, 25 bp, Homo sapien
tattatataaggtcaaggaactaaa

SEQ ID NO: 648797 - DNA, 25 bp, Homo sapien
ttatataaggtcaaggaactaaata

SEQ ID NO: 648798 - DNA, 25 bp, Homo sapien
atataaggtcaaggaactaaatatt

SEQ ID NO: 648799 - DNA, 25 bp, Homo sapien
ctaaatattagtaaagagtcaggcc

SEQ ID NO: 648800 - DNA, 25 bp, Homo sapien
taaatattagtaaagagtcaggcca

SEQ ID NO: 648801 - DNA, 25 bp, Homo sapien
aaatattagtaaagagtcaggccag

SEQ ID NO: 648802 - DNA, 25 bp, Homo sapien
aatattagtaaagagtcaggccagg

SEQ ID NO: 648803 - DNA, 25 bp, Homo sapien
atattagtaaagagtcaggccaggc

SEQ ID NO: 648804 - DNA, 25 bp, Homo sapien
tattagtaaagagtcaggccaggcg

SEQ ID NO: 648805 - DNA, 25 bp, Homo sapien
attagtaaagagtcaggccaggcgt

SEQ ID NO: 648806 - DNA, 25 bp, Homo sapien
ttagtaaagagtcaggccaggcgtg

SEQ ID NO: 648807 - DNA, 25 bp, Homo sapien
aatgctataggccacggtgggcacc

SEQ ID NO: 648808 - DNA, 25 bp, Homo sapien
acggtgggcaccacgggactgctca

SEQ ID NO: 648809 - DNA, 25 bp, Homo sapien
cacaactcagagttccatgaggaca

SEQ ID NO: 648810 - DNA, 25 bp, Homo sapien
agcagggtgccccacacgtaaaatg

SEQ ID NO: 648811 - DNA, 25 bp, Homo sapien
ggtgccccacacgtaaaatgtgctt

SEQ ID NO: 648812 - DNA, 25 bp, Homo sapien
gagtcaagactggatcccgggccga

SEQ ID NO: 648813 - DNA, 25 bp, Homo sapien
agggcagaaccacacctttagtctc

SEQ ID NO: 648814 - DNA, 25 bp, Homo sapien
gaagcaaaaccatgaggcctcctaa

SEQ ID NO: 648815 - DNA, 25 bp, Homo sapien
atgaggcctcctaaattctggtagc

SEQ ID NO: 648816 - DNA, 25 bp, Homo sapien
gcctcctaaattctggtagcccagt

SEQ ID NO: 648817 - DNA, 25 bp, Homo sapien
tggtagcccagtgaacataacccaa

SEQ ID NO: 648818 - DNA, 25 bp, Homo sapien
taagaaatgaaatcttgctctgttg

SEQ ID NO: 648819 - DNA, 25 bp, Homo sapien
gctggagtggagtagtgccatcttt

SEQ ID NO: 648820 - DNA, 25 bp, Homo sapien
ctggagtggagtagtgccatctttg

SEQ ID NO: 648821 - DNA, 25 bp, Homo sapien
gtggagtagtgccatctttgttcac

SEQ ID NO: 648822 - DNA, 25 bp, Homo sapien
ggagtagtgccatctttgttcactg

SEQ ID NO: 648823 - DNA, 25 bp, Homo sapien
gagtagtgccatctttgttcactgc

SEQ ID NO: 648824 - DNA, 25 bp, Homo sapien
tagtgccatctttgttcactgcagc

SEQ ID NO: 648825 - DNA, 25 bp, Homo sapien
agtgccatctttgttcactgcagcc

SEQ ID NO: 648826 - DNA, 25 bp, Homo sapien
tatacccggccctattcctctgaaa

SEQ ID NO: 648827 - DNA, 25 bp, Homo sapien
tacccggccctattcctctgaaaag

SEQ ID NO: 648828 - DNA, 25 bp, Homo sapien
cggccctattcctctgaaaagctta

SEQ ID NO: 648829 - DNA, 25 bp, Homo sapien
acatggcaaagcccctactctaaaa

SEQ ID NO: 648830 - DNA, 25 bp, Homo sapien
catggcaaagcccctactctaaaaa

SEQ ID NO: 648831 - DNA, 25 bp, Homo sapien
aaaattaatcagatgtagtggtgtg

SEQ ID NO: 648832 - DNA, 25 bp, Homo sapien
attaatcagatgtagtggtgtgcac

SEQ ID NO: 648833 - DNA, 25 bp, Homo sapien
aatcagatgtagtggtgtgcacctg

SEQ ID NO: 648834 - DNA, 25 bp, Homo sapien
aaattagtcagcagtggtggtgtgt

SEQ ID NO: 648835 - DNA, 25 bp, Homo sapien
tcacctgagctcagggtgagccatg

SEQ ID NO: 648836 - DNA, 25 bp, Homo sapien
cacctgagctcagggtgagccatga

SEQ ID NO: 648837 - DNA, 25 bp, Homo sapien
cctgagctcagggtgagccatgatc

SEQ ID NO: 648838 - DNA, 25 bp, Homo sapien
ctgagctcagggtgagccatgatcg

SEQ ID NO: 648839 - DNA, 25 bp, Homo sapien
tgagctcagggtgagccatgatcgt

SEQ ID NO: 648840 - DNA, 25 bp, Homo sapien
ggaatggccatgactaaatgtatat

SEQ ID NO: 648841 - DNA, 25 bp, Homo sapien
tggtatgtaagaggccatgctgtta

SEQ ID NO: 648842 - DNA, 25 bp, Homo sapien
aagaggccatgctgttaaatgttgc

SEQ ID NO: 648843 - DNA, 25 bp, Homo sapien
ggccatgctgttaaatgttgcataa

SEQ ID NO: 648844 - DNA, 25 bp, Homo sapien
gcataaactaacacagattctgtag

SEQ ID NO: 648845 - DNA, 25 bp, Homo sapien
aactaacacagattctgtagtcaaa

SEQ ID NO: 648846 - DNA, 25 bp, Homo sapien
atgtgatttgtcattgagagattat

SEQ ID NO: 648847 - DNA, 25 bp, Homo sapien
tttaggaatctaatttaagtgcata

SEQ ID NO: 648848 - DNA, 25 bp, Homo sapien
aacctattccaagagtagaaaatgc

SEQ ID NO: 648849 - DNA, 25 bp, Homo sapien
taatgagattacttgggttcaactc

SEQ ID NO: 648850 - DNA, 25 bp, Homo sapien
atgagattacttgggttcaactcaa

SEQ ID NO: 648851 - DNA, 25 bp, Homo sapien
agcatcccccttgggaggatgagga

SEQ ID NO: 648852 - DNA, 25 bp, Homo sapien
aaggtcacattctcaggatggtgga

SEQ ID NO: 648853 - DNA, 25 bp, Homo sapien
gtcacattctcaggatggtggagaa

SEQ ID NO: 648854 - DNA, 25 bp, Homo sapien
agctagaaggagactgggtacctga

SEQ ID NO: 648855 - DNA, 25 bp, Homo sapien
aggagactgggtacctgatgtccgt

SEQ ID NO: 648856 - DNA, 25 bp, Homo sapien
agactgggtacctgatgtccgtggt

SEQ ID NO: 648857 - DNA, 25 bp, Homo sapien
ctgggtacctgatgtccgtggtgct

SEQ ID NO: 648858 - DNA, 25 bp, Homo sapien
tacctgatgtccgtggtgctgccct

SEQ ID NO: 648859 - DNA, 25 bp, Homo sapien
tggtgctgccctgttagctctggac

SEQ ID NO: 648860 - DNA, 25 bp, Homo sapien
ttagctctggactgcctttcttcaa

SEQ ID NO: 648861 - DNA, 25 bp, Homo sapien
tggactgcctttcttcaaattcctt

SEQ ID NO: 648862 - DNA, 25 bp, Homo sapien
actaacccaatacttttatcacttg

SEQ ID NO: 648863 - DNA, 25 bp, Homo sapien
acccaatacttttatcacttgtaat

SEQ ID NO: 648864 - DNA, 25 bp, Homo sapien
acttttatcacttgtaatttgtata

SEQ ID NO: 648865 - DNA, 25 bp, Homo sapien
tatattttagacttattagagaacg

SEQ ID NO: 648866 - DNA, 25 bp, Homo sapien
ttttaattggatatcactcttgtgc

SEQ ID NO: 648867 - DNA, 25 bp, Homo sapien
tgacttaccaccaggcaaaaatatt

SEQ ID NO: 648868 - DNA, 25 bp, Homo sapien
aagtatgctaataccaagtatcaag

SEQ ID NO: 648869 - DNA, 25 bp, Homo sapien
gaagaatgaagcaagatagctcaaa

SEQ ID NO: 648870 - DNA, 25 bp, Homo sapien
gatagctcaaatatgcttttgaagg

SEQ ID NO: 648871 - DNA, 25 bp, Homo sapien
aggaaatatactgggcttcattcat

SEQ ID NO: 648872 - DNA, 25 bp, Homo sapien
ctgggcttcattcattctgaaatac

SEQ ID NO: 648873 - DNA, 25 bp, Homo sapien
gaaatcctgacagcgagagttgctt

SEQ ID NO: 648874 - DNA, 25 bp, Homo sapien
gacagcgagagttgctttgtaaatt

SEQ ID NO: 648875 - DNA, 25 bp, Homo sapien
aatgtctttattgcaccaattatga

SEQ ID NO: 648876 - DNA, 25 bp, Homo sapien
cagcaagaaataaagcacacagctt

SEQ ID NO: 648877 - DNA, 25 bp, Homo sapien
acagctttgcactcctaaaaaatct

SEQ ID NO: 648878 - DNA, 25 bp, Homo sapien
gaagataggctataaagggctataa

SEQ ID NO: 648879 - DNA, 25 bp, Homo sapien
taaagtttagtttatgaccagggag

SEQ ID NO: 648880 - DNA, 25 bp, Homo sapien
ttatgaccagggaggttgttcagaa

SEQ ID NO: 648881 - DNA, 25 bp, Homo sapien
gatagttgagaggaagctaaccttt

SEQ ID NO: 648882 - DNA, 25 bp, Homo sapien
gaggaagctaacctttattgaactt

SEQ ID NO: 648883 - DNA, 25 bp, Homo sapien
tattgaacttctctctgggatcaga

SEQ ID NO: 648884 - DNA, 25 bp, Homo sapien
ccattctcacacagagttattatta

SEQ ID NO: 648885 - DNA, 25 bp, Homo sapien
agtcatatatttcaagtgctttcta

SEQ ID NO: 648886 - DNA, 25 bp, Homo sapien
agtgctttctaattcaaagtgcttc

SEQ ID NO: 648887 - DNA, 25 bp, Homo sapien
aaagtgcttctctatattcaagtac

SEQ ID NO: 648888 - DNA, 25 bp, Homo sapien
gtgcttctctatattcaagtactat

SEQ ID NO: 648889 - DNA, 25 bp, Homo sapien
caagtactatggtatcatttcaaac

SEQ ID NO: 648890 - DNA, 25 bp, Homo sapien
atggtatcatttcaaacatagcaaa

SEQ ID NO: 648891 - DNA, 25 bp, Homo sapien
tactttgtgaaaggcttctgtgaca

SEQ ID NO: 648892 - DNA, 25 bp, Homo sapien
tgtgaaaggcttctgtgacacacat

SEQ ID NO: 648893 - DNA, 25 bp, Homo sapien
atatttgatgtaccagttgctttgc

SEQ ID NO: 648894 - DNA, 25 bp, Homo sapien
tttgatgtaccagttgctttgctgt

SEQ ID NO: 648895 - DNA, 25 bp, Homo sapien
gagtggcccggctgatcccagtctt

SEQ ID NO: 648896 - DNA, 25 bp, Homo sapien
ccggctgatcccagtcttcctagtg

SEQ ID NO: 648897 - DNA, 25 bp, Homo sapien
tcttcctagtgaccctgcccaggaa

SEQ ID NO: 648898 - DNA, 25 bp, Homo sapien
atcttggaacctccataccagacca

SEQ ID NO: 648899 - DNA, 25 bp, Homo sapien
tcttggaacctccataccagaccag

SEQ ID NO: 648900 - DNA, 25 bp, Homo sapien
tccataccagaccagccacgagatg

SEQ ID NO: 648901 - DNA, 25 bp, Homo sapien
cataccagaccagccacgagatgaa

SEQ ID NO: 648902 - DNA, 25 bp, Homo sapien
taccagaccagccacgagatgaata

SEQ ID NO: 648903 - DNA, 25 bp, Homo sapien
accagaccagccacgagatgaataa

SEQ ID NO: 648904 - DNA, 25 bp, Homo sapien
ccagaccagccacgagatgaataat

SEQ ID NO: 648905 - DNA, 25 bp, Homo sapien
agaccagccacgagatgaataatac

SEQ ID NO: 648906 - DNA, 25 bp, Homo sapien
ttttagggaggagaaattgctggta

SEQ ID NO: 648907 - DNA, 25 bp, Homo sapien
gagaaattgctggtaaagtcctaaa

SEQ ID NO: 648908 - DNA, 25 bp, Homo sapien
gaaattgctggtaaagtcctaaaag

SEQ ID NO: 648909 - DNA, 25 bp, Homo sapien
tgctggtaaagtcctaaaaggaaat

SEQ ID NO: 648910 - DNA, 25 bp, Homo sapien
ttattaccaaatctgtcgtgtttat

SEQ ID NO: 648911 - DNA, 25 bp, Homo sapien
ttaccaaatctgtcgtgtttattat

SEQ ID NO: 648912 - DNA, 25 bp, Homo sapien
aagtataaataggaggccaggctag

SEQ ID NO: 648913 - DNA, 25 bp, Homo sapien
gtataaataggaggccaggctagat

SEQ ID NO: 648914 - DNA, 25 bp, Homo sapien
aaataggaggccaggctagatggct

SEQ ID NO: 648915 - DNA, 25 bp, Homo sapien
ggaggccaggctagatggctgacac

SEQ ID NO: 648916 - DNA, 25 bp, Homo sapien
ccaatgcagatgggttgcttgaggc

SEQ ID NO: 648917 - DNA, 25 bp, Homo sapien
aaatagctggaggaccttggcacca

SEQ ID NO: 648918 - DNA, 25 bp, Homo sapien
aatagctggaggaccttggcaccac

SEQ ID NO: 648919 - DNA, 25 bp, Homo sapien
atagctggaggaccttggcaccacc

SEQ ID NO: 648920 - DNA, 25 bp, Homo sapien
actattggtgttatgtgtaaattcc

SEQ ID NO: 648921 - DNA, 25 bp, Homo sapien
ctattggtgttatgtgtaaattcca

SEQ ID NO: 648922 - DNA, 25 bp, Homo sapien
tattggtgttatgtgtaaattccag

SEQ ID NO: 648923 - DNA, 25 bp, Homo sapien
attggtgttatgtgtaaattccaga

SEQ ID NO: 648924 - DNA, 25 bp, Homo sapien
ttggtgttatgtgtaaattccagac

SEQ ID NO: 648925 - DNA, 25 bp, Homo sapien
ggtgttatgtgtaaattccagacac

SEQ ID NO: 648926 - DNA, 25 bp, Homo sapien
aatgggggcttggggcctgagcgca

SEQ ID NO: 648927 - DNA, 25 bp, Homo sapien
atgggggcttggggcctgagcgcag

SEQ ID NO: 648928 - DNA, 25 bp, Homo sapien
tgggggcttggggcctgagcgcagt

SEQ ID NO: 648929 - DNA, 25 bp, Homo sapien
gggggcttggggcctgagcgcagtg

SEQ ID NO: 648930 - DNA, 25 bp, Homo sapien
ggggcttggggcctgagcgcagtgg

SEQ ID NO: 648931 - DNA, 25 bp, Homo sapien
gggcttggggcctgagcgcagtggc

SEQ ID NO: 648932 - DNA, 25 bp, Homo sapien
ggcttggggcctgagcgcagtggct

SEQ ID NO: 648933 - DNA, 25 bp, Homo sapien
agaccaccctgaccagcatgaaacc

SEQ ID NO: 648934 - DNA, 25 bp, Homo sapien
agaatcacttgggccagggatgctg

SEQ ID NO: 648935 - DNA, 25 bp, Homo sapien
gaatcacttgggccagggatgctga

SEQ ID NO: 648936 - DNA, 25 bp, Homo sapien
aatcacttgggccagggatgctgag

SEQ ID NO: 648937 - DNA, 25 bp, Homo sapien
atggagacaggacacaagctgcata

SEQ ID NO: 648938 - DNA, 25 bp, Homo sapien
acaggacacaagctgcataagggat

SEQ ID NO: 648939 - DNA, 25 bp, Homo sapien
tcctttgttcgggtgtgctgtcacc

SEQ ID NO: 648940 - DNA, 25 bp, Homo sapien
ctttgttcgggtgtgctgtcaccat

SEQ ID NO: 648941 - DNA, 25 bp, Homo sapien
gttcgggtgtgctgtcaccattgtt

SEQ ID NO: 648942 - DNA, 25 bp, Homo sapien
gggtgtgctgtcaccattgtttcat

SEQ ID NO: 648943 - DNA, 25 bp, Homo sapien
gtgtgctgtcaccattgtttcatct

SEQ ID NO: 648944 - DNA, 25 bp, Homo sapien
gtgctgtcaccattgtttcatctgt

SEQ ID NO: 648945 - DNA, 25 bp, Homo sapien
tgctgtcaccattgtttcatctgtg

SEQ ID NO: 648946 - DNA, 25 bp, Homo sapien
gtcaccattgtttcatctgtgagga

SEQ ID NO: 648947 - DNA, 25 bp, Homo sapien
accattgtttcatctgtgaggagca

SEQ ID NO: 648948 - DNA, 25 bp, Homo sapien
ggaggctaaggagggcggattacct

SEQ ID NO: 648949 - DNA, 25 bp, Homo sapien
gaggctaaggagggcggattacctg

SEQ ID NO: 648950 - DNA, 25 bp, Homo sapien
aggctaaggagggcggattacctga

SEQ ID NO: 648951 - DNA, 25 bp, Homo sapien
ggctaaggagggcggattacctgag

SEQ ID NO: 648952 - DNA, 25 bp, Homo sapien
ctaaggagggcggattacctgaggt

SEQ ID NO: 648953 - DNA, 25 bp, Homo sapien
taaggagggcggattacctgaggtc

SEQ ID NO: 648954 - DNA, 25 bp, Homo sapien
caacatggtgaaacaaaagtctact

SEQ ID NO: 648955 - DNA, 25 bp, Homo sapien
caggtgcctataatcacacctactt

SEQ ID NO: 648956 - DNA, 25 bp, Homo sapien
aggtgcctataatcacacctacttg

SEQ ID NO: 648957 - DNA, 25 bp, Homo sapien
ggtgcctataatcacacctacttgg

SEQ ID NO: 648958 - DNA, 25 bp, Homo sapien
gtgcctataatcacacctacttggg

SEQ ID NO: 648959 - DNA, 25 bp, Homo sapien
atcaagcaaatggacacccctgagt

SEQ ID NO: 648960 - DNA, 25 bp, Homo sapien
gagatggcccatttaaaatcaacag

SEQ ID NO: 648961 - DNA, 25 bp, Homo sapien
aaatcaacagttctacagggagcct

SEQ ID NO: 648962 - DNA, 25 bp, Homo sapien
gttctacagggagcctggcactcag

SEQ ID NO: 648963 - DNA, 25 bp, Homo sapien
ggcactcagcatcctggatttcaga

SEQ ID NO: 648964 - DNA, 25 bp, Homo sapien
tggatttcagaaccagacagacccc

SEQ ID NO: 648965 - DNA, 25 bp, Homo sapien
tgggtatccctcatcagccccaagg

SEQ ID NO: 648966 - DNA, 25 bp, Homo sapien
tcatcagccccaagggaaacgcatc

SEQ ID NO: 648967 - DNA, 25 bp, Homo sapien
gggaaacgcatccacattgcaaatc

SEQ ID NO: 648968 - DNA, 25 bp, Homo sapien
cacattgcaaatcctataaacacag

SEQ ID NO: 648969 - DNA, 25 bp, Homo sapien
gaaaacctcacttcttcagtgtgaa

SEQ ID NO: 648970 - DNA, 25 bp, Homo sapien
ccaggatcagctctttccctaaaga

SEQ ID NO: 648971 - DNA, 25 bp, Homo sapien
ttccctaaagagcaaacctggttat

SEQ ID NO: 648972 - DNA, 25 bp, Homo sapien
gcaaacctggttatctcgcaatgac

SEQ ID NO: 648973 - DNA, 25 bp, Homo sapien
taacacaaatgcaacatcagccggg

SEQ ID NO: 648974 - DNA, 25 bp, Homo sapien
catcagctgtttggcagtatccata

SEQ ID NO: 648975 - DNA, 25 bp, Homo sapien
gtttggcagtatccatatacgcctt

SEQ ID NO: 648976 - DNA, 25 bp, Homo sapien
agtatccatatacgcctttaccagt

SEQ ID NO: 648977 - DNA, 25 bp, Homo sapien
tatacgcctttaccagtatttattt

SEQ ID NO: 648978 - DNA, 25 bp, Homo sapien
taatctttttgtttaattcactcta

SEQ ID NO: 648979 - DNA, 25 bp, Homo sapien
aataatagccatgaaatcactggtt

SEQ ID NO: 648980 - DNA, 25 bp, Homo sapien
tcactggtttgatgtacggtttatt

SEQ ID NO: 648981 - DNA, 25 bp, Homo sapien
agccaacgtggaaagatagcttgag

SEQ ID NO: 648982 - DNA, 25 bp, Homo sapien
gccaacgtggaaagatagcttgagg

SEQ ID NO: 648983 - DNA, 25 bp, Homo sapien
ccaacgtggaaagatagcttgaggc

SEQ ID NO: 648984 - DNA, 25 bp, Homo sapien
tttgggaccagcctcggccaccgag

SEQ ID NO: 648985 - DNA, 25 bp, Homo sapien
ttgggaccagcctcggccaccgagc

SEQ ID NO: 648986 - DNA, 25 bp, Homo sapien
tgggaccagcctcggccaccgagcg

SEQ ID NO: 648987 - DNA, 25 bp, Homo sapien
gggaccagcctcggccaccgagcga

SEQ ID NO: 648988 - DNA, 25 bp, Homo sapien
ggaccagcctcggccaccgagcgag

SEQ ID NO: 648989 - DNA, 25 bp, Homo sapien
accagcctcggccaccgagcgagac

SEQ ID NO: 648990 - DNA, 25 bp, Homo sapien
cagcctcggccaccgagcgagaccc

SEQ ID NO: 648991 - DNA, 25 bp, Homo sapien
agcctcggccaccgagcgagaccct

SEQ ID NO: 648992 - DNA, 25 bp, Homo sapien
acttatgtgaggttgcccgcccgtc

SEQ ID NO: 648993 - DNA, 25 bp, Homo sapien
ttatgtgaggttgcccgcccgtctc

SEQ ID NO: 648994 - DNA, 25 bp, Homo sapien
catccatcccgtccggaaaagaagg

SEQ ID NO: 648995 - DNA, 25 bp, Homo sapien
gtggaggcgggacgccctccatctc

SEQ ID NO: 648996 - DNA, 25 bp, Homo sapien
atccgcgctctagcctgaaccctgg

SEQ ID NO: 648997 - DNA, 25 bp, Homo sapien
tgaaccctggcctgggccgagcagt

SEQ ID NO: 648998 - DNA, 25 bp, Homo sapien
agtggcagcagagagtggcctcgga

SEQ ID NO: 648999 - DNA, 25 bp, Homo sapien
tggcctcggagggaagccactgcca

SEQ ID NO: 649000 - DNA, 25 bp, Homo sapien
gaagccactgccacctgagacagcc

SEQ ID NO: 649001 - DNA, 25 bp, Homo sapien
tgagacagcccaagcagcaagataa

SEQ ID NO: 649002 - DNA, 25 bp, Homo sapien
aagcagcaagataaacccgctccac

SEQ ID NO: 649003 - DNA, 25 bp, Homo sapien
gaaagggctttcctccaaagctggg

SEQ ID NO: 649004 - DNA, 25 bp, Homo sapien
aaagctgggcctggtttctacagag

SEQ ID NO: 649005 - DNA, 25 bp, Homo sapien
gtttctacagagagtctttcacatg

SEQ ID NO: 649006 - DNA, 25 bp, Homo sapien
taagcagctctttgcaagcacctca

SEQ ID NO: 649007 - DNA, 25 bp, Homo sapien
gaacccctcaccctgatgaatcagg

SEQ ID NO: 649008 - DNA, 25 bp, Homo sapien
gggcggatccaagacaactggctgc

SEQ ID NO: 649009 - DNA, 25 bp, Homo sapien
caactggctgcgtgcatgtgaacaa

SEQ ID NO: 649010 - DNA, 25 bp, Homo sapien
gcatgtgaacaagcctatggtggaa

SEQ ID NO: 649011 - DNA, 25 bp, Homo sapien
tggaaaggcagtgctttattgtttg

SEQ ID NO: 649012 - DNA, 25 bp, Homo sapien
atcaccaggagggagaagcttctaa

SEQ ID NO: 649013 - DNA, 25 bp, Homo sapien
agcattcagaggtggctgttgcctg

SEQ ID NO: 649014 - DNA, 25 bp, Homo sapien
tctcactctttatccctgattgtat

SEQ ID NO: 649015 - DNA, 25 bp, Homo sapien
atccctgattgtattccttgttctg

SEQ ID NO: 649016 - DNA, 25 bp, Homo sapien
gattgtattccttgttctgaagtct

SEQ ID NO: 649017 - DNA, 25 bp, Homo sapien
aatatagtcatttctgcttttttgt

SEQ ID NO: 649018 - DNA, 25 bp, Homo sapien
gttaatgtttgcgtggtgtatcttt

SEQ ID NO: 649019 - DNA, 25 bp, Homo sapien
gtggtgtatctttttcccaccattt

SEQ ID NO: 649020 - DNA, 25 bp, Homo sapien
tcccaccatttttctatgcctttat

SEQ ID NO: 649021 - DNA, 25 bp, Homo sapien
aaagtatgtttctggtagacagcat

SEQ ID NO: 649022 - DNA, 25 bp, Homo sapien
catatagttggatactgctttttca

SEQ ID NO: 649023 - DNA, 25 bp, Homo sapien
ttcaatcatagaatctctgtcgttt

SEQ ID NO: 649024 - DNA, 25 bp, Homo sapien
atctctgtcgtttaactggtatatt

SEQ ID NO: 649025 - DNA, 25 bp, Homo sapien
gtgaagaatcaattggtacacatta

SEQ ID NO: 649026 - DNA, 25 bp, Homo sapien
gtacacattatgagtttttgcaacc

SEQ ID NO: 649027 - DNA, 25 bp, Homo sapien
atgagtttttgcaaccactccaaaa

SEQ ID NO: 649028 - DNA, 25 bp, Homo sapien
aagaatgctcatactcagatccctc

SEQ ID NO: 649029 - DNA, 25 bp, Homo sapien
tgctcatactcagatccctcagagt

SEQ ID NO: 649030 - DNA, 25 bp, Homo sapien
gacagaattaagtgagttcgttcat

SEQ ID NO: 649031 - DNA, 25 bp, Homo sapien
gttgtagatttgtcccaagagttga

SEQ ID NO: 649032 - DNA, 25 bp, Homo sapien
ttgaaggaacgggtctctgaagatg

SEQ ID NO: 649033 - DNA, 25 bp, Homo sapien
tgaagatgacgaaacccagccagaa

SEQ ID NO: 649034 - DNA, 25 bp, Homo sapien
agggactgagttacaatttgagcat

SEQ ID NO: 649035 - DNA, 25 bp, Homo sapien
tgagcatcttaattgggatccagag

SEQ ID NO: 649036 - DNA, 25 bp, Homo sapien
gtgtgcacctatcatatctagtctt

SEQ ID NO: 649037 - DNA, 25 bp, Homo sapien
tgtgcacctatcatatctagtcttt

SEQ ID NO: 649038 - DNA, 25 bp, Homo sapien
gtgcacctatcatatctagtctttg

SEQ ID NO: 649039 - DNA, 25 bp, Homo sapien
tgcacctatcatatctagtctttgg

SEQ ID NO: 649040 - DNA, 25 bp, Homo sapien
gcacctatcatatctagtctttgga

SEQ ID NO: 649041 - DNA, 25 bp, Homo sapien
cacctatcatatctagtctttggac

SEQ ID NO: 649042 - DNA, 25 bp, Homo sapien
acctatcatatctagtctttggact

SEQ ID NO: 649043 - DNA, 25 bp, Homo sapien
cctatcatatctagtctttggacta

SEQ ID NO: 649044 - DNA, 25 bp, Homo sapien
tagtctttggactagaaaaatctaa

SEQ ID NO: 649045 - DNA, 25 bp, Homo sapien
aaatggtttggtaagactttgctgt

SEQ ID NO: 649046 - DNA, 25 bp, Homo sapien
atggtttggtaagactttgctgttg

SEQ ID NO: 649047 - DNA, 25 bp, Homo sapien
gaaaaggccccatactatgaaatga

SEQ ID NO: 649048 - DNA, 25 bp, Homo sapien
tgtccttctgcatgaagcctggtga

SEQ ID NO: 649049 - DNA, 25 bp, Homo sapien
gataatgtaaccttcaagttccctt

SEQ ID NO: 649050 - DNA, 25 bp, Homo sapien
aagttcccttactgagccttgagct

SEQ ID NO: 649051 - DNA, 25 bp, Homo sapien
gagccttgagctcccttcaaagtat

SEQ ID NO: 649052 - DNA, 25 bp, Homo sapien
ttcaaagtatccaagccaaccctgt

SEQ ID NO: 649053 - DNA, 25 bp, Homo sapien
cctgtcttgggaaactcacctagat

SEQ ID NO: 649054 - DNA, 25 bp, Homo sapien
ctagataatgccctgaaccccaata

SEQ ID NO: 649055 - DNA, 25 bp, Homo sapien
tgggcatgtgtgtcctcaatgtctc

SEQ ID NO: 649056 - DNA, 25 bp, Homo sapien
aagcccttccagtaagccctgcaag

SEQ ID NO: 649057 - DNA, 25 bp, Homo sapien
tgcaaggtgtgctggccactgttct

SEQ ID NO: 649058 - DNA, 25 bp, Homo sapien
gaccacacttagaaccacggctcta

SEQ ID NO: 649059 - DNA, 25 bp, Homo sapien
acacttagaaccacggctctacaag

SEQ ID NO: 649060 - DNA, 25 bp, Homo sapien
agaaccacggctctacaagaaagga

SEQ ID NO: 649061 - DNA, 25 bp, Homo sapien
ccacggctctacaagaaaggagggt

SEQ ID NO: 649062 - DNA, 25 bp, Homo sapien
aaaggagggttatttgtcactgtgc

SEQ ID NO: 649063 - DNA, 25 bp, Homo sapien
aggagggttatttgtcactgtgctt

SEQ ID NO: 649064 - DNA, 25 bp, Homo sapien
gagggttatttgtcactgtgcttgc

SEQ ID NO: 649065 - DNA, 25 bp, Homo sapien
cactgtgcttgcctatgtacaacca

SEQ ID NO: 649066 - DNA, 25 bp, Homo sapien
tgtgcttgcctatgtacaaccacca

SEQ ID NO: 649067 - DNA, 25 bp, Homo sapien
gcttgcctatgtacaaccaccaaga

SEQ ID NO: 649068 - DNA, 25 bp, Homo sapien
tgcctatgtacaaccaccaagaaag

SEQ ID NO: 649069 - DNA, 25 bp, Homo sapien
gttcttgtctttgccaaatcttgca

SEQ ID NO: 649070 - DNA, 25 bp, Homo sapien
tcttgtctttgccaaatcttgcatt

SEQ ID NO: 649071 - DNA, 25 bp, Homo sapien
cttgtctttgccaaatcttgcattt

SEQ ID NO: 649072 - DNA, 25 bp, Homo sapien
tgtctttgccaaatcttgcatttat

SEQ ID NO: 649073 - DNA, 25 bp, Homo sapien
gtctttgccaaatcttgcatttatg

SEQ ID NO: 649074 - DNA, 25 bp, Homo sapien
ctttgccaaatcttgcatttatggg

SEQ ID NO: 649075 - DNA, 25 bp, Homo sapien
ttgccaaatcttgcatttatgggat

SEQ ID NO: 649076 - DNA, 25 bp, Homo sapien
gccaaatcttgcatttatgggatga

SEQ ID NO: 649077 - DNA, 25 bp, Homo sapien
aatcttgcatttatgggatgatacc

SEQ ID NO: 649078 - DNA, 25 bp, Homo sapien
tcttgcatttatgggatgatacctc

SEQ ID NO: 649079 - DNA, 25 bp, Homo sapien
ttgcatttatgggatgatacctctt

SEQ ID NO: 649080 - DNA, 25 bp, Homo sapien
tgagctgagagcacactgttcccaa

SEQ ID NO: 649081 - DNA, 25 bp, Homo sapien
aagctgcctccagtcattgtctaca

SEQ ID NO: 649082 - DNA, 25 bp, Homo sapien
gtcattgtctacatgctgcggaggg

SEQ ID NO: 649083 - DNA, 25 bp, Homo sapien
gagagactcttctacagtcattctt

SEQ ID NO: 649084 - DNA, 25 bp, Homo sapien
agtcattctttgcattggagctccc

SEQ ID NO: 649085 - DNA, 25 bp, Homo sapien
cactgcgatgcctaagactttctca

SEQ ID NO: 649086 - DNA, 25 bp, Homo sapien
agactttctcagagctgcatcacag

SEQ ID NO: 649087 - DNA, 25 bp, Homo sapien
agctgcatcacagttgtagcctctt

SEQ ID NO: 649088 - DNA, 25 bp, Homo sapien
tgtagcctctttctgtgttatcctc

SEQ ID NO: 649089 - DNA, 25 bp, Homo sapien
ctccattcatggcatcaggcctgaa

SEQ ID NO: 649090 - DNA, 25 bp, Homo sapien
taatggtccaaaggctttctctcac

SEQ ID NO: 649091 - DNA, 25 bp, Homo sapien
agccagagccacacggcctgtgaca

SEQ ID NO: 649092 - DNA, 25 bp, Homo sapien
agagccacacggcctgtgacagcat

SEQ ID NO: 649093 - DNA, 25 bp, Homo sapien
gaatcaaaccccaagctttgactct

SEQ ID NO: 649094 - DNA, 25 bp, Homo sapien
aaaccccaagctttgactctagatc

SEQ ID NO: 649095 - DNA, 25 bp, Homo sapien
accccaagctttgactctagatcaa

SEQ ID NO: 649096 - DNA, 25 bp, Homo sapien
aagctttgactctagatcaaaactc

SEQ ID NO: 649097 - DNA, 25 bp, Homo sapien
aaactctttccaccactatactctt

SEQ ID NO: 649098 - DNA, 25 bp, Homo sapien
tctttccaccactatactcttatag

SEQ ID NO: 649099 - DNA, 25 bp, Homo sapien
ccaccactatactcttatagggaaa

SEQ ID NO: 649100 - DNA, 25 bp, Homo sapien
atacaagggttaaaagagactctga

SEQ ID NO: 649101 - DNA, 25 bp, Homo sapien
aagagactctgagaggctggatgca

SEQ ID NO: 649102 - DNA, 25 bp, Homo sapien
ggccagggaccccacaaaacaagca

SEQ ID NO: 649103 - DNA, 25 bp, Homo sapien
gggaccccacaaaacaagcactcgg

SEQ ID NO: 649104 - DNA, 25 bp, Homo sapien
cgccagaagccaggatgttccaggg

SEQ ID NO: 649105 - DNA, 25 bp, Homo sapien
agccaggatgttccagggctcagca

SEQ ID NO: 649106 - DNA, 25 bp, Homo sapien
ctctgaatgacaatcgtgggtcccc

SEQ ID NO: 649107 - DNA, 25 bp, Homo sapien
tcgtggccgtcaccccttggagatc

SEQ ID NO: 649108 - DNA, 25 bp, Homo sapien
accccttggagatccccgagcaggg

SEQ ID NO: 649109 - DNA, 25 bp, Homo sapien
gggtgccttcgtgtcagaaccaaga

SEQ ID NO: 649110 - DNA, 25 bp, Homo sapien
gtcagaaccaagagtgttcacaggg

SEQ ID NO: 649111 - DNA, 25 bp, Homo sapien
aagagtgttcacaggggcagccccg

SEQ ID NO: 649112 - DNA, 25 bp, Homo sapien
agcatgagctctgttccgggaggac

SEQ ID NO: 649113 - DNA, 25 bp, Homo sapien
tctgcattcctgcagttaggtttac

SEQ ID NO: 649114 - DNA, 25 bp, Homo sapien
ctgcagttaggtttactgagctcta

SEQ ID NO: 649115 - DNA, 25 bp, Homo sapien
gagctctatggcctgagttattgct

SEQ ID NO: 649116 - DNA, 25 bp, Homo sapien
tggcctgagttattgctcttctatg

SEQ ID NO: 649117 - DNA, 25 bp, Homo sapien
attgctcttctatgtagttccagat

SEQ ID NO: 649118 - DNA, 25 bp, Homo sapien
tgtagttccagattaagggttaaga

SEQ ID NO: 649119 - DNA, 25 bp, Homo sapien
gaattctagtagagcaggagtattt

SEQ ID NO: 649120 - DNA, 25 bp, Homo sapien
gaagcggagggcttactctccacct

SEQ ID NO: 649121 - DNA, 25 bp, Homo sapien
ttcatggagatgacattcagtaaaa

SEQ ID NO: 649122 - DNA, 25 bp, Homo sapien
tagatggcttttgcggatcaggaac

SEQ ID NO: 649123 - DNA, 25 bp, Homo sapien
tttgcggatcaggaacaaagggtat

SEQ ID NO: 649124 - DNA, 25 bp, Homo sapien
gtttgacagctaccccaagcaaaat

SEQ ID NO: 649125 - DNA, 25 bp, Homo sapien
tgacagctaccccaagcaaaatatt

SEQ ID NO: 649126 - DNA, 25 bp, Homo sapien
gctaccccaagcaaaatattccagt

SEQ ID NO: 649127 - DNA, 25 bp, Homo sapien
taccccaagcaaaatattccagtgt

SEQ ID NO: 649128 - DNA, 25 bp, Homo sapien
cccaagcaaaatattccagtgtaat

SEQ ID NO: 649129 - DNA, 25 bp, Homo sapien
caaacccccagtaatgtcttttcat

SEQ ID NO: 649130 - DNA, 25 bp, Homo sapien
ctgtaaacatgtggatgagtgtacg

SEQ ID NO: 649131 - DNA, 25 bp, Homo sapien
gggcacaaaggaggtcataatacag

SEQ ID NO: 649132 - DNA, 25 bp, Homo sapien
caaaggaggtcataatacagttaac

SEQ ID NO: 649133 - DNA, 25 bp, Homo sapien
gaggtcataatacagttaaccaatg

SEQ ID NO: 649134 - DNA, 25 bp, Homo sapien
gtcataatacagttaaccaatgttt

SEQ ID NO: 649135 - DNA, 25 bp, Homo sapien
gatattaaaggaagtccttcaccta

SEQ ID NO: 649136 - DNA, 25 bp, Homo sapien
aaggaagtccttcacctagatggaa

SEQ ID NO: 649137 - DNA, 25 bp, Homo sapien
ggaagtccttcacctagatggaaat

SEQ ID NO: 649138 - DNA, 25 bp, Homo sapien
gtccttcacctagatggaaatgata

SEQ ID NO: 649139 - DNA, 25 bp, Homo sapien
gatggaaatgatactagatggaaat

SEQ ID NO: 649140 - DNA, 25 bp, Homo sapien
gatggaaatatggatctgtccaagg

SEQ ID NO: 649141 - DNA, 25 bp, Homo sapien
tctgtccaaggaattaagagctctg

SEQ ID NO: 649142 - DNA, 25 bp, Homo sapien
taagagctctggaagtggtaactac

SEQ ID NO: 649143 - DNA, 25 bp, Homo sapien
gagctctggaagtggtaactacctg

SEQ ID NO: 649144 - DNA, 25 bp, Homo sapien
tctggaagtggtaactacctgaata

SEQ ID NO: 649145 - DNA, 25 bp, Homo sapien
gccaaaaacaatgtagtttgtggtt

SEQ ID NO: 649146 - DNA, 25 bp, Homo sapien
cccagactaatttttctgatgacaa

SEQ ID NO: 649147 - DNA, 25 bp, Homo sapien
tgcttgttgatgtgaattctgatat

SEQ ID NO: 649148 - DNA, 25 bp, Homo sapien
gaattctgatatggcacacacttga

SEQ ID NO: 649149 - DNA, 25 bp, Homo sapien
acacacttgagcctcactttgttag

SEQ ID NO: 649150 - DNA, 25 bp, Homo sapien
cacttgagcctcactttgttagcta

SEQ ID NO: 649151 - DNA, 25 bp, Homo sapien
cttgagcctcactttgttagctatt

SEQ ID NO: 649152 - DNA, 25 bp, Homo sapien
gagcctcactttgttagctattaat

SEQ ID NO: 649153 - DNA, 25 bp, Homo sapien
gttagctattaatttgtgttactga

SEQ ID NO: 649154 - DNA, 25 bp, Homo sapien
gtgttactgaatttacaggcttgga

SEQ ID NO: 649155 - DNA, 25 bp, Homo sapien
tactgaatttacaggcttggaatac

SEQ ID NO: 649156 - DNA, 25 bp, Homo sapien
caggcttggaatacaatttgtgctt

SEQ ID NO: 649157 - DNA, 25 bp, Homo sapien
gtgtgtgttacaactgttcagctct

SEQ ID NO: 649158 - DNA, 25 bp, Homo sapien
actgttcagctctaactttgtatga

SEQ ID NO: 649159 - DNA, 25 bp, Homo sapien
tagccataggcaatacacaaatcaa

SEQ ID NO: 649160 - DNA, 25 bp, Homo sapien
atacacaaatcaatgcaccatctgt

SEQ ID NO: 649161 - DNA, 25 bp, Homo sapien
taaaaacaggtcacgggccacattt

SEQ ID NO: 649162 - DNA, 25 bp, Homo sapien
acatttggcccatcagccatagttt

SEQ ID NO: 649163 - DNA, 25 bp, Homo sapien
tggcccatcagccatagtttcccaa

SEQ ID NO: 649164 - DNA, 25 bp, Homo sapien
agtttcccaacctctgctttggaag

SEQ ID NO: 649165 - DNA, 25 bp, Homo sapien
gctttggaaggcctaactcagttaa

SEQ ID NO: 649166 - DNA, 25 bp, Homo sapien
gttaaacattacaagttcatgcagc

SEQ ID NO: 649167 - DNA, 25 bp, Homo sapien
catgcagcacggtgtgatggctcac

SEQ ID NO: 649168 - DNA, 25 bp, Homo sapien
gaacaagttcaacaagtagaaaagt

SEQ ID NO: 649169 - DNA, 25 bp, Homo sapien
gaaaagttacaaacgtagtagatat

SEQ ID NO: 649170 - DNA, 25 bp, Homo sapien
caaacgtagtagatatgaatccaat

SEQ ID NO: 649171 - DNA, 25 bp, Homo sapien
acgtagtagatatgaatccaattat

SEQ ID NO: 649172 - DNA, 25 bp, Homo sapien
cactttgaatgtgaatggtctaaac

SEQ ID NO: 649173 - DNA, 25 bp, Homo sapien
tgaatgtgaatggtctaaacatacc

SEQ ID NO: 649174 - DNA, 25 bp, Homo sapien
gtgaatggtctaaacataccattga

SEQ ID NO: 649175 - DNA, 25 bp, Homo sapien
ggtctaaacataccattgaacatat

SEQ ID NO: 649176 - DNA, 25 bp, Homo sapien
gtctaaacataccattgaacatatt

SEQ ID NO: 649177 - DNA, 25 bp, Homo sapien
ctaaacataccattgaacatattga

SEQ ID NO: 649178 - DNA, 25 bp, Homo sapien
cataccattgaacatattgaaaccc

SEQ ID NO: 649179 - DNA, 25 bp, Homo sapien
tcctaactccattttacaagcaaag

SEQ ID NO: 649180 - DNA, 25 bp, Homo sapien
attttacaagcaaagatcaaggttt

SEQ ID NO: 649181 - DNA, 25 bp, Homo sapien
atcaaggtttacatccattaagttc

SEQ ID NO: 649182 - DNA, 25 bp, Homo sapien
ggtttacatccattaagttcttgag

SEQ ID NO: 649183 - DNA, 25 bp, Homo sapien
acatccattaagttcttgagccaat

SEQ ID NO: 649184 - DNA, 25 bp, Homo sapien
attaagttcttgagccaatgatggc

SEQ ID NO: 649185 - DNA, 25 bp, Homo sapien
gttcttgagccaatgatggcatcag

SEQ ID NO: 649186 - DNA, 25 bp, Homo sapien
gatggcatcaggattagtacccaat

SEQ ID NO: 649187 - DNA, 25 bp, Homo sapien
atcaggattagtacccaattcttct

SEQ ID NO: 649188 - DNA, 25 bp, Homo sapien
acccaattcttctgatatcaaagac

SEQ ID NO: 649189 - DNA, 25 bp, Homo sapien
cttctgatatcaaagactgacctaa

SEQ ID NO: 649190 - DNA, 25 bp, Homo sapien
tagatgtttttaatcagcagggtct

SEQ ID NO: 649191 - DNA, 25 bp, Homo sapien
ggcatgcgaaattgcttaaggattt

SEQ ID NO: 649192 - DNA, 25 bp, Homo sapien
taacagatggtatctcaggttgctg

SEQ ID NO: 649193 - DNA, 25 bp, Homo sapien
gctgttatttttgagaactcttttc

SEQ ID NO: 649194 - DNA, 25 bp, Homo sapien
ttttgagaactcttttcgacagaag

SEQ ID NO: 649195 - DNA, 25 bp, Homo sapien
tcgacagaagaaatccctaagaacc

SEQ ID NO: 649196 - DNA, 25 bp, Homo sapien
ggagatagtctgtgaacctgctttg

SEQ ID NO: 649197 - DNA, 25 bp, Homo sapien
gatagtctgtgaacctgctttgagg

SEQ ID NO: 649198 - DNA, 25 bp, Homo sapien
gaacctgctttgaggttacaaagga

SEQ ID NO: 649199 - DNA, 25 bp, Homo sapien
tgtctgtcagtcacttgcaaagagc

SEQ ID NO: 649200 - DNA, 25 bp, Homo sapien
gtcacttgcaaagagctgataactt

SEQ ID NO: 649201 - DNA, 25 bp, Homo sapien
gcattcaataaatctttacagagtt

SEQ ID NO: 649202 - DNA, 25 bp, Homo sapien
tttacagagttaatctttacagagg

SEQ ID NO: 649203 - DNA, 25 bp, Homo sapien
gaggacaattctcctgtagacagga

SEQ ID NO: 649204 - DNA, 25 bp, Homo sapien
ggacaaataacgaggcaaggccttt

SEQ ID NO: 649205 - DNA, 25 bp, Homo sapien
gaggcaaggcctttgtacctttcag

SEQ ID NO: 649206 - DNA, 25 bp, Homo sapien
gtacctttcagccatctgcaaaatg

SEQ ID NO: 649207 - DNA, 25 bp, Homo sapien
caaattttggtaggcatggctttca

SEQ ID NO: 649208 - DNA, 25 bp, Homo sapien
taggcatggctttcagagaagtctg

SEQ ID NO: 649209 - DNA, 25 bp, Homo sapien
gaagtctgacagaagctatgcatga

SEQ ID NO: 649210 - DNA, 25 bp, Homo sapien
aaaatcctgaagtggcttagtgata

SEQ ID NO: 649211 - DNA, 25 bp, Homo sapien
ggtgtgggtggttcttttaagtgca

SEQ ID NO: 649212 - DNA, 25 bp, Homo sapien
agcccaggcttttctttccatcgga

SEQ ID NO: 649213 - DNA, 25 bp, Homo sapien
caggcttttctttccatcggaaaat

SEQ ID NO: 649214 - DNA, 25 bp, Homo sapien
tttccatcggaaaattatcatctca

SEQ ID NO: 649215 - DNA, 25 bp, Homo sapien
ttatcatctcaataagcacttcagt

SEQ ID NO: 649216 - DNA, 25 bp, Homo sapien
taagcacttcagtaagaaaaaccac

SEQ ID NO: 649217 - DNA, 25 bp, Homo sapien
aaaaaccacaacataatcatcgaag

SEQ ID NO: 649218 - DNA, 25 bp, Homo sapien
ataatcatcgaagcaatccctcacg

SEQ ID NO: 649219 - DNA, 25 bp, Homo sapien
atcatcgaagcaatccctcacggat

SEQ ID NO: 649220 - DNA, 25 bp, Homo sapien
gaagcaatccctcacggatggagtt

SEQ ID NO: 649221 - DNA, 25 bp, Homo sapien
agcaatccctcacggatggagttga

SEQ ID NO: 649222 - DNA, 25 bp, Homo sapien
aatccctcacggatggagttgaggc

SEQ ID NO: 649223 - DNA, 25 bp, Homo sapien
agccaacgtggaaagatagcttgag

SEQ ID NO: 649224 - DNA, 25 bp, Homo sapien
gccaacgtggaaagatagcttgagg

SEQ ID NO: 649225 - DNA, 25 bp, Homo sapien
ccaacgtggaaagatagcttgaggc

SEQ ID NO: 649226 - DNA, 25 bp, Homo sapien
aacgtggaaagatagcttgaggccg

SEQ ID NO: 649227 - DNA, 25 bp, Homo sapien
tttgggaccagcctcggccaccgag

SEQ ID NO: 649228 - DNA, 25 bp, Homo sapien
accagcctcggccaccgagcgagac

SEQ ID NO: 649229 - DNA, 25 bp, Homo sapien
gtgtgcacctatcatatctagtctt

SEQ ID NO: 649230 - DNA, 25 bp, Homo sapien
acctatcatatctagtctttggact

SEQ ID NO: 649231 - DNA, 25 bp, Homo sapien
aatggtttggtaagactttgctgtt

SEQ ID NO: 649232 - DNA, 25 bp, Homo sapien
gcaccagggaccagactggttttgt

SEQ ID NO: 649233 - DNA, 25 bp, Homo sapien
agacagtttttccactgataaagtt

SEQ ID NO: 649234 - DNA, 25 bp, Homo sapien
catctcagacttggagcctgtccaa

SEQ ID NO: 649235 - DNA, 25 bp, Homo sapien
gcaatggaacctgggaggaccgcca

SEQ ID NO: 649236 - DNA, 25 bp, Homo sapien
aggaccgccagccaggttggctcaa

SEQ ID NO: 649237 - DNA, 25 bp, Homo sapien
gttggctcaagctgagagacccctg

SEQ ID NO: 649238 - DNA, 25 bp, Homo sapien
gagacccctgcagagtagggctgta

SEQ ID NO: 649239 - DNA, 25 bp, Homo sapien
ccctggtcccatggtagatagcgta

SEQ ID NO: 649240 - DNA, 25 bp, Homo sapien
agatagcgtaagaccctgcagacat

SEQ ID NO: 649241 - DNA, 25 bp, Homo sapien
cctgcagacatcagaggtcatggct

SEQ ID NO: 649242 - DNA, 25 bp, Homo sapien
tgaaggtgccagatttcctgccctg

SEQ ID NO: 649243 - DNA, 25 bp, Homo sapien
gccctgcagggcattaggcatggct

SEQ ID NO: 649244 - DNA, 25 bp, Homo sapien
attaggcatggctgccagtcccagg

SEQ ID NO: 649245 - DNA, 25 bp, Homo sapien
tcattgcacagctgaggagcccgga

SEQ ID NO: 649246 - DNA, 25 bp, Homo sapien
agaccacagggctaggactgtgatt

SEQ ID NO: 649247 - DNA, 25 bp, Homo sapien
ctaggactgtgatttccagtttgcc

SEQ ID NO: 649248 - DNA, 25 bp, Homo sapien
accaacatcagccatcaaatcagct

SEQ ID NO: 649249 - DNA, 25 bp, Homo sapien
tcaaatcagctgaccgccctgatga

SEQ ID NO: 649250 - DNA, 25 bp, Homo sapien
gccctgatgagggtccatgtgacat

SEQ ID NO: 649251 - DNA, 25 bp, Homo sapien
gagggtccatgtgacatctcttgta

SEQ ID NO: 649252 - DNA, 25 bp, Homo sapien
tgacatctcttgtacttcagaaaga

SEQ ID NO: 649253 - DNA, 25 bp, Homo sapien
cagaaagagtcttgttctccaaact

SEQ ID NO: 649254 - DNA, 25 bp, Homo sapien
caagaatctgacctacctaacacat

SEQ ID NO: 649255 - DNA, 25 bp, Homo sapien
acctaacacatgtatgttccctgaa

SEQ ID NO: 649256 - DNA, 25 bp, Homo sapien
ggagttattttctagagttaacctg

SEQ ID NO: 649257 - DNA, 25 bp, Homo sapien
ttattttctagagttaacctgaagc

SEQ ID NO: 649258 - DNA, 25 bp, Homo sapien
ttttctagagttaacctgaagcagt

SEQ ID NO: 649259 - DNA, 25 bp, Homo sapien
ttctagagttaacctgaagcagtgg

SEQ ID NO: 649260 - DNA, 25 bp, Homo sapien
ctagagttaacctgaagcagtggcc

SEQ ID NO: 649261 - DNA, 25 bp, Homo sapien
tagagttaacctgaagcagtggccg

SEQ ID NO: 649262 - DNA, 25 bp, Homo sapien
gaagcagtggccgagtgccatgcac

SEQ ID NO: 649263 - DNA, 25 bp, Homo sapien
aagcagtggccgagtgccatgcaca

SEQ ID NO: 649264 - DNA, 25 bp, Homo sapien
gcagtggccgagtgccatgcacacg

SEQ ID NO: 649265 - DNA, 25 bp, Homo sapien
cagtggccgagtgccatgcacacgt

SEQ ID NO: 649266 - DNA, 25 bp, Homo sapien
tgccatgcacacgtgtaatctcagc

SEQ ID NO: 649267 - DNA, 25 bp, Homo sapien
acgaatgtgtgccatccgtggaatt

SEQ ID NO: 649268 - DNA, 25 bp, Homo sapien
gcctcaccctctcaagtactggaat

SEQ ID NO: 649269 - DNA, 25 bp, Homo sapien
atacccagcccaaatttcactcttt

SEQ ID NO: 649270 - DNA, 25 bp, Homo sapien
ccagcccaaatttcactctttaatg

SEQ ID NO: 649271 - DNA, 25 bp, Homo sapien
gcccaaatttcactctttaatgttt

SEQ ID NO: 649272 - DNA, 25 bp, Homo sapien
ttcactctttaatgttttcctgttg

SEQ ID NO: 649273 - DNA, 25 bp, Homo sapien
ctctttaatgttttcctgttgctat

SEQ ID NO: 649274 - DNA, 25 bp, Homo sapien
atgttttcctgttgctattctttaa

SEQ ID NO: 649275 - DNA, 25 bp, Homo sapien
gaaaaaactttcctattcagacagt

SEQ ID NO: 649276 - DNA, 25 bp, Homo sapien
aaactttcctattcagacagtgtga

SEQ ID NO: 649277 - DNA, 25 bp, Homo sapien
ttcctattcagacagtgtgaaaatc

SEQ ID NO: 649278 - DNA, 25 bp, Homo sapien
ctgcagtgtgagcttagaatgaagt

SEQ ID NO: 649279 - DNA, 25 bp, Homo sapien
tgaagttgataatagtgagaccttg

SEQ ID NO: 649280 - DNA, 25 bp, Homo sapien
gagaccttgttggtacaagactatg

SEQ ID NO: 649281 - DNA, 25 bp, Homo sapien
agactatgtaacacaacctgcactt

SEQ ID NO: 649282 - DNA, 25 bp, Homo sapien
atgtaacacaacctgcacttctcaa

SEQ ID NO: 649283 - DNA, 25 bp, Homo sapien
ttttctgacttctgcactcaatagc

SEQ ID NO: 649284 - DNA, 25 bp, Homo sapien
gacttctgcactcaatagcaagaca

SEQ ID NO: 649285 - DNA, 25 bp, Homo sapien
tgcctcctcatcagactactcaatg

SEQ ID NO: 649286 - DNA, 25 bp, Homo sapien
tcctcatcagactactcaatgtgaa

SEQ ID NO: 649287 - DNA, 25 bp, Homo sapien
cagactactcaatgtgaaggcaata

SEQ ID NO: 649288 - DNA, 25 bp, Homo sapien
atgtataataattcacttccactta

SEQ ID NO: 649289 - DNA, 25 bp, Homo sapien
ggagcatgtcaggaccaagcctgga

SEQ ID NO: 649290 - DNA, 25 bp, Homo sapien
accaagcctggagccctgagtgagc

SEQ ID NO: 649291 - DNA, 25 bp, Homo sapien
gagctcgtggagcagaatctcccga

SEQ ID NO: 649292 - DNA, 25 bp, Homo sapien
gtggagcagaatctcccgacaccca

SEQ ID NO: 649293 - DNA, 25 bp, Homo sapien
aaacaatagcccacacttctagggt

SEQ ID NO: 649294 - DNA, 25 bp, Homo sapien
cccacacttctagggtaaagcattt

SEQ ID NO: 649295 - DNA, 25 bp, Homo sapien
ttattttctcaacaacccaagagaa

SEQ ID NO: 649296 - DNA, 25 bp, Homo sapien
acaacccaagagaatcaacaggcag

SEQ ID NO: 649297 - DNA, 25 bp, Homo sapien
caacaggcagggatttcgtattcat

SEQ ID NO: 649298 - DNA, 25 bp, Homo sapien
ggcagggatttcgtattcatttaat

SEQ ID NO: 649299 - DNA, 25 bp, Homo sapien
aatacaggcaaaacctgagattcag

SEQ ID NO: 649300 - DNA, 25 bp, Homo sapien
gaagctaaaagaaccacacaccatg

SEQ ID NO: 649301 - DNA, 25 bp, Homo sapien
agaaccacacaccatgtccagaagt

SEQ ID NO: 649302 - DNA, 25 bp, Homo sapien
acacaccatgtccagaagtcaaaag

SEQ ID NO: 649303 - DNA, 25 bp, Homo sapien
gaagtcaaaagtttctcatctggct

SEQ ID NO: 649304 - DNA, 25 bp, Homo sapien
aagtttctcatctggctttctgatc

SEQ ID NO: 649305 - DNA, 25 bp, Homo sapien
atctggctttctgatctcttactaa

SEQ ID NO: 649306 - DNA, 25 bp, Homo sapien
ctggctttctgatctcttactaatg

SEQ ID NO: 649307 - DNA, 25 bp, Homo sapien
gaaagctttgtttgaccacctaact

SEQ ID NO: 649308 - DNA, 25 bp, Homo sapien
tttgtttgaccacctaactgctcga

SEQ ID NO: 649309 - DNA, 25 bp, Homo sapien
ttgaccacctaactgctcgaggcat

SEQ ID NO: 649310 - DNA, 25 bp, Homo sapien
acctaactgctcgaggcattcaagt

SEQ ID NO: 649311 - DNA, 25 bp, Homo sapien
gttgccaagggtagaatgcagtgtc

SEQ ID NO: 649312 - DNA, 25 bp, Homo sapien
ggtagaatgcagtgtcgggatcata

SEQ ID NO: 649313 - DNA, 25 bp, Homo sapien
catagctcactacagacttgacatc

SEQ ID NO: 649314 - DNA, 25 bp, Homo sapien
tagctcactacagacttgacatcct

SEQ ID NO: 649315 - DNA, 25 bp, Homo sapien
agctcactacagacttgacatcctg

SEQ ID NO: 649316 - DNA, 25 bp, Homo sapien
ccactggcgcgcgacaaataatttg

SEQ ID NO: 649317 - DNA, 25 bp, Homo sapien
cactggcgcgcgacaaataatttga

SEQ ID NO: 649318 - DNA, 25 bp, Homo sapien
actggcgcgcgacaaataatttgaa

SEQ ID NO: 649319 - DNA, 25 bp, Homo sapien
atggcagatatcatagaatgagaac

SEQ ID NO: 649320 - DNA, 25 bp, Homo sapien
ttttaattcactagccactaaccag

SEQ ID NO: 649321 - DNA, 25 bp, Homo sapien
taattcactagccactaaccagtta

SEQ ID NO: 649322 - DNA, 25 bp, Homo sapien
cacctgctgaaacggggttcctaat

SEQ ID NO: 649323 - DNA, 25 bp, Homo sapien
taaagttatgcttcttgcagattag

SEQ ID NO: 649324 - DNA, 25 bp, Homo sapien
atgcttcttgcagattagagtttgt

SEQ ID NO: 649325 - DNA, 25 bp, Homo sapien
gattagagtttgtaggctgagttgt

SEQ ID NO: 649326 - DNA, 25 bp, Homo sapien
gtaggctgagttgtacctactatat

SEQ ID NO: 649327 - DNA, 25 bp, Homo sapien
attgcaagagaaacggcacttgtga

SEQ ID NO: 649328 - DNA, 25 bp, Homo sapien
acggcacttgtgatttttatccatt

SEQ ID NO: 649329 - DNA, 25 bp, Homo sapien
ttccttctagtctttgaatttagaa

SEQ ID NO: 649330 - DNA, 25 bp, Homo sapien
cttgccacaagttcaggtcaaatga

SEQ ID NO: 649331 - DNA, 25 bp, Homo sapien
gttcaggtcaaatgactgcagcatt

SEQ ID NO: 649332 - DNA, 25 bp, Homo sapien
caaatgactgcagcattttgagtga

SEQ ID NO: 649333 - DNA, 25 bp, Homo sapien
tgcttccctcatctgaaaaggccaa

SEQ ID NO: 649334 - DNA, 25 bp, Homo sapien
ccttcacctgtccaaatagcacatt

SEQ ID NO: 649335 - DNA, 25 bp, Homo sapien
aggatctcgcttttcctgggaagtc

SEQ ID NO: 649336 - DNA, 25 bp, Homo sapien
aatcctttgtctcactccctgtaag

SEQ ID NO: 649337 - DNA, 25 bp, Homo sapien
tgtaagccccgtcacgttctcaaaa

SEQ ID NO: 649338 - DNA, 25 bp, Homo sapien
gttctcaaaatcctttgcacctcaa

SEQ ID NO: 649339 - DNA, 25 bp, Homo sapien
aatcctttgcacctcaagttaggga

SEQ ID NO: 649340 - DNA, 25 bp, Homo sapien
aagttagggattccactggtctcct

SEQ ID NO: 649341 - DNA, 25 bp, Homo sapien
ctggtctcctgattgtgtctattga

SEQ ID NO: 649342 - DNA, 25 bp, Homo sapien
gtgtctattgatattcctctggtct

SEQ ID NO: 649343 - DNA, 25 bp, Homo sapien
attcctctggtcttgtcttgtataa

SEQ ID NO: 649344 - DNA, 25 bp, Homo sapien
atcctaatgggtatgggtgtgtcac

SEQ ID NO: 649345 - DNA, 25 bp, Homo sapien
tatgggtgtgtcacgcagactgtta

SEQ ID NO: 649346 - DNA, 25 bp, Homo sapien
gtcacgcagactgttattttcctcc

SEQ ID NO: 649347 - DNA, 25 bp, Homo sapien
ttattttcctccctggcacgaagtg

SEQ ID NO: 649348 - DNA, 25 bp, Homo sapien
cctggcacgaagtggttgtgctctt

SEQ ID NO: 649349 - DNA, 25 bp, Homo sapien
tgctttatcaaagtgcaaatgctgt

SEQ ID NO: 649350 - DNA, 25 bp, Homo sapien
gcaaatgctgtggttcctgagacat

SEQ ID NO: 649351 - DNA, 25 bp, Homo sapien
gctgtggttcctgagacataaccct

SEQ ID NO: 649352 - DNA, 25 bp, Homo sapien
aagcacacgtgccaagtgttcagtg

SEQ ID NO: 649353 - DNA, 25 bp, Homo sapien
agtgttcagtgatctcccatttaca

SEQ ID NO: 649354 - DNA, 25 bp, Homo sapien
gatctcccatttacagggtatcgag

SEQ ID NO: 649355 - DNA, 25 bp, Homo sapien
gaaacagtgcaagaagagaaatcac

SEQ ID NO: 649356 - DNA, 25 bp, Homo sapien
tgcaagaagagaaatcactgaggcc

SEQ ID NO: 649357 - DNA, 25 bp, Homo sapien
gcaagaagagaaatcactgaggccg

SEQ ID NO: 649358 - DNA, 25 bp, Homo sapien
caagaagagaaatcactgaggccga

SEQ ID NO: 649359 - DNA, 25 bp, Homo sapien
aagaagagaaatcactgaggccgag

SEQ ID NO: 649360 - DNA, 25 bp, Homo sapien
agaagagaaatcactgaggccgagc

SEQ ID NO: 649361 - DNA, 25 bp, Homo sapien
aagagaaatcactgaggccgagcgt

SEQ ID NO: 649362 - DNA, 25 bp, Homo sapien
agagaaatcactgaggccgagcgtg

SEQ ID NO: 649363 - DNA, 25 bp, Homo sapien
agaaatcactgaggccgagcgtggt

SEQ ID NO: 649364 - DNA, 25 bp, Homo sapien
gaaatcactgaggccgagcgtggtg

SEQ ID NO: 649365 - DNA, 25 bp, Homo sapien
aaatcactgaggccgagcgtggtgg

SEQ ID NO: 649366 - DNA, 25 bp, Homo sapien
gcttctgccctgtggccaccgggaa

SEQ ID NO: 649367 - DNA, 25 bp, Homo sapien
tgccctgtggccaccgggaagtcca

SEQ ID NO: 649368 - DNA, 25 bp, Homo sapien
ggattctagggccaggacccttggg

SEQ ID NO: 649369 - DNA, 25 bp, Homo sapien
ggacctttccaaaggccttgtcact

SEQ ID NO: 649370 - DNA, 25 bp, Homo sapien
ccaaaggccttgtcactgtgaagca

SEQ ID NO: 649371 - DNA, 25 bp, Homo sapien
ttgtcactgtgaagcacaagagaag

SEQ ID NO: 649372 - DNA, 25 bp, Homo sapien
actgtgaagcacaagagaagcaaaa

SEQ ID NO: 649373 - DNA, 25 bp, Homo sapien
gagaagcaaaattgctttgcccagt

SEQ ID NO: 649374 - DNA, 25 bp, Homo sapien
gaagcaaaattgctttgcccagttc

SEQ ID NO: 649375 - DNA, 25 bp, Homo sapien
agcaaaattgctttgcccagttccc

SEQ ID NO: 649376 - DNA, 25 bp, Homo sapien
caaaattgctttgcccagttcccgg

SEQ ID NO: 649377 - DNA, 25 bp, Homo sapien
gagtgtggtcactacatgctatgaa

SEQ ID NO: 649378 - DNA, 25 bp, Homo sapien
gaaacagcaggtgaattcagttcca

SEQ ID NO: 649379 - DNA, 25 bp, Homo sapien
attcagttccaagggcttatttcaa

SEQ ID NO: 649380 - DNA, 25 bp, Homo sapien
gggcttatttcaagactaatggatt

SEQ ID NO: 649381 - DNA, 25 bp, Homo sapien
ggatttttgacacataggcttgaac

SEQ ID NO: 649382 - DNA, 25 bp, Homo sapien
aggcttgaactttgcttcaaaacaa

SEQ ID NO: 649383 - DNA, 25 bp, Homo sapien
aatgctggacttggccttctatcat

SEQ ID NO: 649384 - DNA, 25 bp, Homo sapien
taacccttatctccaactacttcat

SEQ ID NO: 649385 - DNA, 25 bp, Homo sapien
gccaggcattgtgctgagcttggta

SEQ ID NO: 649386 - DNA, 25 bp, Homo sapien
aatacaatatagacactgcctgcaa

SEQ ID NO: 649387 - DNA, 25 bp, Homo sapien
atagacactgcctgcaaggacttaa

SEQ ID NO: 649388 - DNA, 25 bp, Homo sapien
tcctccactttagcctctcgagtac

SEQ ID NO: 649389 - DNA, 25 bp, Homo sapien
ttggactcaagcaatgtacccacct

SEQ ID NO: 649390 - DNA, 25 bp, Homo sapien
aggattaaggcatgagtcagtctta

SEQ ID NO: 649391 - DNA, 25 bp, Homo sapien
tgagtcagtcttaaaatggctaatt

SEQ ID NO: 649392 - DNA, 25 bp, Homo sapien
tggctaattttatgtcatgcaaatc

SEQ ID NO: 649393 - DNA, 25 bp, Homo sapien
ttatgtcatgcaaatcttatcccca

SEQ ID NO: 649394 - DNA, 25 bp, Homo sapien
atgtcatgcaaatcttatccccatc

SEQ ID NO: 649395 - DNA, 25 bp, Homo sapien
tgtcatgcaaatcttatccccatca

SEQ ID NO: 649396 - DNA, 25 bp, Homo sapien
gtcatgcaaatcttatccccatcaa

SEQ ID NO: 649397 - DNA, 25 bp, Homo sapien
tcatgcaaatcttatccccatcaaa

SEQ ID NO: 649398 - DNA, 25 bp, Homo sapien
tgcaaatcttatccccatcaaaaaa

SEQ ID NO: 649399 - DNA, 25 bp, Homo sapien
gatttgactcttacatcaatcctat

SEQ ID NO: 649400 - DNA, 25 bp, Homo sapien
tgaccaaagtcattccactaggctt

SEQ ID NO: 649401 - DNA, 25 bp, Homo sapien
gtcattccactaggcttaaacttaa

SEQ ID NO: 649402 - DNA, 25 bp, Homo sapien
aagcttttggctctaatcctacact

SEQ ID NO: 649403 - DNA, 25 bp, Homo sapien
ttggctctaatcctacacttttctt

SEQ ID NO: 649404 - DNA, 25 bp, Homo sapien
tacacttttcttctactcagcaatc

SEQ ID NO: 649405 - DNA, 25 bp, Homo sapien
tctactcagcaatctttaagacaac

SEQ ID NO: 649406 - DNA, 25 bp, Homo sapien
ttaagacaactcaatagatccaata

SEQ ID NO: 649407 - DNA, 25 bp, Homo sapien
aacaggcacaaattgtatacacatg

SEQ ID NO: 649408 - DNA, 25 bp, Homo sapien
tatacacatgaagactacttaccgt

SEQ ID NO: 649409 - DNA, 25 bp, Homo sapien
gaagactacttaccgtaatattgta

SEQ ID NO: 649410 - DNA, 25 bp, Homo sapien
gtcctccgggtatgaagctaaaatg

SEQ ID NO: 649411 - DNA, 25 bp, Homo sapien
tgaagctaaaatgcagcggctaaga

SEQ ID NO: 649412 - DNA, 25 bp, Homo sapien
atgcagcggctaagaacgcggctct

SEQ ID NO: 649413 - DNA, 25 bp, Homo sapien
ctaagaacgcggctctggagcttga

SEQ ID NO: 649414 - DNA, 25 bp, Homo sapien
tggagcttgacaggcctgacgtcga

SEQ ID NO: 649415 - DNA, 25 bp, Homo sapien
tgacaggcctgacgtcgaatcccag

SEQ ID NO: 649416 - DNA, 25 bp, Homo sapien
gtgatcctgggcaaggttctaagct

SEQ ID NO: 649417 - DNA, 25 bp, Homo sapien
ctgggcaaggttctaagcttctctg

SEQ ID NO: 649418 - DNA, 25 bp, Homo sapien
cttctctgagttactcatatgtgaa

SEQ ID NO: 649419 - DNA, 25 bp, Homo sapien
aatggagcatgtaccttttccctac

SEQ ID NO: 649420 - DNA, 25 bp, Homo sapien
acctcttagggctggtgtgaagatt

SEQ ID NO: 649421 - DNA, 25 bp, Homo sapien
tttgctttgctatatacatggacaa

SEQ ID NO: 649422 - DNA, 25 bp, Homo sapien
ggacaataatcctgtaccttgcctg

SEQ ID NO: 649423 - DNA, 25 bp, Homo sapien
gtaccttgcctgtgatcttccagaa

SEQ ID NO: 649424 - DNA, 25 bp, Homo sapien
cagttatattgatgggttgtcctca

SEQ ID NO: 649425 - DNA, 25 bp, Homo sapien
gatgggttgtcctcagatggttgaa

SEQ ID NO: 649426 - DNA, 25 bp, Homo sapien
gaggctgcagggatgattgaaatct

SEQ ID NO: 649427 - DNA, 25 bp, Homo sapien
atctgtaggcggaagagacaactgc

SEQ ID NO: 649428 - DNA, 25 bp, Homo sapien
gagacaactgcaattcctggaggtg

SEQ ID NO: 649429 - DNA, 25 bp, Homo sapien
gtgttagaactctgcagtgttttgg

SEQ ID NO: 649430 - DNA, 25 bp, Homo sapien
gaggtctggtgctgccatttatatt

SEQ ID NO: 649431 - DNA, 25 bp, Homo sapien
gtgctgccatttatatttctcttcc

SEQ ID NO: 649432 - DNA, 25 bp, Homo sapien
ctcacactgtaaactttctataata

SEQ ID NO: 649433 - DNA, 25 bp, Homo sapien
atatatctcaatttttggtaccaat

SEQ ID NO: 649434 - DNA, 25 bp, Homo sapien
gattctgatgcacatcaaatgttaa

SEQ ID NO: 649435 - DNA, 25 bp, Homo sapien
tcaaatgttaagacgtgttctgtaa

SEQ ID NO: 649436 - DNA, 25 bp, Homo sapien
gttctgtaacatagttttcctcttt

SEQ ID NO: 649437 - DNA, 25 bp, Homo sapien
ttttgctggaaggagtttactttga

SEQ ID NO: 649438 - DNA, 25 bp, Homo sapien
gagtttactttgagaatgcatttga

SEQ ID NO: 649439 - DNA, 25 bp, Homo sapien
ataccataaatgcagttagcgaaat

SEQ ID NO: 649440 - DNA, 25 bp, Homo sapien
tgcagttagcgaaattatcatggga

SEQ ID NO: 649441 - DNA, 25 bp, Homo sapien
tatcatgggaatatgatcactacat

SEQ ID NO: 649442 - DNA, 25 bp, Homo sapien
atcactacatgatcatacatctaat

SEQ ID NO: 649443 - DNA, 25 bp, Homo sapien
cttggcatgtgagtaaagccatctt

SEQ ID NO: 649444 - DNA, 25 bp, Homo sapien
gatgaataatactaactgatcccag

SEQ ID NO: 649445 - DNA, 25 bp, Homo sapien
aactgatcccagtcaatgccacata

SEQ ID NO: 649446 - DNA, 25 bp, Homo sapien
gatcccagtcaatgccacatagagc

SEQ ID NO: 649447 - DNA, 25 bp, Homo sapien
atgccacatagagcagaagaactgc

SEQ ID NO: 649448 - DNA, 25 bp, Homo sapien
gaactgcctaactgaattctttcca

SEQ ID NO: 649449 - DNA, 25 bp, Homo sapien
aactgaattctttccaaactgctga

SEQ ID NO: 649450 - DNA, 25 bp, Homo sapien
aattctttccaaactgctgactcaa

SEQ ID NO: 649451 - DNA, 25 bp, Homo sapien
ctttccaaactgctgactcaaaaat

SEQ ID NO: 649452 - DNA, 25 bp, Homo sapien
aactgctgactcaaaaatttgtatg

SEQ ID NO: 649453 - DNA, 25 bp, Homo sapien
taggagtaataagcaaccagaataa

SEQ ID NO: 649454 - DNA, 25 bp, Homo sapien
gggttcaagtgatcattccaccttg

SEQ ID NO: 649455 - DNA, 25 bp, Homo sapien
catgaaccaccgtggccaggtgcct

SEQ ID NO: 649456 - DNA, 25 bp, Homo sapien
atgaaccaccgtggccaggtgcctt

SEQ ID NO: 649457 - DNA, 25 bp, Homo sapien
tgaaccaccgtggccaggtgccttt

SEQ ID NO: 649458 - DNA, 25 bp, Homo sapien
gaaccaccgtggccaggtgcctttt

SEQ ID NO: 649459 - DNA, 25 bp, Homo sapien
gctgaggtagtagagtcgcctgaac

SEQ ID NO: 649460 - DNA, 25 bp, Homo sapien
ctgaggtagtagagtcgcctgaacc

SEQ ID NO: 649461 - DNA, 25 bp, Homo sapien
tgaggtagtagagtcgcctgaacct

SEQ ID NO: 649462 - DNA, 25 bp, Homo sapien
gaggtagtagagtcgcctgaacctg

SEQ ID NO: 649463 - DNA, 25 bp, Homo sapien
aggtagtagagtcgcctgaacctgg

SEQ ID NO: 649464 - DNA, 25 bp, Homo sapien
ggtagtagagtcgcctgaacctggg

SEQ ID NO: 649465 - DNA, 25 bp, Homo sapien
agcactttggtaggcgacgtcgggc

SEQ ID NO: 649466 - DNA, 25 bp, Homo sapien
ctttggtaggcgacgtcgggcagat

SEQ ID NO: 649467 - DNA, 25 bp, Homo sapien
tttggtaggcgacgtcgggcagatc

SEQ ID NO: 649468 - DNA, 25 bp, Homo sapien
ttggtaggcgacgtcgggcagatca

SEQ ID NO: 649469 - DNA, 25 bp, Homo sapien
tggtaggcgacgtcgggcagatcat

SEQ ID NO: 649470 - DNA, 25 bp, Homo sapien
ggtaggcgacgtcgggcagatcatg

SEQ ID NO: 649471 - DNA, 25 bp, Homo sapien
gtaggcgacgtcgggcagatcatga

SEQ ID NO: 649472 - DNA, 25 bp, Homo sapien
taggcgacgtcgggcagatcatgag

SEQ ID NO: 649473 - DNA, 25 bp, Homo sapien
catggtggtgcacccgtattcctag

SEQ ID NO: 649474 - DNA, 25 bp, Homo sapien
atggtggtgcacccgtattcctagc

SEQ ID NO: 649475 - DNA, 25 bp, Homo sapien
tggtgcacccgtattcctagctact

SEQ ID NO: 649476 - DNA, 25 bp, Homo sapien
ctcaagttaacaatatactttggtt

SEQ ID NO: 649477 - DNA, 25 bp, Homo sapien
tatatccctattaggaaatatacac

SEQ ID NO: 649478 - DNA, 25 bp, Homo sapien
ggtggtgatgtatacaacttagtct

SEQ ID NO: 649479 - DNA, 25 bp, Homo sapien
tacaacttagtcttaaatggttcgg

SEQ ID NO: 649480 - DNA, 25 bp, Homo sapien
aagtgttaacagtaggtaatctgga

SEQ ID NO: 649481 - DNA, 25 bp, Homo sapien
aggatatatgagtggccctttgtat

SEQ ID NO: 649482 - DNA, 25 bp, Homo sapien
atgagtggccctttgtattattatc

SEQ ID NO: 649483 - DNA, 25 bp, Homo sapien
gagtggccctttgtattattatcct

SEQ ID NO: 649484 - DNA, 25 bp, Homo sapien
ggccctttgtattattatccttgca

SEQ ID NO: 649485 - DNA, 25 bp, Homo sapien
ctttgtattattatccttgcaattt

SEQ ID NO: 649486 - DNA, 25 bp, Homo sapien
tattatccttgcaattttttataag

SEQ ID NO: 649487 - DNA, 25 bp, Homo sapien
ctgatggtgggtgtggtcttcataa

SEQ ID NO: 649488 - DNA, 25 bp, Homo sapien
aggagtacacagtccatctgatcca

SEQ ID NO: 649489 - DNA, 25 bp, Homo sapien
tgatccacctctcttatggttccat

SEQ ID NO: 649490 - DNA, 25 bp, Homo sapien
ggttccattggcaaaatcattcatc

SEQ ID NO: 649491 - DNA, 25 bp, Homo sapien
aaatcattcatcagtcgtcctatct

SEQ ID NO: 649492 - DNA, 25 bp, Homo sapien
agtcgtcctatcttttcctggcgag

SEQ ID NO: 649493 - DNA, 25 bp, Homo sapien
gcgagcgctcacaatggcttcataa

SEQ ID NO: 649494 - DNA, 25 bp, Homo sapien
ataagtgtttcaatacagtgtccca

SEQ ID NO: 649495 - DNA, 25 bp, Homo sapien
tcccaggcagtcactacctatagat

SEQ ID NO: 649496 - DNA, 25 bp, Homo sapien
agattagagctgatgtgctggcctg

SEQ ID NO: 649497 - DNA, 25 bp, Homo sapien
ccatcaggatggaacaaggtagctc

SEQ ID NO: 649498 - DNA, 25 bp, Homo sapien
agagaaagatctttgctatcatggg

SEQ ID NO: 649499 - DNA, 25 bp, Homo sapien
tttgcaatcatctagtatctaaaga

SEQ ID NO: 649500 - DNA, 25 bp, Homo sapien
gaagtttcctctttttaattcagtg

SEQ ID NO: 649501 - DNA, 25 bp, Homo sapien
cagtgttatttttcacatagtattt

SEQ ID NO: 649502 - DNA, 25 bp, Homo sapien
tatgcacataatgttccacgcacct

SEQ ID NO: 649503 - DNA, 25 bp, Homo sapien
tgttccacgcacctagttgttcaaa

SEQ ID NO: 649504 - DNA, 25 bp, Homo sapien
gttgttcaaacaagacagctcagag

SEQ ID NO: 649505 - DNA, 25 bp, Homo sapien
aagacagctcagagtcaacttttac

SEQ ID NO: 649506 - DNA, 25 bp, Homo sapien
ttttcccttaaccttgcatttcaat

SEQ ID NO: 649507 - DNA, 25 bp, Homo sapien
aaatcctgtcaataatctctggttt

SEQ ID NO: 649508 - DNA, 25 bp, Homo sapien
aaatgatgatttattgctgccttcc

SEQ ID NO: 649509 - DNA, 25 bp, Homo sapien
aaccatcatcactacctaattccaa

SEQ ID NO: 649510 - DNA, 25 bp, Homo sapien
ccatcatcactacctaattccaaaa

SEQ ID NO: 649511 - DNA, 25 bp, Homo sapien
catcatcactacctaattccaaaac

SEQ ID NO: 649512 - DNA, 25 bp, Homo sapien
tcatcactacctaattccaaaacat

SEQ ID NO: 649513 - DNA, 25 bp, Homo sapien
tcactacctaattccaaaacatttt

SEQ ID NO: 649514 - DNA, 25 bp, Homo sapien
catttttatcactcactctcaaaag

SEQ ID NO: 649515 - DNA, 25 bp, Homo sapien
ttttatcactcactctcaaaagaaa

SEQ ID NO: 649516 - DNA, 25 bp, Homo sapien
ctctcaaaagaaacgttgtacccat

SEQ ID NO: 649517 - DNA, 25 bp, Homo sapien
aagaaacgttgtacccattagcagt

SEQ ID NO: 649518 - DNA, 25 bp, Homo sapien
agaaacgttgtacccattagcagtt

SEQ ID NO: 649519 - DNA, 25 bp, Homo sapien
ctcagtccctagcaaccactaatct

SEQ ID NO: 649520 - DNA, 25 bp, Homo sapien
gtcctggtcacatagtgagtagttc

SEQ ID NO: 649521 - DNA, 25 bp, Homo sapien
ggtcacatagtgagtagttctcctt

SEQ ID NO: 649522 - DNA, 25 bp, Homo sapien
tgagtagttctccttgtactctcac

SEQ ID NO: 649523 - DNA, 25 bp, Homo sapien
cttgtactctcacccatgtgtctgt

SEQ ID NO: 649524 - DNA, 25 bp, Homo sapien
tgtccatctttccatctatgcatac

SEQ ID NO: 649525 - DNA, 25 bp, Homo sapien
catctttccatctatgcatacatcc

SEQ ID NO: 649526 - DNA, 25 bp, Homo sapien
atgcatacatccatacatctgtcca

SEQ ID NO: 649527 - DNA, 25 bp, Homo sapien
atacatccatacatctgtccatcat

SEQ ID NO: 649528 - DNA, 25 bp, Homo sapien
atcatccacccttgtatccatctat

SEQ ID NO: 649529 - DNA, 25 bp, Homo sapien
gagcacttaatatgcaaactacctt

SEQ ID NO: 649530 - DNA, 25 bp, Homo sapien
taatatgcaaactaccttccataaa

SEQ ID NO: 649531 - DNA, 25 bp, Homo sapien
atcacactgggcaatcacgtggcaa

SEQ ID NO: 649532 - DNA, 25 bp, Homo sapien
actgggcaatcacgtggcaatctct

SEQ ID NO: 649533 - DNA, 25 bp, Homo sapien
aatcacgtggcaatctctgctttga

SEQ ID NO: 649534 - DNA, 25 bp, Homo sapien
acgtggcaatctctgctttgatgca

SEQ ID NO: 649535 - DNA, 25 bp, Homo sapien
tggcaatctctgctttgatgcagta

SEQ ID NO: 649536 - DNA, 25 bp, Homo sapien
gatggcagataagctaaggctccaa

SEQ ID NO: 649537 - DNA, 25 bp, Homo sapien
taagctaaggctccaagtccaagct

SEQ ID NO: 649538 - DNA, 25 bp, Homo sapien
aagctgtggcactgatcactctgtg

SEQ ID NO: 649539 - DNA, 25 bp, Homo sapien
tgtggcactgatcactctgtgaccc

SEQ ID NO: 649540 - DNA, 25 bp, Homo sapien
ctgtgaccctgggaagaggttctcc

SEQ ID NO: 649541 - DNA, 25 bp, Homo sapien
ggaagaggttctccctttgaattct

SEQ ID NO: 649542 - DNA, 25 bp, Homo sapien
tgctttgttgcacaggctggtccca

SEQ ID NO: 649543 - DNA, 25 bp, Homo sapien
gctttgttgcacaggctggtcccaa

SEQ ID NO: 649544 - DNA, 25 bp, Homo sapien
ctttgttgcacaggctggtcccaaa

SEQ ID NO: 649545 - DNA, 25 bp, Homo sapien
catggcaaaactttatctctacaaa

SEQ ID NO: 649546 - DNA, 25 bp, Homo sapien
gagactgcagtgagatgtgatcgcg

SEQ ID NO: 649547 - DNA, 25 bp, Homo sapien
agactgcagtgagatgtgatcgcgc

SEQ ID NO: 649548 - DNA, 25 bp, Homo sapien
gactgcagtgagatgtgatcgcgcc

SEQ ID NO: 649549 - DNA, 25 bp, Homo sapien
agtgagatgtgatcgcgccactgta

SEQ ID NO: 649550 - DNA, 25 bp, Homo sapien
gatgtgatcgcgccactgtacttca

SEQ ID NO: 649551 - DNA, 25 bp, Homo sapien
gtacttcagcctgggtgccagagta

SEQ ID NO: 649552 - DNA, 25 bp, Homo sapien
tacttcagcctgggtgccagagtaa

SEQ ID NO: 649553 - DNA, 25 bp, Homo sapien
tgcaagcaacttcttcttttccttt

SEQ ID NO: 649554 - DNA, 25 bp, Homo sapien
atggagacaggacacaagctgcata

SEQ ID NO: 649555 - DNA, 25 bp, Homo sapien
acaggacacaagctgcataagggat

SEQ ID NO: 649556 - DNA, 25 bp, Homo sapien
cctttgttcgggtgtgctgtcacca

SEQ ID NO: 649557 - DNA, 25 bp, Homo sapien
gttcgggtgtgctgtcaccattgtt

SEQ ID NO: 649558 - DNA, 25 bp, Homo sapien
gtgtgctgtcaccattgtttcatct

SEQ ID NO: 649559 - DNA, 25 bp, Homo sapien
gtgctgtcaccattgtttcatctgt

SEQ ID NO: 649560 - DNA, 25 bp, Homo sapien
tgctgtcaccattgtttcatctgtg

SEQ ID NO: 649561 - DNA, 25 bp, Homo sapien
gtcaccattgtttcatctgtgagga

SEQ ID NO: 649562 - DNA, 25 bp, Homo sapien
accattgtttcatctgtgaggagca

SEQ ID NO: 649563 - DNA, 25 bp, Homo sapien
cattgtttcatctgtgaggagcacc

SEQ ID NO: 649564 - DNA, 25 bp, Homo sapien
ggtgaagggtatgaaggttctctct

SEQ ID NO: 649565 - DNA, 25 bp, Homo sapien
gggtatgaaggttctctctgtgtca

SEQ ID NO: 649566 - DNA, 25 bp, Homo sapien
atgaaggttctctctgtgtcatttc

SEQ ID NO: 649567 - DNA, 25 bp, Homo sapien
ggttctctctgtgtcatttcttaaa

SEQ ID NO: 649568 - DNA, 25 bp, Homo sapien
tctctgtgtcatttcttaaaactcc

SEQ ID NO: 649569 - DNA, 25 bp, Homo sapien
gtcatttcttaaaactccatgtgag

SEQ ID NO: 649570 - DNA, 25 bp, Homo sapien
tccatgtgagtctatagtgagtttt

SEQ ID NO: 649571 - DNA, 25 bp, Homo sapien
gtgagtctatagtgagttttaaaaa

SEQ ID NO: 649572 - DNA, 25 bp, Homo sapien
tagcgagacctattgtctctacaca

SEQ ID NO: 649573 - DNA, 25 bp, Homo sapien
gacctattgtctctacacataataa

SEQ ID NO: 649574 - DNA, 25 bp, Homo sapien
tgccagagcgagacgccttctcaac

SEQ ID NO: 649575 - DNA, 25 bp, Homo sapien
gccaaggtggatacatcccttgagc

SEQ ID NO: 649576 - DNA, 25 bp, Homo sapien
aaggtggatacatcccttgagccca

SEQ ID NO: 649577 - DNA, 25 bp, Homo sapien
aattaaccagctgtggtggcatacg

SEQ ID NO: 649578 - DNA, 25 bp, Homo sapien
attaaccagctgtggtggcatacgc

SEQ ID NO: 649579 - DNA, 25 bp, Homo sapien
ttaaccagctgtggtggcatacgcc

SEQ ID NO: 649580 - DNA, 25 bp, Homo sapien
accagctgtggtggcatacgcctgt

SEQ ID NO: 649581 - DNA, 25 bp, Homo sapien
aggcaggaggatcttgggaggctga

SEQ ID NO: 649582 - DNA, 25 bp, Homo sapien
ggcaggaggatcttgggaggctgag

SEQ ID NO: 649583 - DNA, 25 bp, Homo sapien
gcaggaggatcgtaggaggctgaga

SEQ ID NO: 649584 - DNA, 25 bp, Homo sapien
caggaggatcgtaggaggctgagac

SEQ ID NO: 649585 - DNA, 25 bp, Homo sapien
aggaggatcgtaggaggctgagaca

SEQ ID NO: 649586 - DNA, 25 bp, Homo sapien
aggttgcgttgagccgacttcgcgc

SEQ ID NO: 649587 - DNA, 25 bp, Homo sapien
gcgttgagccgacttcgcgccattg

SEQ ID NO: 649588 - DNA, 25 bp, Homo sapien
aaacccaaacagaatcggcggctca

SEQ ID NO: 649589 - DNA, 25 bp, Homo sapien
cccaaacagaatcggcggctcactt

SEQ ID NO: 649590 - DNA, 25 bp, Homo sapien
agatcaagcccctgggtggaactgc

SEQ ID NO: 649591 - DNA, 25 bp, Homo sapien
caagcccctgggtggaactgcagtt

SEQ ID NO: 649592 - DNA, 25 bp, Homo sapien
agcccctgggtggaactgcagtttc

SEQ ID NO: 649593 - DNA, 25 bp, Homo sapien
ccctgggtggaactgcagtttccag

SEQ ID NO: 649594 - DNA, 25 bp, Homo sapien
ggtggaactgcagtttccaggatac

SEQ ID NO: 649595 - DNA, 25 bp, Homo sapien
gaactgcagtttccaggatacaaca

SEQ ID NO: 649596 - DNA, 25 bp, Homo sapien
agtttccaggatacaacatcccggg

SEQ ID NO: 649597 - DNA, 25 bp, Homo sapien
tcaacaactggattagtgcgagctg

SEQ ID NO: 649598 - DNA, 25 bp, Homo sapien
gtgcgagctgaagtgtcatcatata

SEQ ID NO: 649599 - DNA, 25 bp, Homo sapien
atacttcagatcattctttggctaa

SEQ ID NO: 649600 - DNA, 25 bp, Homo sapien
ctttggctaagaattgtgtcgttgt

SEQ ID NO: 649601 - DNA, 25 bp, Homo sapien
taatctgcaaacaggtgcccagagg

SEQ ID NO: 649602 - DNA, 25 bp, Homo sapien
agaggaagcttggaggctgctacct

SEQ ID NO: 649603 - DNA, 25 bp, Homo sapien
ctagagggagccactgttgcctttt

SEQ ID NO: 649604 - DNA, 25 bp, Homo sapien
actgttgccttttattatcctggcc

SEQ ID NO: 649605 - DNA, 25 bp, Homo sapien
tggccaaagcacagatcatccacca

SEQ ID NO: 649606 - DNA, 25 bp, Homo sapien
cagatcatccaccatttcctatttt

SEQ ID NO: 649607 - DNA, 25 bp, Homo sapien
cattcagcacactaagacaggttac

SEQ ID NO: 649608 - DNA, 25 bp, Homo sapien
atcccttctgcaaactcacaggaca

SEQ ID NO: 649609 - DNA, 25 bp, Homo sapien
cccttctgcaaactcacaggacagg

SEQ ID NO: 649610 - DNA, 25 bp, Homo sapien
cttctgcaaactcacaggacaggat

SEQ ID NO: 649611 - DNA, 25 bp, Homo sapien
tctgcaaactcacaggacaggattg

SEQ ID NO: 649612 - DNA, 25 bp, Homo sapien
tgcaaactcacaggacaggattgat

SEQ ID NO: 649613 - DNA, 25 bp, Homo sapien
aaactcacaggacaggattgatggg

SEQ ID NO: 649614 - DNA, 25 bp, Homo sapien
gagagcccaggcgaaacgaagctga

SEQ ID NO: 649615 - DNA, 25 bp, Homo sapien
gagcccaggcgaaacgaagctgacc

SEQ ID NO: 649616 - DNA, 25 bp, Homo sapien
ggctctggaacaggcccgggaccgg

SEQ ID NO: 649617 - DNA, 25 bp, Homo sapien
cccgggaccggtggcctggagacag

SEQ ID NO: 649618 - DNA, 25 bp, Homo sapien
gggaccggtggcctggagacagtgg

SEQ ID NO: 649619 - DNA, 25 bp, Homo sapien
aggttggtcccagtcatttttgcat

SEQ ID NO: 649620 - DNA, 25 bp, Homo sapien
tcatttttgcatccccaatgcctag

SEQ ID NO: 649621 - DNA, 25 bp, Homo sapien
atgcctagcacatgattggctgacc

SEQ ID NO: 649622 - DNA, 25 bp, Homo sapien
agttactctggacagttctgttccc

SEQ ID NO: 649623 - DNA, 25 bp, Homo sapien
tctcctctccacatattcagttagt

SEQ ID NO: 649624 - DNA, 25 bp, Homo sapien
gttctgctaacaacggtctcctaaa

SEQ ID NO: 649625 - DNA, 25 bp, Homo sapien
gataccccaaagactggcgctttga

SEQ ID NO: 649626 - DNA, 25 bp, Homo sapien
ctttgacatgctgagaggccttcga

SEQ ID NO: 649627 - DNA, 25 bp, Homo sapien
tcagaatcaaggtccctctaacctt

SEQ ID NO: 649628 - DNA, 25 bp, Homo sapien
tctaaccttctctcccaagtatagg

SEQ ID NO: 649629 - DNA, 25 bp, Homo sapien
gtatagggaggcactctctctagaa

SEQ ID NO: 649630 - DNA, 25 bp, Homo sapien
gaaagagctgttcagtaatcccaaa

SEQ ID NO: 649631 - DNA, 25 bp, Homo sapien
agagctgttcagtaatcccaaatgc

SEQ ID NO: 649632 - DNA, 25 bp, Homo sapien
gctgttcagtaatcccaaatgctga

SEQ ID NO: 649633 - DNA, 25 bp, Homo sapien
taatcccaaatgctgaagtgatcat

SEQ ID NO: 649634 - DNA, 25 bp, Homo sapien
taaaaaagagctttgcagtagaaac

SEQ ID NO: 649635 - DNA, 25 bp, Homo sapien
ttgagagtaaaattccagtagcgag

SEQ ID NO: 649636 - DNA, 25 bp, Homo sapien
ccagtagcgagaggatgaaattaac

SEQ ID NO: 649637 - DNA, 25 bp, Homo sapien
taacattgtaggagattgggaagac

SEQ ID NO: 649638 - DNA, 25 bp, Homo sapien
ttctgatgtacaaagagcccttaca

SEQ ID NO: 649639 - DNA, 25 bp, Homo sapien
gtacaaagagcccttacaagccaga

SEQ ID NO: 649640 - DNA, 25 bp, Homo sapien
aaagagcccttacaagccagaaaga

SEQ ID NO: 649641 - DNA, 25 bp, Homo sapien
gccaatttctacaaaagtcctgctg

SEQ ID NO: 649642 - DNA, 25 bp, Homo sapien
agtcctgctgagattttaattggta

SEQ ID NO: 649643 - DNA, 25 bp, Homo sapien
ttaattggtattttgcttgttctgc

SEQ ID NO: 649644 - DNA, 25 bp, Homo sapien
ttgttctgcagcttaatgcaagaaa

SEQ ID NO: 649645 - DNA, 25 bp, Homo sapien
ttatttctactattggcttagtaac

SEQ ID NO: 649646 - DNA, 25 bp, Homo sapien
ggcttagtaactatgccccactttt

SEQ ID NO: 649647 - DNA, 25 bp, Homo sapien
aactatgccccactttttgattttg

SEQ ID NO: 649648 - DNA, 25 bp, Homo sapien
gccccactttttgattttgtagcac

SEQ ID NO: 649649 - DNA, 25 bp, Homo sapien
tttgtagcacagttgaccattgaac

SEQ ID NO: 649650 - DNA, 25 bp, Homo sapien
acaagtttgaattgtgcatgtccaa

SEQ ID NO: 649651 - DNA, 25 bp, Homo sapien
attgtgcatgtccaattgtctatgg

SEQ ID NO: 649652 - DNA, 25 bp, Homo sapien
gatagacaacggagtgcttcagagc

SEQ ID NO: 649653 - DNA, 25 bp, Homo sapien
gagtgcttcagagcaggctgctgac

SEQ ID NO: 649654 - DNA, 25 bp, Homo sapien
gctgacgcagtgaggccaaaatata

SEQ ID NO: 649655 - DNA, 25 bp, Homo sapien
aaaacagctggatgctggtgttgaa

SEQ ID NO: 649656 - DNA, 25 bp, Homo sapien
tgaagggacgtctggagacaatgaa

SEQ ID NO: 649657 - DNA, 25 bp, Homo sapien
cagcagagtgagtgtttcagaagac

SEQ ID NO: 649658 - DNA, 25 bp, Homo sapien
gaagacagttaaaggccttggtgac

SEQ ID NO: 649659 - DNA, 25 bp, Homo sapien
ggccttggtgacgaacaactgcgga

SEQ ID NO: 649660 - DNA, 25 bp, Homo sapien
caactgcggagaaggaaggtgtttt

SEQ ID NO: 649661 - DNA, 25 bp, Homo sapien
gggagtgaattctgacaatttctga

SEQ ID NO: 649662 - DNA, 25 bp, Homo sapien
gaattcacagcaagacatcaatggc

SEQ ID NO: 649663 - DNA, 25 bp, Homo sapien
caggcgcacgacaccatgcctggct

SEQ ID NO: 649664 - DNA, 25 bp, Homo sapien
aggcgcacgacaccatgcctggcta

SEQ ID NO: 649665 - DNA, 25 bp, Homo sapien
gctaattttttaattgtagtagaga

SEQ ID NO: 649666 - DNA, 25 bp, Homo sapien
attacaggcatgggcgacacaggga

SEQ ID NO: 649667 - DNA, 25 bp, Homo sapien
ttacaggcatgggcgacacagggag

SEQ ID NO: 649668 - DNA, 25 bp, Homo sapien
acaggcatgggcgacacagggagac

SEQ ID NO: 649669 - DNA, 25 bp, Homo sapien
caggcatgggcgacacagggagact

SEQ ID NO: 649670 - DNA, 25 bp, Homo sapien
aggcatgggcgacacagggagactc

SEQ ID NO: 649671 - DNA, 25 bp, Homo sapien
tgttgctcctgagtcctatgaatca

SEQ ID NO: 649672 - DNA, 25 bp, Homo sapien
gctcctgagtcctatgaatcagaaa

SEQ ID NO: 649673 - DNA, 25 bp, Homo sapien
gaatcagaaaaatcatcctctttaa

SEQ ID NO: 649674 - DNA, 25 bp, Homo sapien
tatggcatgcatttagaaaaccaga

SEQ ID NO: 649675 - DNA, 25 bp, Homo sapien
accagaaactttcatcatcagtact

SEQ ID NO: 649676 - DNA, 25 bp, Homo sapien
tcatcagtactggttaatcaaggga

SEQ ID NO: 649677 - DNA, 25 bp, Homo sapien
gtactggttaatcaagggatcaaac

SEQ ID NO: 649678 - DNA, 25 bp, Homo sapien
gatcaaaccttttttacaatatcct

SEQ ID NO: 649679 - DNA, 25 bp, Homo sapien
tttttacaatatccttcgaatgaag

SEQ ID NO: 649680 - DNA, 25 bp, Homo sapien
gaaatgtctaatccagagatcatca

SEQ ID NO: 649681 - DNA, 25 bp, Homo sapien
cagagatcatcaaaccacatttttt

SEQ ID NO: 649682 - DNA, 25 bp, Homo sapien
gtcctctgacccttttagcaggaaa

SEQ ID NO: 649683 - DNA, 25 bp, Homo sapien
ttttagcaggaaatccagcccagcc

SEQ ID NO: 649684 - DNA, 25 bp, Homo sapien
gcccagcccctgaacggcatgttag

SEQ ID NO: 649685 - DNA, 25 bp, Homo sapien
gacagttcaacaaagccttctagaa

SEQ ID NO: 649686 - DNA, 25 bp, Homo sapien
gactcataggaataagcctcttgct

SEQ ID NO: 649687 - DNA, 25 bp, Homo sapien
ataagcctcttgctgattaatggaa

SEQ ID NO: 649688 - DNA, 25 bp, Homo sapien
caatctgcattgaacacctttaggg

SEQ ID NO: 649689 - DNA, 25 bp, Homo sapien
gggaacctgtcatttaagacttcaa

SEQ ID NO: 649690 - DNA, 25 bp, Homo sapien
taagacttcaagcattaccatgaaa

SEQ ID NO: 649691 - DNA, 25 bp, Homo sapien
tgaaaacttcctctgaaacacctta

SEQ ID NO: 649692 - DNA, 25 bp, Homo sapien
ctgaaacaccttacagacatctctg

SEQ ID NO: 649693 - DNA, 25 bp, Homo sapien
agtgtgcttacatatccagacccag

SEQ ID NO: 649694 - DNA, 25 bp, Homo sapien
cagacccagcagacagtcaatgaca

SEQ ID NO: 649695 - DNA, 25 bp, Homo sapien
gacagtcaatgacagcttgtgtgat

SEQ ID NO: 649696 - DNA, 25 bp, Homo sapien
ttgtgtgatatggtccaccgtcctc

SEQ ID NO: 649697 - DNA, 25 bp, Homo sapien
aggcctgtaacacagagccctgtcc

SEQ ID NO: 649698 - DNA, 25 bp, Homo sapien
ctgctcagctacctgtggagttgga

SEQ ID NO: 649699 - DNA, 25 bp, Homo sapien
gagttggaattcagacccgagatgt

SEQ ID NO: 649700 - DNA, 25 bp, Homo sapien
gacccgagatgtgtactgcctgcac

SEQ ID NO: 649701 - DNA, 25 bp, Homo sapien
ccctcctgaggagtgccgagatgaa

SEQ ID NO: 649702 - DNA, 25 bp, Homo sapien
gtgccgagatgaaaagccccatgct

SEQ ID NO: 649703 - DNA, 25 bp, Homo sapien
aagccccatgctttacaagcatgca

SEQ ID NO: 649704 - DNA, 25 bp, Homo sapien
aatactaatagtccctgatatgcag

SEQ ID NO: 649705 - DNA, 25 bp, Homo sapien
ctaatagtccctgatatgcagaaat

SEQ ID NO: 649706 - DNA, 25 bp, Homo sapien
tggcataagctgtctttctctctgt

SEQ ID NO: 649707 - DNA, 25 bp, Homo sapien
acctatcattggaggtgactcacat

SEQ ID NO: 649708 - DNA, 25 bp, Homo sapien
tggaggtgactcacattctttaccc

SEQ ID NO: 649709 - DNA, 25 bp, Homo sapien
gtatccaataacagcgcagtcagac

SEQ ID NO: 649710 - DNA, 25 bp, Homo sapien
tatccaataacagcgcagtcagaca

SEQ ID NO: 649711 - DNA, 25 bp, Homo sapien
caataacagcgcagtcagacattca

SEQ ID NO: 649712 - DNA, 25 bp, Homo sapien
agcgcagtcagacattcagggccac

SEQ ID NO: 649713 - DNA, 25 bp, Homo sapien
gcagtcagacattcagggccactac

SEQ ID NO: 649714 - DNA, 25 bp, Homo sapien
ccggtctccgcacattggtggtagt

SEQ ID NO: 649715 - DNA, 25 bp, Homo sapien
agcaatcttcctgctaaggccattg

SEQ ID NO: 649716 - DNA, 25 bp, Homo sapien
gcaatcttcctgctaaggccattgg

SEQ ID NO: 649717 - DNA, 25 bp, Homo sapien
caatcttcctgctaaggccattgga

SEQ ID NO: 649718 - DNA, 25 bp, Homo sapien
aatcttcctgctaaggccattggac

SEQ ID NO: 649719 - DNA, 25 bp, Homo sapien
atcttcctgctaaggccattggaca

SEQ ID NO: 649720 - DNA, 25 bp, Homo sapien
tcttcctgctaaggccattggacac

SEQ ID NO: 649721 - DNA, 25 bp, Homo sapien
tcctgctaaggccattggacacaga

SEQ ID NO: 649722 - DNA, 25 bp, Homo sapien
ctgctaaggccattggacacagaat

SEQ ID NO: 649723 - DNA, 25 bp, Homo sapien
taaggccattggacacagaatccga

SEQ ID NO: 649724 - DNA, 25 bp, Homo sapien
aggccattggacacagaatccgagt

SEQ ID NO: 649725 - DNA, 25 bp, Homo sapien
ggccattggacacagaatccgagtg

SEQ ID NO: 649726 - DNA, 25 bp, Homo sapien
tctgcatcaggagacaccctgggtg

SEQ ID NO: 649727 - DNA, 25 bp, Homo sapien
gaggcttcgctgaaaagcattgcaa

SEQ ID NO: 649728 - DNA, 25 bp, Homo sapien
gcaacagcattatcacatacgtgga

SEQ ID NO: 649729 - DNA, 25 bp, Homo sapien
ataagaattgcatctcaacccttcc

SEQ ID NO: 649730 - DNA, 25 bp, Homo sapien
cctcctgtggccatagtaacctgaa

SEQ ID NO: 649731 - DNA, 25 bp, Homo sapien
gtggccatagtaacctgaacagtaa

SEQ ID NO: 649732 - DNA, 25 bp, Homo sapien
tgaacagtaactacagcagcaggct

SEQ ID NO: 649733 - DNA, 25 bp, Homo sapien
acagcagcaggctgcttaggtgcca

SEQ ID NO: 649734 - DNA, 25 bp, Homo sapien
agctctaacctttcaacctataact

SEQ ID NO: 649735 - DNA, 25 bp, Homo sapien
acctataactactccctactgtaat

SEQ ID NO: 649736 - DNA, 25 bp, Homo sapien
actactccctactgtaatttttgtg

SEQ ID NO: 649737 - DNA, 25 bp, Homo sapien
tgggaggatcagtggagcctcagag

SEQ ID NO: 649738 - DNA, 25 bp, Homo sapien
gggaggatcagtggagcctcagagg

SEQ ID NO: 649739 - DNA, 25 bp, Homo sapien
ggaggatcagtggagcctcagaggt

SEQ ID NO: 649740 - DNA, 25 bp, Homo sapien
gaggatcagtggagcctcagaggtt

SEQ ID NO: 649741 - DNA, 25 bp, Homo sapien
aggatcagtggagcctcagaggttg

SEQ ID NO: 649742 - DNA, 25 bp, Homo sapien
ggatcagtggagcctcagaggttga

SEQ ID NO: 649743 - DNA, 25 bp, Homo sapien
gatcagtggagcctcagaggttgag

SEQ ID NO: 649744 - DNA, 25 bp, Homo sapien
atcagtggagcctcagaggttgagg

SEQ ID NO: 649745 - DNA, 25 bp, Homo sapien
tcagtggagcctcagaggttgaggc

SEQ ID NO: 649746 - DNA, 25 bp, Homo sapien
ctgcacctggcctaactgtgggctt

SEQ ID NO: 649747 - DNA, 25 bp, Homo sapien
gaaatgtctttttcaggttgaggaa

SEQ ID NO: 649748 - DNA, 25 bp, Homo sapien
tgtctttttcaggttgaggaaggtc

SEQ ID NO: 649749 - DNA, 25 bp, Homo sapien
aggaaggtcccttctattcctagtg

SEQ ID NO: 649750 - DNA, 25 bp, Homo sapien
gtcccttctattcctagtgtactga

SEQ ID NO: 649751 - DNA, 25 bp, Homo sapien
cttctattcctagtgtactgagagt

SEQ ID NO: 649752 - DNA, 25 bp, Homo sapien
cctagtgtactgagagtttgtatca

SEQ ID NO: 649753 - DNA, 25 bp, Homo sapien
tcaaatgttgttcctgtgtctattg

SEQ ID NO: 649754 - DNA, 25 bp, Homo sapien
aatgttgttcctgtgtctattgaga

SEQ ID NO: 649755 - DNA, 25 bp, Homo sapien
ttcctgtgtctattgagatggctgt

SEQ ID NO: 649756 - DNA, 25 bp, Homo sapien
agatggctgtatgggttttctcttt

SEQ ID NO: 649757 - DNA, 25 bp, Homo sapien
gaacaagttcaacaagtagaaaagt

SEQ ID NO: 649758 - DNA, 25 bp, Homo sapien
gaaaagttacaaacgtagtagatat

SEQ ID NO: 649759 - DNA, 25 bp, Homo sapien
caaacgtagtagatatgaatccaat

SEQ ID NO: 649760 - DNA, 25 bp, Homo sapien
acgtagtagatatgaatccaattat

SEQ ID NO: 649761 - DNA, 25 bp, Homo sapien
cactttgaatgtgaatggtctaaac

SEQ ID NO: 649762 - DNA, 25 bp, Homo sapien
tgaatgtgaatggtctaaacatacc

SEQ ID NO: 649763 - DNA, 25 bp, Homo sapien
gtgaatggtctaaacataccattga

SEQ ID NO: 649764 - DNA, 25 bp, Homo sapien
gtctaaacataccattgaacatatt

SEQ ID NO: 649765 - DNA, 25 bp, Homo sapien
cataccattgaacatattgaaaccc

SEQ ID NO: 649766 - DNA, 25 bp, Homo sapien
attgaacatattgaaaccccgtctc

SEQ ID NO: 649767 - DNA, 25 bp, Homo sapien
cgggacaggagaattacttgggctt

SEQ ID NO: 649768 - DNA, 25 bp, Homo sapien
ttctctgtctcccttagatatagag

SEQ ID NO: 649769 - DNA, 25 bp, Homo sapien
tcccttagatatagagttgccaatg

SEQ ID NO: 649770 - DNA, 25 bp, Homo sapien
tatagagttgccaatgcggcacaag

SEQ ID NO: 649771 - DNA, 25 bp, Homo sapien
aatgcggcacaagcaaaggttgtta

SEQ ID NO: 649772 - DNA, 25 bp, Homo sapien
gcaaaggttgttaggtgggatttat

SEQ ID NO: 649773 - DNA, 25 bp, Homo sapien
ggtgggatttatgagcagacttttc

SEQ ID NO: 649774 - DNA, 25 bp, Homo sapien
acttttcaaaagagatgggtgtact

SEQ ID NO: 649775 - DNA, 25 bp, Homo sapien
gggcatgattccctccttctatttt

SEQ ID NO: 649776 - DNA, 25 bp, Homo sapien
catgattccctccttctattttctt

SEQ ID NO: 649777 - DNA, 25 bp, Homo sapien
attttcttcttgcagggagtacaga

SEQ ID NO: 649778 - DNA, 25 bp, Homo sapien
tcttcttgcagggagtacagatgca

SEQ ID NO: 649779 - DNA, 25 bp, Homo sapien
acaacctggctgcattgactttttt

SEQ ID NO: 649780 - DNA, 25 bp, Homo sapien
gcattgacttttttggatcttcctc

SEQ ID NO: 649781 - DNA, 25 bp, Homo sapien
ttttggatcttcctcaacagtcttt

SEQ ID NO: 649782 - DNA, 25 bp, Homo sapien
aacagtctttgtacttttcacgcct

SEQ ID NO: 649783 - DNA, 25 bp, Homo sapien
tacttttcacgcctctgtgcctttg

SEQ ID NO: 649784 - DNA, 25 bp, Homo sapien
tgtgcctttgctcaagccgatctct

SEQ ID NO: 649785 - DNA, 25 bp, Homo sapien
ctcaagccgatctctttagctggaa

SEQ ID NO: 649786 - DNA, 25 bp, Homo sapien
gatctctttagctggaatgcccttc

SEQ ID NO: 649787 - DNA, 25 bp, Homo sapien
tttagctggaatgcccttcttcctc

SEQ ID NO: 649788 - DNA, 25 bp, Homo sapien
attccttatattttcaggttgaact

SEQ ID NO: 649789 - DNA, 25 bp, Homo sapien
aaacattttagcctgggtgcggtgg

SEQ ID NO: 649790 - DNA, 25 bp, Homo sapien
taaacagccctaattccctttagct

SEQ ID NO: 649791 - DNA, 25 bp, Homo sapien
gccctaattccctttagctatcaaa

SEQ ID NO: 649792 - DNA, 25 bp, Homo sapien
attccctttagctatcaaatttcta

SEQ ID NO: 649793 - DNA, 25 bp, Homo sapien
aaatttctaatggagctcacgcaat

SEQ ID NO: 649794 - DNA, 25 bp, Homo sapien
ggagctcacgcaatagctatagctt

SEQ ID NO: 649795 - DNA, 25 bp, Homo sapien
tagcttctataacttactcttcctc

SEQ ID NO: 649796 - DNA, 25 bp, Homo sapien
actcttcctcttctcaatgtttcct

SEQ ID NO: 649797 - DNA, 25 bp, Homo sapien
gtttcctcccttattatcataaaag

SEQ ID NO: 649798 - DNA, 25 bp, Homo sapien
ataaaaggtctcctaagcatcctcc

SEQ ID NO: 649799 - DNA, 25 bp, Homo sapien
ctcagctctttcttcctaatgatta

SEQ ID NO: 649800 - DNA, 25 bp, Homo sapien
tctgggtgcagaggcattcacctgt

SEQ ID NO: 649801 - DNA, 25 bp, Homo sapien
tggatggacatgtcaaatctaccac

SEQ ID NO: 649802 - DNA, 25 bp, Homo sapien
ggacatgtcaaatctaccacaagaa

SEQ ID NO: 649803 - DNA, 25 bp, Homo sapien
tgtcaaatctaccacaagaatttcg

SEQ ID NO: 649804 - DNA, 25 bp, Homo sapien
caaaatccatatgaagaaccaccaa

SEQ ID NO: 649805 - DNA, 25 bp, Homo sapien
atatgaagaaccaccaaagttacca

SEQ ID NO: 649806 - DNA, 25 bp, Homo sapien
aagttaccacgaagccggaagcaga

SEQ ID NO: 649807 - DNA, 25 bp, Homo sapien
agcagaggaggattccttgcagtgt

SEQ ID NO: 649808 - DNA, 25 bp, Homo sapien
gaggaggattccttgcagtgttaag

SEQ ID NO: 649809 - DNA, 25 bp, Homo sapien
cttgcagtgttaaggatctgtttaa

SEQ ID NO: 649810 - DNA, 25 bp, Homo sapien
taatttctgttggacactttttgtt

SEQ ID NO: 649811 - DNA, 25 bp, Homo sapien
atactaagggtaattttcggatgat

SEQ ID NO: 649812 - DNA, 25 bp, Homo sapien
atcacatattagatccttccctgtc

SEQ ID NO: 649813 - DNA, 25 bp, Homo sapien
tctgttgcaattcaggttttttggg

SEQ ID NO: 649814 - DNA, 25 bp, Homo sapien
agaagccagctaaggttgcctgact

SEQ ID NO: 649815 - DNA, 25 bp, Homo sapien
ggttgcctgacttctattacaaatt

SEQ ID NO: 649816 - DNA, 25 bp, Homo sapien
attacaaatttgttccagagctggg

SEQ ID NO: 649817 - DNA, 25 bp, Homo sapien
gagtctattttcaacacccagccca

SEQ ID NO: 649818 - DNA, 25 bp, Homo sapien
cagaactaagttttaccccacatca

SEQ ID NO: 649819 - DNA, 25 bp, Homo sapien
ggcacatgggacagaagagcttact

SEQ ID NO: 649820 - DNA, 25 bp, Homo sapien
aagagcttactgactgctaagggta

SEQ ID NO: 649821 - DNA, 25 bp, Homo sapien
gactgctaagggtagctcaggaaga

SEQ ID NO: 649822 - DNA, 25 bp, Homo sapien
tgccaggattccaagagcaggagtt

SEQ ID NO: 649823 - DNA, 25 bp, Homo sapien
agcatcccccttgggaggatgagga

SEQ ID NO: 649824 - DNA, 25 bp, Homo sapien
aaggtcacattctcaggatggtgga

SEQ ID NO: 649825 - DNA, 25 bp, Homo sapien
ggtcacattctcaggatggtggaga

SEQ ID NO: 649826 - DNA, 25 bp, Homo sapien
gtcacattctcaggatggtggagaa

SEQ ID NO: 649827 - DNA, 25 bp, Homo sapien
agctagaaggagactgggtacctga

SEQ ID NO: 649828 - DNA, 25 bp, Homo sapien
gaaggagactgggtacctgatgtcc

SEQ ID NO: 649829 - DNA, 25 bp, Homo sapien
aggagactgggtacctgatgtccgt

SEQ ID NO: 649830 - DNA, 25 bp, Homo sapien
agactgggtacctgatgtccgtggt

SEQ ID NO: 649831 - DNA, 25 bp, Homo sapien
actgggtacctgatgtccgtggtgc

SEQ ID NO: 649832 - DNA, 25 bp, Homo sapien
ctgggtacctgatgtccgtggtgct

SEQ ID NO: 649833 - DNA, 25 bp, Homo sapien
gtacctgatgtccgtggtgctgccc

SEQ ID NO: 649834 - DNA, 25 bp, Homo sapien
gttcttgtctttgccaaatcttgca

SEQ ID NO: 649835 - DNA, 25 bp, Homo sapien
tcttgtctttgccaaatcttgcatt

SEQ ID NO: 649836 - DNA, 25 bp, Homo sapien
tgtctttgccaaatcttgcatttat

SEQ ID NO: 649837 - DNA, 25 bp, Homo sapien
gtctttgccaaatcttgcatttatg

SEQ ID NO: 649838 - DNA, 25 bp, Homo sapien
ctttgccaaatcttgcatttatggg

SEQ ID NO: 649839 - DNA, 25 bp, Homo sapien
ttgccaaatcttgcatttatgggat

SEQ ID NO: 649840 - DNA, 25 bp, Homo sapien
gccaaatcttgcatttatgggatga

SEQ ID NO: 649841 - DNA, 25 bp, Homo sapien
tcttgcatttatgggatgatacctc

SEQ ID NO: 649842 - DNA, 25 bp, Homo sapien
ttgcatttatgggatgatacctctt

SEQ ID NO: 649843 - DNA, 25 bp, Homo sapien
atgggatgatacctctttgattaga

SEQ ID NO: 649844 - DNA, 25 bp, Homo sapien
tatacccttgaaaatacagcaccag

SEQ ID NO: 649845 - DNA, 25 bp, Homo sapien
aagtactttcccgagcattcattca

SEQ ID NO: 649846 - DNA, 25 bp, Homo sapien
attcattcaccctagagtgcacatg

SEQ ID NO: 649847 - DNA, 25 bp, Homo sapien
agtgcacatgattcctctaaacaaa

SEQ ID NO: 649848 - DNA, 25 bp, Homo sapien
gattcctctaaacaaactctcccat

SEQ ID NO: 649849 - DNA, 25 bp, Homo sapien
aaatatcgatcaaggagagactcat

SEQ ID NO: 649850 - DNA, 25 bp, Homo sapien
agagactcatctcctgacagcagtg

SEQ ID NO: 649851 - DNA, 25 bp, Homo sapien
atctcctgacagcagtggcacaagc

SEQ ID NO: 649852 - DNA, 25 bp, Homo sapien
gctttagtaactcctcatagagatt

SEQ ID NO: 649853 - DNA, 25 bp, Homo sapien
acagatacgttattgctgctcctct

SEQ ID NO: 649854 - DNA, 25 bp, Homo sapien
tcttcactgtctcactcacactaaa

SEQ ID NO: 649855 - DNA, 25 bp, Homo sapien
tcacactaaactctcctgccagagg

SEQ ID NO: 649856 - DNA, 25 bp, Homo sapien
aaataactgcaatagggtttctgta

SEQ ID NO: 649857 - DNA, 25 bp, Homo sapien
tctgtaagtaaagggccctcattta

SEQ ID NO: 649858 - DNA, 25 bp, Homo sapien
aagggccctcatttaaataatgctg

SEQ ID NO: 649859 - DNA, 25 bp, Homo sapien
gtgatgaaactcttcgtggccagca

SEQ ID NO: 649860 - DNA, 25 bp, Homo sapien
gcacagagcactttgagttagttat

SEQ ID NO: 649861 - DNA, 25 bp, Homo sapien
agttataaaccattctacacacaga

SEQ ID NO: 649862 - DNA, 25 bp, Homo sapien
catagtgtaacagcatttctcattg

SEQ ID NO: 649863 - DNA, 25 bp, Homo sapien
acagcatttctcattgcctagcatg

SEQ ID NO: 649864 - DNA, 25 bp, Homo sapien
atttctcattgcctagcatgggcct

SEQ ID NO: 649865 - DNA, 25 bp, Homo sapien
tagcatgggccttctccatatcgaa

SEQ ID NO: 649866 - DNA, 25 bp, Homo sapien
ccttctccatatcgaaggcccaata

SEQ ID NO: 649867 - DNA, 25 bp, Homo sapien
aggagccctgactgggaggtacctt

SEQ ID NO: 649868 - DNA, 25 bp, Homo sapien
ggagccctgactgggaggtaccttc

SEQ ID NO: 649869 - DNA, 25 bp, Homo sapien
agccctgactgggaggtaccttctt

SEQ ID NO: 649870 - DNA, 25 bp, Homo sapien
tgactgggaggtaccttcttccaaa

SEQ ID NO: 649871 - DNA, 25 bp, Homo sapien
tcttccaaacccggtggcgggacag

SEQ ID NO: 649872 - DNA, 25 bp, Homo sapien
gcctggccggcctctgcagagacgt

SEQ ID NO: 649873 - DNA, 25 bp, Homo sapien
ggccggcctctgcagagacgtccaa

SEQ ID NO: 649874 - DNA, 25 bp, Homo sapien
tctgcagagacgtccaacctcgtgc

SEQ ID NO: 649875 - DNA, 25 bp, Homo sapien
agagacgtccaacctcgtgcgcatg

SEQ ID NO: 649876 - DNA, 25 bp, Homo sapien
agacgtccaacctcgtgcgcatgcg

SEQ ID NO: 649877 - DNA, 25 bp, Homo sapien
aacctcgtgcgcatgcgcagccagg

SEQ ID NO: 649878 - DNA, 25 bp, Homo sapien
gaagtttttaaggccgggcactgtg

SEQ ID NO: 649879 - DNA, 25 bp, Homo sapien
gtttttaaggccgggcactgtggct

SEQ ID NO: 649880 - DNA, 25 bp, Homo sapien
tttttaaggccgggcactgtggctc

SEQ ID NO: 649881 - DNA, 25 bp, Homo sapien
ttttaaggccgggcactgtggctca

SEQ ID NO: 649882 - DNA, 25 bp, Homo sapien
ggttgggagtccaacaccagcctga

SEQ ID NO: 649883 - DNA, 25 bp, Homo sapien
gttgggagtccaacaccagcctgac

SEQ ID NO: 649884 - DNA, 25 bp, Homo sapien
ttgggagtccaacaccagcctgacc

SEQ ID NO: 649885 - DNA, 25 bp, Homo sapien
cagcctgaccaaccctgtctctact

SEQ ID NO: 649886 - DNA, 25 bp, Homo sapien
ggtgagctcagattgcaccattgct

SEQ ID NO: 649887 - DNA, 25 bp, Homo sapien
agctcagattgcaccattgctctcc

SEQ ID NO: 649888 - DNA, 25 bp, Homo sapien
gctcagattgcaccattgctctcca

SEQ ID NO: 649889 - DNA, 25 bp, Homo sapien
gggcttggggcctgagcgcagtggc

SEQ ID NO: 649890 - DNA, 25 bp, Homo sapien
ggcttggggcctgagcgcagtggct

SEQ ID NO: 649891 - DNA, 25 bp, Homo sapien
agaccaccctgaccagcatgaaacc

SEQ ID NO: 649892 - DNA, 25 bp, Homo sapien
agaatcacttgggccagggatgctg

SEQ ID NO: 649893 - DNA, 25 bp, Homo sapien
aatcacttgggccagggatgctgag

SEQ ID NO: 649894 - DNA, 25 bp, Homo sapien
atcacttgggccagggatgctgagg

SEQ ID NO: 649895 - DNA, 25 bp, Homo sapien
tcacttgggccagggatgctgaggt

SEQ ID NO: 649896 - DNA, 25 bp, Homo sapien
cacttgggccagggatgctgaggtt

SEQ ID NO: 649897 - DNA, 25 bp, Homo sapien
acttgggccagggatgctgaggttg

SEQ ID NO: 649898 - DNA, 25 bp, Homo sapien
ggccagggatgctgaggttgcacga

SEQ ID NO: 649899 - DNA, 25 bp, Homo sapien
gggatgctgaggttgcacgagctga

SEQ ID NO: 649900 - DNA, 25 bp, Homo sapien
tattatataaggtcaaggaactaaa

SEQ ID NO: 649901 - DNA, 25 bp, Homo sapien
ttatataaggtcaaggaactaaata

SEQ ID NO: 649902 - DNA, 25 bp, Homo sapien
atataaggtcaaggaactaaatatt

SEQ ID NO: 649903 - DNA, 25 bp, Homo sapien
aaatattagtaaagagtcaggccag

SEQ ID NO: 649904 - DNA, 25 bp, Homo sapien
aatattagtaaagagtcaggccagg

SEQ ID NO: 649905 - DNA, 25 bp, Homo sapien
atattagtaaagagtcaggccaggc

SEQ ID NO: 649906 - DNA, 25 bp, Homo sapien
tattagtaaagagtcaggccaggcg

SEQ ID NO: 649907 - DNA, 25 bp, Homo sapien
attagtaaagagtcaggccaggcgt

SEQ ID NO: 649908 - DNA, 25 bp, Homo sapien
ttagtaaagagtcaggccaggcgtg

SEQ ID NO: 649909 - DNA, 25 bp, Homo sapien
tagtaaagagtcaggccaggcgtgg

SEQ ID NO: 649910 - DNA, 25 bp, Homo sapien
agtagtgtgtggtatggtggcgcat

SEQ ID NO: 649911 - DNA, 25 bp, Homo sapien
aagccctcccgcttccagggaggat

SEQ ID NO: 649912 - DNA, 25 bp, Homo sapien
gaggatgtgcatggctctgccaatg

SEQ ID NO: 649913 - DNA, 25 bp, Homo sapien
aggatgcgcaagactgggctgccca

SEQ ID NO: 649914 - DNA, 25 bp, Homo sapien
ggacgcgacgcctgatagccagtga

SEQ ID NO: 649915 - DNA, 25 bp, Homo sapien
gatagccagtgaggagccaggcaca

SEQ ID NO: 649916 - DNA, 25 bp, Homo sapien
ggagccaggcacacaacttggaaat

SEQ ID NO: 649917 - DNA, 25 bp, Homo sapien
caagctttattttcagtttcaacag

SEQ ID NO: 649918 - DNA, 25 bp, Homo sapien
ttcagtttcaacaggtaaggcgata

SEQ ID NO: 649919 - DNA, 25 bp, Homo sapien
ggtaaggcgatacctgcttcatcgt

SEQ ID NO: 649920 - DNA, 25 bp, Homo sapien
acctgcttcatcgtgtgcttttatg

SEQ ID NO: 649921 - DNA, 25 bp, Homo sapien
cgtgtgcttttatgtaaatgccaaa

SEQ ID NO: 649922 - DNA, 25 bp, Homo sapien
tattgtctccgatagaaggtcatct

SEQ ID NO: 649923 - DNA, 25 bp, Homo sapien
aaggtcatcttcgtaggcatgggaa

SEQ ID NO: 649924 - DNA, 25 bp, Homo sapien
gtcatcttcgtaggcatgggaactg

SEQ ID NO: 649925 - DNA, 25 bp, Homo sapien
tcgtaggcatgggaactgtgtttta

SEQ ID NO: 649926 - DNA, 25 bp, Homo sapien
ggtgctcagcaaatagttgctgcat

SEQ ID NO: 649927 - DNA, 25 bp, Homo sapien
gcaaatagttgctgcatgaatacag

SEQ ID NO: 649928 - DNA, 25 bp, Homo sapien
ataagtgactggatgaatgtgcaag

SEQ ID NO: 649929 - DNA, 25 bp, Homo sapien
atgaatgtgcaagggtggctctggc

SEQ ID NO: 649930 - DNA, 25 bp, Homo sapien
ggagctgcttttagccccgcttcat

SEQ ID NO: 649931 - DNA, 25 bp, Homo sapien
ttagccccgcttcatggagggcgca

SEQ ID NO: 649932 - DNA, 25 bp, Homo sapien
catggagggcgcaggtgtcttcatc

SEQ ID NO: 649933 - DNA, 25 bp, Homo sapien
aaacagttgtgctgcaggatcccaa

SEQ ID NO: 649934 - DNA, 25 bp, Homo sapien
tgcaggatcccaaaagccagataag

SEQ ID NO: 649935 - DNA, 25 bp, Homo sapien
gataagagcctttagagaccctcta

SEQ ID NO: 649936 - DNA, 25 bp, Homo sapien
gagaccctctacaggatgacactgg

SEQ ID NO: 649937 - DNA, 25 bp, Homo sapien
aggaagtcacctcctctgaagataa

SEQ ID NO: 649938 - DNA, 25 bp, Homo sapien
tctttggcctttaagcaggaattaa

SEQ ID NO: 649939 - DNA, 25 bp, Homo sapien
aaagatgtgatcctctgtatctccc

SEQ ID NO: 649940 - DNA, 25 bp, Homo sapien
tctgtatctccccagtaatcacatt

SEQ ID NO: 649941 - DNA, 25 bp, Homo sapien
taatcacattccgagaaccctttct

SEQ ID NO: 649942 - DNA, 25 bp, Homo sapien
ggatgagatgctctacccgagatta

SEQ ID NO: 649943 - DNA, 25 bp, Homo sapien
ttgcagagcaggtttactggtctcc

SEQ ID NO: 649944 - DNA, 25 bp, Homo sapien
tataatgtcgagaatcattgggata

SEQ ID NO: 649945 - DNA, 25 bp, Homo sapien
aatcattgggataactcggctgtca

SEQ ID NO: 649946 - DNA, 25 bp, Homo sapien
atcattgggataactcggctgtcat

SEQ ID NO: 649947 - DNA, 25 bp, Homo sapien
cattgggataactcggctgtcatgt

SEQ ID NO: 649948 - DNA, 25 bp, Homo sapien
attgggataactcggctgtcatgtt

SEQ ID NO: 649949 - DNA, 25 bp, Homo sapien
ggataactcggctgtcatgttgaga

SEQ ID NO: 649950 - DNA, 25 bp, Homo sapien
ataactcggctgtcatgttgagaac

SEQ ID NO: 649951 - DNA, 25 bp, Homo sapien
aactcggctgtcatgttgagaacaa

SEQ ID NO: 649952 - DNA, 25 bp, Homo sapien
ctcggctgtcatgttgagaacaaac

SEQ ID NO: 649953 - DNA, 25 bp, Homo sapien
ggctgtcatgttgagaacaaactat

SEQ ID NO: 649954 - DNA, 25 bp, Homo sapien
cccagcactttggagatcgagacca

SEQ ID NO: 649955 - DNA, 25 bp, Homo sapien
taagagcttggactttgaagccagg

SEQ ID NO: 649956 - DNA, 25 bp, Homo sapien
aaatcctggctttctcaccttctag

SEQ ID NO: 649957 - DNA, 25 bp, Homo sapien
tcaccttctagctccgttaccttaa

SEQ ID NO: 649958 - DNA, 25 bp, Homo sapien
gctccgttaccttaaagaacttcat

SEQ ID NO: 649959 - DNA, 25 bp, Homo sapien
cattatcttccttgtattttagtct

SEQ ID NO: 649960 - DNA, 25 bp, Homo sapien
tagtcttttcatctctaaattagtg

SEQ ID NO: 649961 - DNA, 25 bp, Homo sapien
agtacttaaacagtgcctaccaggt

SEQ ID NO: 649962 - DNA, 25 bp, Homo sapien
gcctaccaggtagtaagtgctatag

SEQ ID NO: 649963 - DNA, 25 bp, Homo sapien
gtgctatagcagagtgtgttagata

SEQ ID NO: 649964 - DNA, 25 bp, Homo sapien
gataatgaaacatcctgtgctgtgg

SEQ ID NO: 649965 - DNA, 25 bp, Homo sapien
gtgctgtggatatattattcccatt

SEQ ID NO: 649966 - DNA, 25 bp, Homo sapien
actaacccaatacttttatcacttg

SEQ ID NO: 649967 - DNA, 25 bp, Homo sapien
acccaatacttttatcacttgtaat

SEQ ID NO: 649968 - DNA, 25 bp, Homo sapien
acttttatcacttgtaatttgtata

SEQ ID NO: 649969 - DNA, 25 bp, Homo sapien
tatattttagacttattagagaacg

SEQ ID NO: 649970 - DNA, 25 bp, Homo sapien
gaacgatttttaattggatatcact

SEQ ID NO: 649971 - DNA, 25 bp, Homo sapien
ttttaattggatatcactcttgtgc

SEQ ID NO: 649972 - DNA, 25 bp, Homo sapien
aagtatgctaataccaagtatcaag

SEQ ID NO: 649973 - DNA, 25 bp, Homo sapien
gaagaatgaagcaagatagctcaaa

SEQ ID NO: 649974 - DNA, 25 bp, Homo sapien
gatagctcaaatatgcttttgaagg

SEQ ID NO: 649975 - DNA, 25 bp, Homo sapien
aaggaaatatactgggcttcattca

SEQ ID NO: 649976 - DNA, 25 bp, Homo sapien
aggaaatatactgggcttcattcat

SEQ ID NO: 649977 - DNA, 25 bp, Homo sapien
tcagggcgatatgaagaccccagga

SEQ ID NO: 649978 - DNA, 25 bp, Homo sapien
aagaccccaggaaggaaattatgct

SEQ ID NO: 649979 - DNA, 25 bp, Homo sapien
aaaggagatcacacctctgtccagc

SEQ ID NO: 649980 - DNA, 25 bp, Homo sapien
ggccccttggcatgccctgaagaca

SEQ ID NO: 649981 - DNA, 25 bp, Homo sapien
gcatgccctgaagacacaaggccta

SEQ ID NO: 649982 - DNA, 25 bp, Homo sapien
atgccctgaagacacaaggcctaaa

SEQ ID NO: 649983 - DNA, 25 bp, Homo sapien
gacacaaggcctaaatcaaggtcaa

SEQ ID NO: 649984 - DNA, 25 bp, Homo sapien
aaatcaaggtcaaagacacagccct

SEQ ID NO: 649985 - DNA, 25 bp, Homo sapien
gctgcatgaggagggttacccagaa

SEQ ID NO: 649986 - DNA, 25 bp, Homo sapien
atgaggagggttacccagaatgtca

SEQ ID NO: 649987 - DNA, 25 bp, Homo sapien
gtgggttttatttcgtgtgcacaaa

SEQ ID NO: 649988 - DNA, 25 bp, Homo sapien
gtcctcattgagttgacatccaaaa

SEQ ID NO: 649989 - DNA, 25 bp, Homo sapien
gttgacatccaaaatttgtcaggaa

SEQ ID NO: 649990 - DNA, 25 bp, Homo sapien
gaatgacttttgagtggcaattatt

SEQ ID NO: 649991 - DNA, 25 bp, Homo sapien
ttccattgtcttcatattcaccttt

SEQ ID NO: 649992 - DNA, 25 bp, Homo sapien
gtcttcatattcaccttttgtcatt

SEQ ID NO: 649993 - DNA, 25 bp, Homo sapien
atgaggtcatcaagggcagagaact

SEQ ID NO: 649994 - DNA, 25 bp, Homo sapien
gcagagaactgtgtggcatctcctt

SEQ ID NO: 649995 - DNA, 25 bp, Homo sapien
aactgtgtggcatctccttatagta

SEQ ID NO: 649996 - DNA, 25 bp, Homo sapien
ggcatctccttatagtaaaagtgca

SEQ ID NO: 649997 - DNA, 25 bp, Homo sapien
aagtgcaatcatatggatggctaac

SEQ ID NO: 649998 - DNA, 25 bp, Homo sapien
aatcatatggatggctaactttgta

SEQ ID NO: 649999 - DNA, 25 bp, Homo sapien
aaactagacaagtgagtgcctacgt

SEQ ID NO: 650000 - DNA, 25 bp, Homo sapien
gtgcctacgtgacactcaaatgttg

SEQ ID NO: 650001 - DNA, 25 bp, Homo sapien
acgtgacactcaaatgttgccagca

SEQ ID NO: 650002 - DNA, 25 bp, Homo sapien
ccagcatacagttaagggccctagt

SEQ ID NO: 650003 - DNA, 25 bp, Homo sapien
gggccctagtcaatgtaggcctgct

SEQ ID NO: 650004 - DNA, 25 bp, Homo sapien
gtcaatgtaggcctgcttcttatag

SEQ ID NO: 650005 - DNA, 25 bp, Homo sapien
gtaggcctgcttcttatagcttttt

SEQ ID NO: 650006 - DNA, 25 bp, Homo sapien
tattatgctgtctttgacttagtca

SEQ ID NO: 650007 - DNA, 25 bp, Homo sapien
ctttgacttagtcagtcaacactta

SEQ ID NO: 650008 - DNA, 25 bp, Homo sapien
taagtgccaaacactctcctggact

SEQ ID NO: 650009 - DNA, 25 bp, Homo sapien
tgccaaacactctcctggactctgg

SEQ ID NO: 650010 - DNA, 25 bp, Homo sapien
ctacataacatggagagctagctat

SEQ ID NO: 650011 - DNA, 25 bp, Homo sapien
gagctagctatatacccttggcatc

SEQ ID NO: 650012 - DNA, 25 bp, Homo sapien
tatacccttggcatcagtttttatc

SEQ ID NO: 650013 - DNA, 25 bp, Homo sapien
catcagtttttatcctacttttact

SEQ ID NO: 650014 - DNA, 25 bp, Homo sapien
tcatttactgaacaaagcctccttt

SEQ ID NO: 650015 - DNA, 25 bp, Homo sapien
aacaaagcctcctttgccaaaggca

SEQ ID NO: 650016 - DNA, 25 bp, Homo sapien
gccaaaggcagggtaaataaactca

SEQ ID NO: 650017 - DNA, 25 bp, Homo sapien
ataaactcagtcacatcctgtcttc

SEQ ID NO: 650018 - DNA, 25 bp, Homo sapien
aaagcatgcttgaagcggttacacg

SEQ ID NO: 650019 - DNA, 25 bp, Homo sapien
gaagcggttacacgaaggccaaata

SEQ ID NO: 650020 - DNA, 25 bp, Homo sapien
acctaaaatgatactgagctggccc

SEQ ID NO: 650021 - DNA, 25 bp, Homo sapien
gagaaagtcgtgtagtcctgtttac

SEQ ID NO: 650022 - DNA, 25 bp, Homo sapien
gtcctgtttacaattcactatggta

SEQ ID NO: 650023 - DNA, 25 bp, Homo sapien
acaaccggagactggtctaataaat

SEQ ID NO: 650024 - DNA, 25 bp, Homo sapien
gatagaattctacacagccactgaa

SEQ ID NO: 650025 - DNA, 25 bp, Homo sapien
tctacacagccactgaattcatgct

SEQ ID NO: 650026 - DNA, 25 bp, Homo sapien
tgttcaagtcacattacccagggaa

SEQ ID NO: 650027 - DNA, 25 bp, Homo sapien
ggagattacaaaatacaagcctttt

SEQ ID NO: 650028 - DNA, 25 bp, Homo sapien
aaaacgtgtcagaatggtcatggca

SEQ ID NO: 650029 - DNA, 25 bp, Homo sapien
ggtcatggcaaaggcaaccatggtt

SEQ ID NO: 650030 - DNA, 25 bp, Homo sapien
caaccatggttatcacttgacagtg

SEQ ID NO: 650031 - DNA, 25 bp, Homo sapien
aagaatgatcccattcttaatggct

SEQ ID NO: 650032 - DNA, 25 bp, Homo sapien
atgcccgttgtgtgagtaattgccc

SEQ ID NO: 650033 - DNA, 25 bp, Homo sapien
gtgtgagtaattgcccatgtctgag

SEQ ID NO: 650034 - DNA, 25 bp, Homo sapien
attgcccatgtctgaggaaactttt

SEQ ID NO: 650035 - DNA, 25 bp, Homo sapien
taaaagcagcactagtgtaggcggg

SEQ ID NO: 650036 - DNA, 25 bp, Homo sapien
tttttagtttctcagaacagcccat

SEQ ID NO: 650037 - DNA, 25 bp, Homo sapien
agaacagcccataaccgagaaacag

SEQ ID NO: 650038 - DNA, 25 bp, Homo sapien
acaggaaggcacatgtcgtttacca

SEQ ID NO: 650039 - DNA, 25 bp, Homo sapien
tgtcgtttaccatgagctgtactct

SEQ ID NO: 650040 - DNA, 25 bp, Homo sapien
atgagctgtactctcgcccgtttca

SEQ ID NO: 650041 - DNA, 25 bp, Homo sapien
gcccgtttcacaagtggcccaaata

SEQ ID NO: 650042 - DNA, 25 bp, Homo sapien
tccatttgccaaagagcattctgtg

SEQ ID NO: 650043 - DNA, 25 bp, Homo sapien
tttggcaaaaatctcaactcccgta

SEQ ID NO: 650044 - DNA, 25 bp, Homo sapien
atctcaactcccgtaatcacatgaa

SEQ ID NO: 650045 - DNA, 25 bp, Homo sapien
tttcttctccaagggcaggaaattc

SEQ ID NO: 650046 - DNA, 25 bp, Homo sapien
ggcaggaaattcaaaggctacatat

SEQ ID NO: 650047 - DNA, 25 bp, Homo sapien
ggctacatatgtagggttgcccagt

SEQ ID NO: 650048 - DNA, 25 bp, Homo sapien
atatgtagggttgcccagtgggaat

SEQ ID NO: 650049 - DNA, 25 bp, Homo sapien
gtgggaatctgagactctagaaact

SEQ ID NO: 650050 - DNA, 25 bp, Homo sapien
gactctagaaactacatcctgcttt

SEQ ID NO: 650051 - DNA, 25 bp, Homo sapien
agaaactacatcctgcttttgcata

SEQ ID NO: 650052 - DNA, 25 bp, Homo sapien
atcctgcttttgcatatatcaagat

SEQ ID NO: 650053 - DNA, 25 bp, Homo sapien
tatcaagattattttggtgccaaaa

SEQ ID NO: 650054 - DNA, 25 bp, Homo sapien
tgtccaggactgaggcgcccgggag

SEQ ID NO: 650055 - DNA, 25 bp, Homo sapien
cggtcaccgttgtgcgcacacggac

SEQ ID NO: 650056 - DNA, 25 bp, Homo sapien
gttgtgcgcacacggaccctttcca

SEQ ID NO: 650057 - DNA, 25 bp, Homo sapien
gcccaggctgggtcgggaacggcaa

SEQ ID NO: 650058 - DNA, 25 bp, Homo sapien
ggcaagcgccagagggtgtccgtgt

SEQ ID NO: 650059 - DNA, 25 bp, Homo sapien
gtgtccgtgtgggaacccgtcccat

SEQ ID NO: 650060 - DNA, 25 bp, Homo sapien
tgtgggaacccgtcccattcacgcg

SEQ ID NO: 650061 - DNA, 25 bp, Homo sapien
acagcggcaatcaacacgcttctgt

SEQ ID NO: 650062 - DNA, 25 bp, Homo sapien
gcggcaatcaacacgcttctgtgaa

SEQ ID NO: 650063 - DNA, 25 bp, Homo sapien
atcaacacgcttctgtgaataaata

SEQ ID NO: 650064 - DNA, 25 bp, Homo sapien
gtttatcattccgtacaaacgcaaa

SEQ ID NO: 650065 - DNA, 25 bp, Homo sapien
taaatagaatatgggctggacgcag

SEQ ID NO: 650066 - DNA, 25 bp, Homo sapien
agcactttggtaggcgacgtcgggc

SEQ ID NO: 650067 - DNA, 25 bp, Homo sapien
ctttggtaggcgacgtcgggcagat

SEQ ID NO: 650068 - DNA, 25 bp, Homo sapien
tttggtaggcgacgtcgggcagatc

SEQ ID NO: 650069 - DNA, 25 bp, Homo sapien
ttggtaggcgacgtcgggcagatca

SEQ ID NO: 650070 - DNA, 25 bp, Homo sapien
tggtaggcgacgtcgggcagatcat

SEQ ID NO: 650071 - DNA, 25 bp, Homo sapien
taggcgacgtcgggcagatcatgag

SEQ ID NO: 650072 - DNA, 25 bp, Homo sapien
gtgaaactctctactaaaacaacaa

SEQ ID NO: 650073 - DNA, 25 bp, Homo sapien
catggtggtgcacccgtattcctag

SEQ ID NO: 650074 - DNA, 25 bp, Homo sapien
atggtggtgcacccgtattcctagc

SEQ ID NO: 650075 - DNA, 25 bp, Homo sapien
tggtgcacccgtattcctagctact

SEQ ID NO: 650076 - DNA, 25 bp, Homo sapien
caaaatacccactacttgatagcct

SEQ ID NO: 650077 - DNA, 25 bp, Homo sapien
aaaatacccactacttgatagccta

SEQ ID NO: 650078 - DNA, 25 bp, Homo sapien
aaatacccactacttgatagcctag

SEQ ID NO: 650079 - DNA, 25 bp, Homo sapien
aatacccactacttgatagcctaga

SEQ ID NO: 650080 - DNA, 25 bp, Homo sapien
atacccactacttgatagcctagag

SEQ ID NO: 650081 - DNA, 25 bp, Homo sapien
ttgatagcctagagaaaccaaggca

SEQ ID NO: 650082 - DNA, 25 bp, Homo sapien
gaaaccaaggcaaatggttgcttaa

SEQ ID NO: 650083 - DNA, 25 bp, Homo sapien
ccaaggcaaatggttgcttaaaaat

SEQ ID NO: 650084 - DNA, 25 bp, Homo sapien
aggcaaatggttgcttaaaaatgct

SEQ ID NO: 650085 - DNA, 25 bp, Homo sapien
taaaaatgctgtttttggctgggcg

SEQ ID NO: 650086 - DNA, 25 bp, Homo sapien
aaaatgctgtttttggctgggcgcg

SEQ ID NO: 650087 - DNA, 25 bp, Homo sapien
atacccagcccaaatttcactcttt

SEQ ID NO: 650088 - DNA, 25 bp, Homo sapien
ccagcccaaatttcactctttaatg

SEQ ID NO: 650089 - DNA, 25 bp, Homo sapien
gcccaaatttcactctttaatgttt

SEQ ID NO: 650090 - DNA, 25 bp, Homo sapien
atttcactctttaatgttttcctgt

SEQ ID NO: 650091 - DNA, 25 bp, Homo sapien
tcactctttaatgttttcctgttgc

SEQ ID NO: 650092 - DNA, 25 bp, Homo sapien
actctttaatgttttcctgttgcta

SEQ ID NO: 650093 - DNA, 25 bp, Homo sapien
ctctttaatgttttcctgttgctat

SEQ ID NO: 650094 - DNA, 25 bp, Homo sapien
gaaaaaactttcctattcagacagt

SEQ ID NO: 650095 - DNA, 25 bp, Homo sapien
aaactttcctattcagacagtgtga

SEQ ID NO: 650096 - DNA, 25 bp, Homo sapien
actttcctattcagacagtgtgaaa

SEQ ID NO: 650097 - DNA, 25 bp, Homo sapien
tcctattcagacagtgtgaaaatca

SEQ ID NO: 650098 - DNA, 25 bp, Homo sapien
ctgcagccacatcatttcaacttca

SEQ ID NO: 650099 - DNA, 25 bp, Homo sapien
tgcagccacatcatttcaacttcac

SEQ ID NO: 650100 - DNA, 25 bp, Homo sapien
gcagccacatcatttcaacttcact

SEQ ID NO: 650101 - DNA, 25 bp, Homo sapien
agccacatcatttcaacttcacttt

SEQ ID NO: 650102 - DNA, 25 bp, Homo sapien
gccacatcatttcaacttcacttta

SEQ ID NO: 650103 - DNA, 25 bp, Homo sapien
ccacatcatttcaacttcactttaa

SEQ ID NO: 650104 - DNA, 25 bp, Homo sapien
cacatcatttcaacttcactttaaa

SEQ ID NO: 650105 - DNA, 25 bp, Homo sapien
catcatttcaacttcactttaaaaa

SEQ ID NO: 650106 - DNA, 25 bp, Homo sapien
aaatatctttttggcctggcacagt

SEQ ID NO: 650107 - DNA, 25 bp, Homo sapien
gcctggaagattgacgctgtggtga

SEQ ID NO: 650108 - DNA, 25 bp, Homo sapien
gaagattgacgctgtggtgagctgt

SEQ ID NO: 650109 - DNA, 25 bp, Homo sapien
aaatagctggaggaccttggcacca

SEQ ID NO: 650110 - DNA, 25 bp, Homo sapien
aatagctggaggaccttggcaccac

SEQ ID NO: 650111 - DNA, 25 bp, Homo sapien
atagctggaggaccttggcaccacc

SEQ ID NO: 650112 - DNA, 25 bp, Homo sapien
tggccctggtggctaaaataataat

SEQ ID NO: 650113 - DNA, 25 bp, Homo sapien
actattggtgttatgtgtaaattcc

SEQ ID NO: 650114 - DNA, 25 bp, Homo sapien
ctattggtgttatgtgtaaattcca

SEQ ID NO: 650115 - DNA, 25 bp, Homo sapien
ttggtgttatgtgtaaattccagac

SEQ ID NO: 650116 - DNA, 25 bp, Homo sapien
ggtgttatgtgtaaattccagacac

SEQ ID NO: 650117 - DNA, 25 bp, Homo sapien
gtgtaaattccagacactgtatgag

SEQ ID NO: 650118 - DNA, 25 bp, Homo sapien
agtcacgtttttcacgcttacttga

SEQ ID NO: 650119 - DNA, 25 bp, Homo sapien
cgtttttcacgcttacttgatctat

SEQ ID NO: 650120 - DNA, 25 bp, Homo sapien
agagcaatgacatttcctacccagc

SEQ ID NO: 650121 - DNA, 25 bp, Homo sapien
agccagagccacacggcctgtgaca

SEQ ID NO: 650122 - DNA, 25 bp, Homo sapien
gcctgtgacagcatggctgagaatc

SEQ ID NO: 650123 - DNA, 25 bp, Homo sapien
gaatcaaaccccaagctttgactct

SEQ ID NO: 650124 - DNA, 25 bp, Homo sapien
aaccccaagctttgactctagatca

SEQ ID NO: 650125 - DNA, 25 bp, Homo sapien
aagctttgactctagatcaaaactc

SEQ ID NO: 650126 - DNA, 25 bp, Homo sapien
aaactctttccaccactatactctt

SEQ ID NO: 650127 - DNA, 25 bp, Homo sapien
tctttccaccactatactcttatag

SEQ ID NO: 650128 - DNA, 25 bp, Homo sapien
ccaccactatactcttatagggaaa

SEQ ID NO: 650129 - DNA, 25 bp, Homo sapien
atacaagggttaaaagagactctga

SEQ ID NO: 650130 - DNA, 25 bp, Homo sapien
aagagactctgagaggctggatgca

SEQ ID NO: 650131 - DNA, 25 bp, Homo sapien
gagacaagaacagtagtcctgcttt

SEQ ID NO: 650132 - DNA, 25 bp, Homo sapien
agacaagaacagtagtcctgctttg

SEQ ID NO: 650133 - DNA, 25 bp, Homo sapien
agaacagtagtcctgctttgaaaag

SEQ ID NO: 650134 - DNA, 25 bp, Homo sapien
aaattgacagactaactgacataga

SEQ ID NO: 650135 - DNA, 25 bp, Homo sapien
attgacagactaactgacatagaaa

SEQ ID NO: 650136 - DNA, 25 bp, Homo sapien
gacagactaactgacatagaaaaag

SEQ ID NO: 650137 - DNA, 25 bp, Homo sapien
tcctatgtaaaaggcgtggaagaaa

SEQ ID NO: 650138 - DNA, 25 bp, Homo sapien
atgttggagatacctaaaagaatca

SEQ ID NO: 650139 - DNA, 25 bp, Homo sapien
gttggagatacctaaaagaatcaag

SEQ ID NO: 650140 - DNA, 25 bp, Homo sapien
aagaatcaagaggtggaaaactgct

SEQ ID NO: 650141 - DNA, 25 bp, Homo sapien
aagtaacttattgacagtattaata

SEQ ID NO: 650142 - DNA, 25 bp, Homo sapien
taatatcttccactataaacctttt

SEQ ID NO: 650143 - DNA, 25 bp, Homo sapien
ccaaagttaggactactgggtctat

SEQ ID NO: 650144 - DNA, 25 bp, Homo sapien
gactactgggtctatcaaatggcaa

SEQ ID NO: 650145 - DNA, 25 bp, Homo sapien
tggcaaaatcactttaatggctttt

SEQ ID NO: 650146 - DNA, 25 bp, Homo sapien
acatcatataacaaactgctcccac

SEQ ID NO: 650147 - DNA, 25 bp, Homo sapien
ccccagaactgtttgcacgaatcaa

SEQ ID NO: 650148 - DNA, 25 bp, Homo sapien
gcacgaatcaagttcccttacagtt

SEQ ID NO: 650149 - DNA, 25 bp, Homo sapien
ccttacagttttgccagcactgggt

SEQ ID NO: 650150 - DNA, 25 bp, Homo sapien
tgccagcactgggtatttgttaata

SEQ ID NO: 650151 - DNA, 25 bp, Homo sapien
tgatgtattcatgtcctctaaccac

SEQ ID NO: 650152 - DNA, 25 bp, Homo sapien
attcatgtcctctaaccacttattt

SEQ ID NO: 650153 - DNA, 25 bp, Homo sapien
gcccctgcaaccatggcactagtga

SEQ ID NO: 650154 - DNA, 25 bp, Homo sapien
ctgcaaccatggcactagtgatcct

SEQ ID NO: 650155 - DNA, 25 bp, Homo sapien
tgcaaccatggcactagtgatcctc

SEQ ID NO: 650156 - DNA, 25 bp, Homo sapien
aaccatggcactagtgatcctccag

SEQ ID NO: 650157 - DNA, 25 bp, Homo sapien
catggcactagtgatcctccagaag

SEQ ID NO: 650158 - DNA, 25 bp, Homo sapien
atggcactagtgatcctccagaaga

SEQ ID NO: 650159 - DNA, 25 bp, Homo sapien
ggcactagtgatcctccagaagagc

SEQ ID NO: 650160 - DNA, 25 bp, Homo sapien
gcactagtgatcctccagaagagct

SEQ ID NO: 650161 - DNA, 25 bp, Homo sapien
actagtgatcctccagaagagctgg

SEQ ID NO: 650162 - DNA, 25 bp, Homo sapien
ggaactacagagaggacatcttgct

SEQ ID NO: 650163 - DNA, 25 bp, Homo sapien
actacagagaggacatcttgctgtg

SEQ ID NO: 650164 - DNA, 25 bp, Homo sapien
atttttttcatattgattgcatgtt

SEQ ID NO: 650165 - DNA, 25 bp, Homo sapien
ttatcctcattttgccattgtttaa

SEQ ID NO: 650166 - DNA, 25 bp, Homo sapien
attacataggacagcatgtctcgac

SEQ ID NO: 650167 - DNA, 25 bp, Homo sapien
tacataggacagcatgtctcgactt

SEQ ID NO: 650168 - DNA, 25 bp, Homo sapien
cataggacagcatgtctcgacttcc

SEQ ID NO: 650169 - DNA, 25 bp, Homo sapien
acagcatgtctcgacttcctgagga

SEQ ID NO: 650170 - DNA, 25 bp, Homo sapien
agcatgtctcgacttcctgaggaat

SEQ ID NO: 650171 - DNA, 25 bp, Homo sapien
gcatgtctcgacttcctgaggaata

SEQ ID NO: 650172 - DNA, 25 bp, Homo sapien
catgtctcgacttcctgaggaatat

SEQ ID NO: 650173 - DNA, 25 bp, Homo sapien
tgtctcgacttcctgaggaatatct

SEQ ID NO: 650174 - DNA, 25 bp, Homo sapien
cctgaggaatatctgaaagcatata

SEQ ID NO: 650175 - DNA, 25 bp, Homo sapien
ggagttattttctagagttaacctg

SEQ ID NO: 650176 - DNA, 25 bp, Homo sapien
ttattttctagagttaacctgaagc

SEQ ID NO: 650177 - DNA, 25 bp, Homo sapien
attttctagagttaacctgaagcag

SEQ ID NO: 650178 - DNA, 25 bp, Homo sapien
ttttctagagttaacctgaagcagt

SEQ ID NO: 650179 - DNA, 25 bp, Homo sapien
ttctagagttaacctgaagcagtgg

SEQ ID NO: 650180 - DNA, 25 bp, Homo sapien
ctagagttaacctgaagcagtggcc

SEQ ID NO: 650181 - DNA, 25 bp, Homo sapien
tagagttaacctgaagcagtggccg

SEQ ID NO: 650182 - DNA, 25 bp, Homo sapien
gaagcagtggccgagtgccatgcac

SEQ ID NO: 650183 - DNA, 25 bp, Homo sapien
aagcagtggccgagtgccatgcaca

SEQ ID NO: 650184 - DNA, 25 bp, Homo sapien
gcagtggccgagtgccatgcacacg

SEQ ID NO: 650185 - DNA, 25 bp, Homo sapien
cagtggccgagtgccatgcacacgt

SEQ ID NO: 650186 - DNA, 25 bp, Homo sapien
gtacagatgcaatagctggagccac

SEQ ID NO: 650187 - DNA, 25 bp, Homo sapien
agatgcaatagctggagccacagaa

SEQ ID NO: 650188 - DNA, 25 bp, Homo sapien
gaagccatattgtgaccatcaggca

SEQ ID NO: 650189 - DNA, 25 bp, Homo sapien
attgtgaccatcaggcaccttgaac

SEQ ID NO: 650190 - DNA, 25 bp, Homo sapien
gcaccttgaacttgctggcctcgtg

SEQ ID NO: 650191 - DNA, 25 bp, Homo sapien
gctggcctcgtgctaaggctcttag

SEQ ID NO: 650192 - DNA, 25 bp, Homo sapien
ctcgtgctaaggctcttagcgcaga

SEQ ID NO: 650193 - DNA, 25 bp, Homo sapien
cttagcgcagaagagtccggatatt

SEQ ID NO: 650194 - DNA, 25 bp, Homo sapien
gaagagtccggatatttcctgatta

SEQ ID NO: 650195 - DNA, 25 bp, Homo sapien
ggatatttcctgattactctgacac

SEQ ID NO: 650196 - DNA, 25 bp, Homo sapien
atttcctgattactctgacacaaga

SEQ ID NO: 650197 - DNA, 25 bp, Homo sapien
ttcaatttcacccttcatatacttc

SEQ ID NO: 650198 - DNA, 25 bp, Homo sapien
tcaatttcacccttcatatacttcc

SEQ ID NO: 650199 - DNA, 25 bp, Homo sapien
caatttcacccttcatatacttcca

SEQ ID NO: 650200 - DNA, 25 bp, Homo sapien
aatttcacccttcatatacttccac

SEQ ID NO: 650201 - DNA, 25 bp, Homo sapien
atttcacccttcatatacttccacc

SEQ ID NO: 650202 - DNA, 25 bp, Homo sapien
cttcatatacttccacccggcttgg

SEQ ID NO: 650203 - DNA, 25 bp, Homo sapien
ttcatatacttccacccggcttggc

SEQ ID NO: 650204 - DNA, 25 bp, Homo sapien
tcatatacttccacccggcttggcg

SEQ ID NO: 650205 - DNA, 25 bp, Homo sapien
atatacttccacccggcttggcgca

SEQ ID NO: 650206 - DNA, 25 bp, Homo sapien
acttccacccggcttggcgcagtgg

SEQ ID NO: 650207 - DNA, 25 bp, Homo sapien
ttccacccggcttggcgcagtggct

SEQ ID NO: 650208 - DNA, 25 bp, Homo sapien
caaatatccaaaccgtatcagggct

SEQ ID NO: 650209 - DNA, 25 bp, Homo sapien
atccaaaccgtatcagggctacaat

SEQ ID NO: 650210 - DNA, 25 bp, Homo sapien
caaaccgtatcagggctacaatttt

SEQ ID NO: 650211 - DNA, 25 bp, Homo sapien
tcagggctacaatttttttcctata

SEQ ID NO: 650212 - DNA, 25 bp, Homo sapien
tcctataaaaatacttcaccaacat

SEQ ID NO: 650213 - DNA, 25 bp, Homo sapien
atacttcaccaacatttaagagaaa

SEQ ID NO: 650214 - DNA, 25 bp, Homo sapien
ccaacatttaagagaaagtcaggtg

SEQ ID NO: 650215 - DNA, 25 bp, Homo sapien
acatgtatatactatgtacctgcaa

SEQ ID NO: 650216 - DNA, 25 bp, Homo sapien
gtatatactatgtacctgcaaacaa

SEQ ID NO: 650217 - DNA, 25 bp, Homo sapien
gtacctgcaaacaaaatgcataatg

SEQ ID NO: 650218 - DNA, 25 bp, Homo sapien
ataatgttggtaatgcttctgtaca

SEQ ID NO: 650219 - DNA, 25 bp, Homo sapien
ggtcacaatcttccataattccatc

SEQ ID NO: 650220 - DNA, 25 bp, Homo sapien
cataattccatcactcttaccaatt

SEQ ID NO: 650221 - DNA, 25 bp, Homo sapien
atcactcttaccaattacctgaagt

SEQ ID NO: 650222 - DNA, 25 bp, Homo sapien
cctgctgcagagaggtaagctctgt

SEQ ID NO: 650223 - DNA, 25 bp, Homo sapien
aggtaagctctgttcagaatttgct

SEQ ID NO: 650224 - DNA, 25 bp, Homo sapien
gctttgtgtcctggattttttccta

SEQ ID NO: 650225 - DNA, 25 bp, Homo sapien
ggattttttcctatgctcacagaga

SEQ ID NO: 650226 - DNA, 25 bp, Homo sapien
tttcctatgctcacagagacaggat

SEQ ID NO: 650227 - DNA, 25 bp, Homo sapien
gacaggattagctggcggtcttgct

SEQ ID NO: 650228 - DNA, 25 bp, Homo sapien
tggcggtcttgctttgtgtgctatc

SEQ ID NO: 650229 - DNA, 25 bp, Homo sapien
gctttgtgtgctatctttctagaca

SEQ ID NO: 650230 - DNA, 25 bp, Homo sapien
gggtttgaggtatatattctttcat

SEQ ID NO: 650231 - DNA, 25 bp, Homo sapien
tattctttcatgttttgcagtgaag

SEQ ID NO: 650232 - DNA, 25 bp, Homo sapien
gaaggtgtgtttttcttccaatagt

SEQ ID NO: 650233 - DNA, 25 bp, Homo sapien
acattttctttcattggaagttcat

SEQ ID NO: 650234 - DNA, 25 bp, Homo sapien
ggaagttcatcactgttaggcgtta

SEQ ID NO: 650235 - DNA, 25 bp, Homo sapien
ctgttaggcgttatcttgagtatta

SEQ ID NO: 650236 - DNA, 25 bp, Homo sapien
aaattcctgcgatactttgttgtca

SEQ ID NO: 650237 - DNA, 25 bp, Homo sapien
ttgttgtcaaacacttgccactgat

SEQ ID NO: 650238 - DNA, 25 bp, Homo sapien
acacttgccactgatagacgttatt

SEQ ID NO: 650239 - DNA, 25 bp, Homo sapien
gccactgatagacgttattttagct

SEQ ID NO: 650240 - DNA, 25 bp, Homo sapien
tttagcttttaaggcctgtcacatt

SEQ ID NO: 650241 - DNA, 25 bp, Homo sapien
gtaattctggaatcaaagactattg

SEQ ID NO: 650242 - DNA, 25 bp, Homo sapien
aagactattggatacatttggcatt

SEQ ID NO: 650243 - DNA, 25 bp, Homo sapien
ttggatacatttggcattgggctga

SEQ ID NO: 650244 - DNA, 25 bp, Homo sapien
aattaaccatgcgtggtggtacacg

SEQ ID NO: 650245 - DNA, 25 bp, Homo sapien
taaccatgcgtggtggtacacgtct

SEQ ID NO: 650246 - DNA, 25 bp, Homo sapien
catgcgtggtggtacacgtctgtca

SEQ ID NO: 650247 - DNA, 25 bp, Homo sapien
tgcgtggtggtacacgtctgtcatc

SEQ ID NO: 650248 - DNA, 25 bp, Homo sapien
tctgtcatcccagcagctcttaagg

SEQ ID NO: 650249 - DNA, 25 bp, Homo sapien
tcatcccagcagctcttaaggctga

SEQ ID NO: 650250 - DNA, 25 bp, Homo sapien
cccagcagctcttaaggctgaggca

SEQ ID NO: 650251 - DNA, 25 bp, Homo sapien
gaggctgtagttagccaagatagca

SEQ ID NO: 650252 - DNA, 25 bp, Homo sapien
ttaaaaacttgctttgagactgggc

SEQ ID NO: 650253 - DNA, 25 bp, Homo sapien
taaaaacttgctttgagactgggca

SEQ ID NO: 650254 - DNA, 25 bp, Homo sapien
aaaaacttgctttgagactgggcac

SEQ ID NO: 650255 - DNA, 25 bp, Homo sapien
aaaacttgctttgagactgggcacg

SEQ ID NO: 650256 - DNA, 25 bp, Homo sapien
aaacttgctttgagactgggcacgg

SEQ ID NO: 650257 - DNA, 25 bp, Homo sapien
aacttgctttgagactgggcacggt

SEQ ID NO: 650258 - DNA, 25 bp, Homo sapien
acttgctttgagactgggcacggtg

SEQ ID NO: 650259 - DNA, 25 bp, Homo sapien
ccctgtctctattaataacacaaaa

SEQ ID NO: 650260 - DNA, 25 bp, Homo sapien
gttagctgagatcgcagcattgcat

SEQ ID NO: 650261 - DNA, 25 bp, Homo sapien
ttagctgagatcgcagcattgcatt

SEQ ID NO: 650262 - DNA, 25 bp, Homo sapien
tagctgagatcgcagcattgcattc

SEQ ID NO: 650263 - DNA, 25 bp, Homo sapien
gctgagaatattcatgcacaagttt

SEQ ID NO: 650264 - DNA, 25 bp, Homo sapien
gtgaatatgttttagttctcttggg

SEQ ID NO: 650265 - DNA, 25 bp, Homo sapien
attagaagggtggtttgctgtgtca

SEQ ID NO: 650266 - DNA, 25 bp, Homo sapien
gtttgctgtgtcagatagtaactct

SEQ ID NO: 650267 - DNA, 25 bp, Homo sapien
gctgtgtcagatagtaactctgtgt

SEQ ID NO: 650268 - DNA, 25 bp, Homo sapien
taactttttgagaccctttcctcat

SEQ ID NO: 650269 - DNA, 25 bp, Homo sapien
gtatagtatgtatctctgtaagcca

SEQ ID NO: 650270 - DNA, 25 bp, Homo sapien
gtatgtatctctgtaagccactaca

SEQ ID NO: 650271 - DNA, 25 bp, Homo sapien
gtaagccactacagattcctctttt

SEQ ID NO: 650272 - DNA, 25 bp, Homo sapien
agccactacagattcctctttttgg

SEQ ID NO: 650273 - DNA, 25 bp, Homo sapien
attcctctttttggaatgaggtggc

SEQ ID NO: 650274 - DNA, 25 bp, Homo sapien
ggctcttcttggcatgcaaatgaac

SEQ ID NO: 650275 - DNA, 25 bp, Homo sapien
aacgtgtgtgtctctgagtgcatgt

SEQ ID NO: 650276 - DNA, 25 bp, Homo sapien
gtgtgtctctgagtgcatgtgtctg

SEQ ID NO: 650277 - DNA, 25 bp, Homo sapien
gtgtgtgtacacacgtccctttgaa

SEQ ID NO: 650278 - DNA, 25 bp, Homo sapien
gtacacacgtccctttgaagtttat

SEQ ID NO: 650279 - DNA, 25 bp, Homo sapien
gaagtttatttacttggtagcacta

SEQ ID NO: 650280 - DNA, 25 bp, Homo sapien
actaattgtaaaagggcacacccag

SEQ ID NO: 650281 - DNA, 25 bp, Homo sapien
gggaatttaatgaggcgacatgcta

SEQ ID NO: 650282 - DNA, 25 bp, Homo sapien
gaggcgacatgctagaatatagaca

SEQ ID NO: 650283 - DNA, 25 bp, Homo sapien
tattttcctcataatagcaagtagg

SEQ ID NO: 650284 - DNA, 25 bp, Homo sapien
aggaacaggttttgatgatcgtaga

SEQ ID NO: 650285 - DNA, 25 bp, Homo sapien
gaatttggcacaagggatacgtttt

SEQ ID NO: 650286 - DNA, 25 bp, Homo sapien
gatacgtttttaggccctgagtgga

SEQ ID NO: 650287 - DNA, 25 bp, Homo sapien
ccctgagtggaggatctgggtttca

SEQ ID NO: 650288 - DNA, 25 bp, Homo sapien
gatctgggtttcaaactggactttt

SEQ ID NO: 650289 - DNA, 25 bp, Homo sapien
actcttattgtagaagggcctgcgg

SEQ ID NO: 650290 - DNA, 25 bp, Homo sapien
ggcctgcgggtttgttttaatcact

SEQ ID NO: 650291 - DNA, 25 bp, Homo sapien
tcaaagctacgctaggcattcgcag

SEQ ID NO: 650292 - DNA, 25 bp, Homo sapien
acgctaggcattcgcagctcaggat

SEQ ID NO: 650293 - DNA, 25 bp, Homo sapien
tcaggatccccagtttagcctaata

SEQ ID NO: 650294 - DNA, 25 bp, Homo sapien
gataatttgattgtgtctgagacga

SEQ ID NO: 650295 - DNA, 25 bp, Homo sapien
gaagctcggcttaaatacaaacagt

SEQ ID NO: 650296 - DNA, 25 bp, Homo sapien
aagtgtttgaccaaagtaggtctgc

SEQ ID NO: 650297 - DNA, 25 bp, Homo sapien
accaaagtaggtctgcagctatttc

SEQ ID NO: 650298 - DNA, 25 bp, Homo sapien
aagtaggtctgcagctatttcaact

SEQ ID NO: 650299 - DNA, 25 bp, Homo sapien
gtaggtctgcagctatttcaacttc

SEQ ID NO: 650300 - DNA, 25 bp, Homo sapien
ggtctgcagctatttcaacttcctt

SEQ ID NO: 650301 - DNA, 25 bp, Homo sapien
tgcagctatttcaacttccttccgt

SEQ ID NO: 650302 - DNA, 25 bp, Homo sapien
tatttcaacttccttccgtttccag

SEQ ID NO: 650303 - DNA, 25 bp, Homo sapien
ctggaaattaagaacttgctgctgt

SEQ ID NO: 650304 - DNA, 25 bp, Homo sapien
ttaagaacttgctgctgttttaata

SEQ ID NO: 650305 - DNA, 25 bp, Homo sapien
ttctgactacaggagataaaatttc

SEQ ID NO: 650306 - DNA, 25 bp, Homo sapien
gataaaatttcagtcaaaaaaccat

SEQ ID NO: 650307 - DNA, 25 bp, Homo sapien
gtgcccagcctatttctaaataaga

SEQ ID NO: 650308 - DNA, 25 bp, Homo sapien
gcccagcctatttctaaataagaat

SEQ ID NO: 650309 - DNA, 25 bp, Homo sapien
gaatttacttgggttctattaatag

SEQ ID NO: 650310 - DNA, 25 bp, Homo sapien
aagcaacaacaaatccaacctaaat

SEQ ID NO: 650311 - DNA, 25 bp, Homo sapien
agcaacaacaaatccaacctaaatg

SEQ ID NO: 650312 - DNA, 25 bp, Homo sapien
gcaacaacaaatccaacctaaatgt

SEQ ID NO: 650313 - DNA, 25 bp, Homo sapien
caacaacaaatccaacctaaatgtt

SEQ ID NO: 650314 - DNA, 25 bp, Homo sapien
acaacaaatccaacctaaatgtttg

SEQ ID NO: 650315 - DNA, 25 bp, Homo sapien
caacaaatccaacctaaatgtttga

SEQ ID NO: 650316 - DNA, 25 bp, Homo sapien
acaaatccaacctaaatgtttgact

SEQ ID NO: 650317 - DNA, 25 bp, Homo sapien
caaatccaacctaaatgtttgactt

SEQ ID NO: 650318 - DNA, 25 bp, Homo sapien
ctccttgaggatgaaagacaggtac

SEQ ID NO: 650319 - DNA, 25 bp, Homo sapien
gaaagacaggtacagaggcatgaat

SEQ ID NO: 650320 - DNA, 25 bp, Homo sapien
gtgactattgcaaattcgagtacta

SEQ ID NO: 650321 - DNA, 25 bp, Homo sapien
gtgatttcactatttggaaaatgta

SEQ ID NO: 650322 - DNA, 25 bp, Homo sapien
gttacactgagttacagacctggtc

SEQ ID NO: 650323 - DNA, 25 bp, Homo sapien
cagacctggtctcaaagcttcaatt

SEQ ID NO: 650324 - DNA, 25 bp, Homo sapien
tggtctcaaagcttcaattacagta

SEQ ID NO: 650325 - DNA, 25 bp, Homo sapien
tcaaagcttcaattacagtaaccgt

SEQ ID NO: 650326 - DNA, 25 bp, Homo sapien
tttacccctctcaagtgagtttttg

SEQ ID NO: 650327 - DNA, 25 bp, Homo sapien
cctctcaagtgagtttttgcagact

SEQ ID NO: 650328 - DNA, 25 bp, Homo sapien
gtgagtttttgcagactaacagata

SEQ ID NO: 650329 - DNA, 25 bp, Homo sapien
agagaaggcatcatactgggatctt

SEQ ID NO: 650330 - DNA, 25 bp, Homo sapien
gaaggcatcatactgggatcttttt

SEQ ID NO: 650331 - DNA, 25 bp, Homo sapien
aggcatcatactgggatcttttttc

SEQ ID NO: 650332 - DNA, 25 bp, Homo sapien
gggatcttttttcacatccagccca

SEQ ID NO: 650333 - DNA, 25 bp, Homo sapien
gatcttttttcacatccagcccatg

SEQ ID NO: 650334 - DNA, 25 bp, Homo sapien
ttttttcacatccagcccatgcgga

SEQ ID NO: 650335 - DNA, 25 bp, Homo sapien
tcacatccagcccatgcggactgag

SEQ ID NO: 650336 - DNA, 25 bp, Homo sapien
agcccatgcggactgagcagccaaa

SEQ ID NO: 650337 - DNA, 25 bp, Homo sapien
catgcggactgagcagccaaagctt

SEQ ID NO: 650338 - DNA, 25 bp, Homo sapien
gcggactgagcagccaaagcttgac

SEQ ID NO: 650339 - DNA, 25 bp, Homo sapien
gactgagcagccaaagcttgacaga

SEQ ID NO: 650340 - DNA, 25 bp, Homo sapien
aaaagatgacatttacgttagtagg

SEQ ID NO: 650341 - DNA, 25 bp, Homo sapien
gaaggatggcctgtccagtaaataa

SEQ ID NO: 650342 - DNA, 25 bp, Homo sapien
catgtaagtgaatcttttgtggatt

SEQ ID NO: 650343 - DNA, 25 bp, Homo sapien
gtaagtgcagatattcataacattg

SEQ ID NO: 650344 - DNA, 25 bp, Homo sapien
gcagatattcataacattgagatgt

SEQ ID NO: 650345 - DNA, 25 bp, Homo sapien
gatgttgaagactttcaagacggca

SEQ ID NO: 650346 - DNA, 25 bp, Homo sapien
tgaagactttcaagacggcaacagt

SEQ ID NO: 650347 - DNA, 25 bp, Homo sapien
ttcaagacggcaacagtcaaatcat

SEQ ID NO: 650348 - DNA, 25 bp, Homo sapien
cggcaacagtcaaatcataaaggat

SEQ ID NO: 650349 - DNA, 25 bp, Homo sapien
aaacacgattttatgattccacgga

SEQ ID NO: 650350 - DNA, 25 bp, Homo sapien
cacgattttatgattccacggaaaa

SEQ ID NO: 650351 - DNA, 25 bp, Homo sapien
cttttgcttagcttttgttacaaga

SEQ ID NO: 650352 - DNA, 25 bp, Homo sapien
gcttttgttacaagatcactatggg

SEQ ID NO: 650353 - DNA, 25 bp, Homo sapien
gatcactatgggtatattcatgaag

SEQ ID NO: 650354 - DNA, 25 bp, Homo sapien
gaggttcaatgtaatctccaactct

SEQ ID NO: 650355 - DNA, 25 bp, Homo sapien
atctccaactcttaaaccctgagtg

SEQ ID NO: 650356 - DNA, 25 bp, Homo sapien
ctcttaaaccctgagtgcagcaagg

SEQ ID NO: 650357 - DNA, 25 bp, Homo sapien
tgcagcaagggagaactaaactagt

SEQ ID NO: 650358 - DNA, 25 bp, Homo sapien
gaaaactggactagagccttcccac

SEQ ID NO: 650359 - DNA, 25 bp, Homo sapien
tagagccttcccacattgtctgtct

SEQ ID NO: 650360 - DNA, 25 bp, Homo sapien
cattgtctgtctgtgctaggaaaac

SEQ ID NO: 650361 - DNA, 25 bp, Homo sapien
agagaagccaacagatgtgtttatt

SEQ ID NO: 650362 - DNA, 25 bp, Homo sapien
cccacttcctatacagcttgcagaa

SEQ ID NO: 650363 - DNA, 25 bp, Homo sapien
tctttataaagacagactcaggcat

SEQ ID NO: 650364 - DNA, 25 bp, Homo sapien
gtatcagtgcacaaacagcctcata

SEQ ID NO: 650365 - DNA, 25 bp, Homo sapien
aaacagcctcatacactgggcatac

SEQ ID NO: 650366 - DNA, 25 bp, Homo sapien
ctgggcatacgtgttatatcctgct

SEQ ID NO: 650367 - DNA, 25 bp, Homo sapien
atacgtgttatatcctgctttcctt

SEQ ID NO: 650368 - DNA, 25 bp, Homo sapien
tatatcctgctttccttcaatttac

SEQ ID NO: 650369 - DNA, 25 bp, Homo sapien
ctgctttccttcaatttactattag

SEQ ID NO: 650370 - DNA, 25 bp, Homo sapien
tactattagcgtttttatgtcacaa

SEQ ID NO: 650371 - DNA, 25 bp, Homo sapien
tttatgtcacaaactattcctcaaa

SEQ ID NO: 650372 - DNA, 25 bp, Homo sapien
acttattctgtagttaaccatccac

SEQ ID NO: 650373 - DNA, 25 bp, Homo sapien
tgtgcagttttcaggtaaatatccc

SEQ ID NO: 650374 - DNA, 25 bp, Homo sapien
gttttcaggtaaatatccctattca

SEQ ID NO: 650375 - DNA, 25 bp, Homo sapien
ggtaaatatccctattcattccaac

SEQ ID NO: 650376 - DNA, 25 bp, Homo sapien
aatatccctattcattccaacattg

SEQ ID NO: 650377 - DNA, 25 bp, Homo sapien
atccctattcattccaacattgact

SEQ ID NO: 650378 - DNA, 25 bp, Homo sapien
aacattgactacctcctctgtgcca

SEQ ID NO: 650379 - DNA, 25 bp, Homo sapien
aggcctgtgggctagttggtatcta

SEQ ID NO: 650380 - DNA, 25 bp, Homo sapien
cctgtgggctagttggtatctatca

SEQ ID NO: 650381 - DNA, 25 bp, Homo sapien
tgggctagttggtatctatcaggaa

SEQ ID NO: 650382 - DNA, 25 bp, Homo sapien
ctagttggtatctatcaggaaacaa

SEQ ID NO: 650383 - DNA, 25 bp, Homo sapien
aaacaaatgggagatgccttcacct

SEQ ID NO: 650384 - DNA, 25 bp, Homo sapien
caaagcactgtgttagatactgttt

SEQ ID NO: 650385 - DNA, 25 bp, Homo sapien
tagatactgtttaaggatcccttta

SEQ ID NO: 650386 - DNA, 25 bp, Homo sapien
gatccctttacagttatctgattag

SEQ ID NO: 650387 - DNA, 25 bp, Homo sapien
atctgattaggacactttcttgtag

SEQ ID NO: 650388 - DNA, 25 bp, Homo sapien
caatcttattagtaggagtgcctct

SEQ ID NO: 650389 - DNA, 25 bp, Homo sapien
tagtaggagtgcctctttaatgtct

SEQ ID NO: 650390 - DNA, 25 bp, Homo sapien
ctggaggaagttttgttgctaagct

SEQ ID NO: 650391 - DNA, 25 bp, Homo sapien
agcttttaacagcttgttgccttta

SEQ ID NO: 650392 - DNA, 25 bp, Homo sapien
cttgttgcctttacccacatataga

SEQ ID NO: 650393 - DNA, 25 bp, Homo sapien
aagtacttgggttggctaggcttca

SEQ ID NO: 650394 - DNA, 25 bp, Homo sapien
gctaggcttcatgcttcaacacaga

SEQ ID NO: 650395 - DNA, 25 bp, Homo sapien
actggagtgtgcgggccctagtgca

SEQ ID NO: 650396 - DNA, 25 bp, Homo sapien
gagtgtgcgggccctagtgcagcag

SEQ ID NO: 650397 - DNA, 25 bp, Homo sapien
gaagggcaacaaaggtccccgtctg

SEQ ID NO: 650398 - DNA, 25 bp, Homo sapien
gggcaacaaaggtccccgtctgaat

SEQ ID NO: 650399 - DNA, 25 bp, Homo sapien
ggcaacaaaggtccccgtctgaatc

SEQ ID NO: 650400 - DNA, 25 bp, Homo sapien
gcaacaaaggtccccgtctgaatcc

SEQ ID NO: 650401 - DNA, 25 bp, Homo sapien
caaaggtccccgtctgaatccagct

SEQ ID NO: 650402 - DNA, 25 bp, Homo sapien
aaaggtccccgtctgaatccagctg

SEQ ID NO: 650403 - DNA, 25 bp, Homo sapien
aaggtccccgtctgaatccagctgc

SEQ ID NO: 650404 - DNA, 25 bp, Homo sapien
aggtccccgtctgaatccagctgct

SEQ ID NO: 650405 - DNA, 25 bp, Homo sapien
cccgtctgaatccagctgctccagc

SEQ ID NO: 650406 - DNA, 25 bp, Homo sapien
gaatcacatataaaggtgctgtcaa

SEQ ID NO: 650407 - DNA, 25 bp, Homo sapien
ataaaggtgctgtcaagaaatctgg

SEQ ID NO: 650408 - DNA, 25 bp, Homo sapien
aagaaatctggttgaaggctggaca

SEQ ID NO: 650409 - DNA, 25 bp, Homo sapien
cttcaagaagagcttgggcaagact

SEQ ID NO: 650410 - DNA, 25 bp, Homo sapien
aagagcttgggcaagactgtagcca

SEQ ID NO: 650411 - DNA, 25 bp, Homo sapien
gagcttgggcaagactgtagccata

SEQ ID NO: 650412 - DNA, 25 bp, Homo sapien
gggcaagactgtagccatagccata

SEQ ID NO: 650413 - DNA, 25 bp, Homo sapien
aagactgtagccatagccatagcaa

SEQ ID NO: 650414 - DNA, 25 bp, Homo sapien
gactgtagccatagccatagcaaga

SEQ ID NO: 650415 - DNA, 25 bp, Homo sapien
gtagccatagccatagcaagaatct

SEQ ID NO: 650416 - DNA, 25 bp, Homo sapien
ccatagccatagcaagaatctgtct

SEQ ID NO: 650417 - DNA, 25 bp, Homo sapien
tccatgttgtcctccaaatgtgctg

SEQ ID NO: 650418 - DNA, 25 bp, Homo sapien
gttgtcctccaaatgtgctggctga

SEQ ID NO: 650419 - DNA, 25 bp, Homo sapien
gagcccagcgcctgaatcagaggga

SEQ ID NO: 650420 - DNA, 25 bp, Homo sapien
gcctgaatcagagggacctgggttt

SEQ ID NO: 650421 - DNA, 25 bp, Homo sapien
attgaacaccagctgtctgaccttg

SEQ ID NO: 650422 - DNA, 25 bp, Homo sapien
aacaccagctgtctgaccttgactg

SEQ ID NO: 650423 - DNA, 25 bp, Homo sapien
agctgtctgaccttgactgcgttcc

SEQ ID NO: 650424 - DNA, 25 bp, Homo sapien
ctgaccttgactgcgttcctttgct

SEQ ID NO: 650425 - DNA, 25 bp, Homo sapien
agaagctaccttgggattgcctcaa

SEQ ID NO: 650426 - DNA, 25 bp, Homo sapien
agctaccttgggattgcctcaagga

SEQ ID NO: 650427 - DNA, 25 bp, Homo sapien
cttaaacaatgagtggagggcctgg

SEQ ID NO: 650428 - DNA, 25 bp, Homo sapien
atcaaagtaggccaccctgatttgc

SEQ ID NO: 650429 - DNA, 25 bp, Homo sapien
ccaccctgatttgcactgtcaataa

SEQ ID NO: 650430 - DNA, 25 bp, Homo sapien
ctaggagattaacaccctttcatga

SEQ ID NO: 650431 - DNA, 25 bp, Homo sapien
tttcatgatgacctagctgttccct

SEQ ID NO: 650432 - DNA, 25 bp, Homo sapien
ctagctgttcccttgaaggtggtaa

SEQ ID NO: 650433 - DNA, 25 bp, Homo sapien
tggtaacacccagtcaggcccagga

SEQ ID NO: 650434 - DNA, 25 bp, Homo sapien
gggtgacactggaagctttcaaatc

SEQ ID NO: 650435 - DNA, 25 bp, Homo sapien
gctttcaaatctaaggagccacaga

SEQ ID NO: 650436 - DNA, 25 bp, Homo sapien
gccacagatctcttactcatttttt

SEQ ID NO: 650437 - DNA, 25 bp, Homo sapien
taatgtcagtagcattgctttccaa

SEQ ID NO: 650438 - DNA, 25 bp, Homo sapien
gtagcattgctttccaatccatatc

SEQ ID NO: 650439 - DNA, 25 bp, Homo sapien
tcagcgccgggatgagatgcttcga

SEQ ID NO: 650440 - DNA, 25 bp, Homo sapien
gccgggatgagatgcttcgaatgta

SEQ ID NO: 650441 - DNA, 25 bp, Homo sapien
gatgcttcgaatgtatcaagcactg

SEQ ID NO: 650442 - DNA, 25 bp, Homo sapien
agcactgaaagaagcccttgggata

SEQ ID NO: 650443 - DNA, 25 bp, Homo sapien
gaaagaagcccttgggataattggg

SEQ ID NO: 650444 - DNA, 25 bp, Homo sapien
cagtggatgactcctggatacagca

SEQ ID NO: 650445 - DNA, 25 bp, Homo sapien
ggatgactcctggatacagcactct

SEQ ID NO: 650446 - DNA, 25 bp, Homo sapien
tggatacagcactctcgcaggtcac

SEQ ID NO: 650447 - DNA, 25 bp, Homo sapien
caacccaaaggaggccaacactaag

SEQ ID NO: 650448 - DNA, 25 bp, Homo sapien
aaggaggccaacactaagtgctccc

SEQ ID NO: 650449 - DNA, 25 bp, Homo sapien
aacactaagtgctcccctcgcaagg

SEQ ID NO: 650450 - DNA, 25 bp, Homo sapien
caacgccgagctcaaggactactcg

SEQ ID NO: 650451 - DNA, 25 bp, Homo sapien
gagctcaaggactactcgggcctcc

SEQ ID NO: 650452 - DNA, 25 bp, Homo sapien
tccacgatgccgcagccgcgggtga

SEQ ID NO: 650453 - DNA, 25 bp, Homo sapien
agccgcgggtgacacactgcccgag

SEQ ID NO: 650454 - DNA, 25 bp, Homo sapien
tcagccaagctgagcctctcaactg

SEQ ID NO: 650455 - DNA, 25 bp, Homo sapien
gccaagctgagcctctcaactggtg

SEQ ID NO: 650456 - DNA, 25 bp, Homo sapien
aagctgagcctctcaactggtgtgg

SEQ ID NO: 650457 - DNA, 25 bp, Homo sapien
tggggaaatcctgtctttccaaaag

SEQ ID NO: 650458 - DNA, 25 bp, Homo sapien
tccaaaagtccaaggagcgcgggtc

SEQ ID NO: 650459 - DNA, 25 bp, Homo sapien
ccaaaagtccaaggagcgcgggtcg

SEQ ID NO: 650460 - DNA, 25 bp, Homo sapien
cgcgggtcggaggagacaaactctt

SEQ ID NO: 650461 - DNA, 25 bp, Homo sapien
atatatatctcttcgatttcccttt

SEQ ID NO: 650462 - DNA, 25 bp, Homo sapien
tatctcttcgatttccctttatatg

SEQ ID NO: 650463 - DNA, 25 bp, Homo sapien
tcgatttccctttatatgtatttat

SEQ ID NO: 650464 - DNA, 25 bp, Homo sapien
attgtaattgttgttagggtgcata

SEQ ID NO: 650465 - DNA, 25 bp, Homo sapien
ataattgttagtaagcaccactcag

SEQ ID NO: 650466 - DNA, 25 bp, Homo sapien
atgtatacagacagtgtgtgtgaaa

SEQ ID NO: 650467 - DNA, 25 bp, Homo sapien
aaatattcaaactgttaggactaga

SEQ ID NO: 650468 - DNA, 25 bp, Homo sapien
ggactagaaataggtacttgcaact

SEQ ID NO: 650469 - DNA, 25 bp, Homo sapien
ataggtacttgcaactacagaatca

SEQ ID NO: 650470 - DNA, 25 bp, Homo sapien
tacagaatcacagaattgctactac

SEQ ID NO: 650471 - DNA, 25 bp, Homo sapien
cagaattgctactacaacaccattt

SEQ ID NO: 650472 - DNA, 25 bp, Homo sapien
gtttataccactatgtccaattcca

SEQ ID NO: 650473 - DNA, 25 bp, Homo sapien
gtccaattccaagtaaacaccacag

SEQ ID NO: 650474 - DNA, 25 bp, Homo sapien
agtaaacaccacagagttatttcag

SEQ ID NO: 650475 - DNA, 25 bp, Homo sapien
ctgctcccattaacctcaatgtatg

SEQ ID NO: 650476 - DNA, 25 bp, Homo sapien
tgctgagttccctgtatgtaacaaa

SEQ ID NO: 650477 - DNA, 25 bp, Homo sapien
gtatgtaacaaatctcctggccaca

SEQ ID NO: 650478 - DNA, 25 bp, Homo sapien
gtaacaaatctcctggccacactgg

SEQ ID NO: 650479 - DNA, 25 bp, Homo sapien
actggcctcaaccatgtgcatcatc

SEQ ID NO: 650480 - DNA, 25 bp, Homo sapien
tggccctggttgagccctcagttga

SEQ ID NO: 650481 - DNA, 25 bp, Homo sapien
attacttttaaatcttgtctctggt

SEQ ID NO: 650482 - DNA, 25 bp, Homo sapien
taaatcttgtctctggttctaaaaa

SEQ ID NO: 650483 - DNA, 25 bp, Homo sapien
gtcaggagccactaagttgcttcac

SEQ ID NO: 650484 - DNA, 25 bp, Homo sapien
ctaagttgcttcactccttttttct

SEQ ID NO: 650485 - DNA, 25 bp, Homo sapien
tttctctaattttctaccttcctct

SEQ ID NO: 650486 - DNA, 25 bp, Homo sapien
tgttcctgcagacagttttgccagc

SEQ ID NO: 650487 - DNA, 25 bp, Homo sapien
tttgcttctggttactagggtctca

SEQ ID NO: 650488 - DNA, 25 bp, Homo sapien
tggttactagggtctcatgcgtgtc

SEQ ID NO: 650489 - DNA, 25 bp, Homo sapien
gtctcatgcgtgtcctgcttggaga

SEQ ID NO: 650490 - DNA, 25 bp, Homo sapien
gtcctgcttggagagccataaggaa

SEQ ID NO: 650491 - DNA, 25 bp, Homo sapien
aggaaattgctgtcttgtgctttgt

SEQ ID NO: 650492 - DNA, 25 bp, Homo sapien
ctgtcttgtgctttgtgtctctcat

SEQ ID NO: 650493 - DNA, 25 bp, Homo sapien
tccagtctctggctcttgggattct

SEQ ID NO: 650494 - DNA, 25 bp, Homo sapien
ccacaaggtaagctgatgcctccag

SEQ ID NO: 650495 - DNA, 25 bp, Homo sapien
agcttcctcagtagggctgatggca

SEQ ID NO: 650496 - DNA, 25 bp, Homo sapien
cagtagggctgatggcaattacgtt

SEQ ID NO: 650497 - DNA, 25 bp, Homo sapien
atggcaattacgttgtgcagctact

SEQ ID NO: 650498 - DNA, 25 bp, Homo sapien
ttacgttgtgcagctactggaaaga

SEQ ID NO: 650499 - DNA, 25 bp, Homo sapien
ttaattttacttccctattcaggca

SEQ ID NO: 650500 - DNA, 25 bp, Homo sapien
aattttacttccctattcaggcagg

SEQ ID NO: 650501 - DNA, 25 bp, Homo sapien
gagtggaatatgcaacctggcgtca

SEQ ID NO: 650502 - DNA, 25 bp, Homo sapien
gaatatgcaacctggcgtcatgggc

SEQ ID NO: 650503 - DNA, 25 bp, Homo sapien
gcgtcatgggccagctggttaaaat

SEQ ID NO: 650504 - DNA, 25 bp, Homo sapien
tgggccagctggttaaaataaaatt

SEQ ID NO: 650505 - DNA, 25 bp, Homo sapien
atcccactttatgcgtaatcaccaa

SEQ ID NO: 650506 - DNA, 25 bp, Homo sapien
atgtatttaggataagtcacacaaa

SEQ ID NO: 650507 - DNA, 25 bp, Homo sapien
caaaatagtgcttgtttctcaaatc

SEQ ID NO: 650508 - DNA, 25 bp, Homo sapien
gtttctcaaatcacgtgtcttctat

SEQ ID NO: 650509 - DNA, 25 bp, Homo sapien
tcacgtgtcttctatttgccacaat

SEQ ID NO: 650510 - DNA, 25 bp, Homo sapien
atttgccacaatagttacttgttat

SEQ ID NO: 650511 - DNA, 25 bp, Homo sapien
gtttcagagttttatgtatatccag

SEQ ID NO: 650512 - DNA, 25 bp, Homo sapien
acagtaccgtaattatgttgtagtt

SEQ ID NO: 650513 - DNA, 25 bp, Homo sapien
gttgtagttatgacaagctaacctt

SEQ ID NO: 650514 - DNA, 25 bp, Homo sapien
gctaaccttgaattggctttttaag

SEQ ID NO: 650515 - DNA, 25 bp, Homo sapien
agctcagttgtggaaaacacagtaa

SEQ ID NO: 650516 - DNA, 25 bp, Homo sapien
atcaagaatcctagctgggagctgt

SEQ ID NO: 650517 - DNA, 25 bp, Homo sapien
tcaagaatcctagctgggagctgtg

SEQ ID NO: 650518 - DNA, 25 bp, Homo sapien
aagaatcctagctgggagctgtggc

SEQ ID NO: 650519 - DNA, 25 bp, Homo sapien
agaatcctagctgggagctgtggct

SEQ ID NO: 650520 - DNA, 25 bp, Homo sapien
aatcctagctgggagctgtggctca

SEQ ID NO: 650521 - DNA, 25 bp, Homo sapien
atcctagctgggagctgtggctcat

SEQ ID NO: 650522 - DNA, 25 bp, Homo sapien
gtgaaaccccaaatatactaaatat

SEQ ID NO: 650523 - DNA, 25 bp, Homo sapien
tgaaaccccaaatatactaaatata

SEQ ID NO: 650524 - DNA, 25 bp, Homo sapien
aaccccaaatatactaaatatacag

SEQ ID NO: 650525 - DNA, 25 bp, Homo sapien
accccaaatatactaaatatacaga

SEQ ID NO: 650526 - DNA, 25 bp, Homo sapien
gggaggtgcagtttgcagcgagccg

SEQ ID NO: 650527 - DNA, 25 bp, Homo sapien
ggcagcacaagccagtcatgctgag

SEQ ID NO: 650528 - DNA, 25 bp, Homo sapien
gcacaagccagtcatgctgagctgc

SEQ ID NO: 650529 - DNA, 25 bp, Homo sapien
acaagccagtcatgctgagctgcct

SEQ ID NO: 650530 - DNA, 25 bp, Homo sapien
agccagtcatgctgagctgcctcca

SEQ ID NO: 650531 - DNA, 25 bp, Homo sapien
ctgagctgcctccagataatcctgg

SEQ ID NO: 650532 - DNA, 25 bp, Homo sapien
gagctgcctccagataatcctggct

SEQ ID NO: 650533 - DNA, 25 bp, Homo sapien
gcctccagataatcctggctccagg

SEQ ID NO: 650534 - DNA, 25 bp, Homo sapien
aggccagagcccgtgtctgccctca

SEQ ID NO: 650535 - DNA, 25 bp, Homo sapien
gatgtggttgtctgcttagccacat

SEQ ID NO: 650536 - DNA, 25 bp, Homo sapien
gtggttgtctgcttagccacatgcc

SEQ ID NO: 650537 - DNA, 25 bp, Homo sapien
gttgtctgcttagccacatgcctgt

SEQ ID NO: 650538 - DNA, 25 bp, Homo sapien
aagacatgcacacataaagatacgc

SEQ ID NO: 650539 - DNA, 25 bp, Homo sapien
gcacacataaagatacgcatagcat

SEQ ID NO: 650540 - DNA, 25 bp, Homo sapien
atacgcatagcatgattgagggctt

SEQ ID NO: 650541 - DNA, 25 bp, Homo sapien
attgagggcttggtgttttgtttct

SEQ ID NO: 650542 - DNA, 25 bp, Homo sapien
gagggcttggtgttttgtttctgta

SEQ ID NO: 650543 - DNA, 25 bp, Homo sapien
aacactggatttgaaacgaaactat

SEQ ID NO: 650544 - DNA, 25 bp, Homo sapien
taatgagaatgtatagcagggctgg

SEQ ID NO: 650545 - DNA, 25 bp, Homo sapien
gctgggcgaatgacaggcttgctta

SEQ ID NO: 650546 - DNA, 25 bp, Homo sapien
tgggcgaatgacaggcttgcttatg

SEQ ID NO: 650547 - DNA, 25 bp, Homo sapien
gcgaatgacaggcttgcttatgact

SEQ ID NO: 650548 - DNA, 25 bp, Homo sapien
gaatgacaggcttgcttatgactgg

SEQ ID NO: 650549 - DNA, 25 bp, Homo sapien
gatgcatgtaattttcagtaataaa

SEQ ID NO: 650550 - DNA, 25 bp, Homo sapien
attttaatatgactcttttctagcc

SEQ ID NO: 650551 - DNA, 25 bp, Homo sapien
ttaatatgactcttttctagccaaa

SEQ ID NO: 650552 - DNA, 25 bp, Homo sapien
aatatgactcttttctagccaaagc

SEQ ID NO: 650553 - DNA, 25 bp, Homo sapien
atgactcttttctagccaaagcatg

SEQ ID NO: 650554 - DNA, 25 bp, Homo sapien
gactcttttctagccaaagcatgtt

SEQ ID NO: 650555 - DNA, 25 bp, Homo sapien
ttttctagccaaagcatgtttcata

SEQ ID NO: 650556 - DNA, 25 bp, Homo sapien
ttctagccaaagcatgtttcatacc

SEQ ID NO: 650557 - DNA, 25 bp, Homo sapien
gccaaagcatgtttcataccaaaag

SEQ ID NO: 650558 - DNA, 25 bp, Homo sapien
caaagcatgtttcataccaaaagta

SEQ ID NO: 650559 - DNA, 25 bp, Homo sapien
aaagtagttaatttctcactcattt

SEQ ID NO: 650560 - DNA, 25 bp, Homo sapien
aattgggttttcaacagtcccagct

SEQ ID NO: 650561 - DNA, 25 bp, Homo sapien
gttttcaacagtcccagctttcact

SEQ ID NO: 650562 - DNA, 25 bp, Homo sapien
cagggtcccagtcagattccaggaa

SEQ ID NO: 650563 - DNA, 25 bp, Homo sapien
ggtcccagtcagattccaggaattt

SEQ ID NO: 650564 - DNA, 25 bp, Homo sapien
cagattccaggaatttgcgccctaa

SEQ ID NO: 650565 - DNA, 25 bp, Homo sapien
attccaggaatttgcgccctaactt

SEQ ID NO: 650566 - DNA, 25 bp, Homo sapien
ggaatttgcgccctaactttgcttg

SEQ ID NO: 650567 - DNA, 25 bp, Homo sapien
ttgcgccctaactttgcttgctaat

SEQ ID NO: 650568 - DNA, 25 bp, Homo sapien
aactttgcttgctaatcctggttta

SEQ ID NO: 650569 - DNA, 25 bp, Homo sapien
aatcctggtttagagctatcccact

SEQ ID NO: 650570 - DNA, 25 bp, Homo sapien
cttctcacaccctcaagaggagtta

SEQ ID NO: 650571 - DNA, 25 bp, Homo sapien
acacatgtcaaagtaaaactggatt

SEQ ID NO: 650572 - DNA, 25 bp, Homo sapien
aactggattttatgtagaggttaat

SEQ ID NO: 650573 - DNA, 25 bp, Homo sapien
aattttctcaagttgtgccatcctg

SEQ ID NO: 650574 - DNA, 25 bp, Homo sapien
tttctcaagttgtgccatcctgtat

SEQ ID NO: 650575 - DNA, 25 bp, Homo sapien
gccatcctgtattttaagtcagagt

SEQ ID NO: 650576 - DNA, 25 bp, Homo sapien
ttttgtttgcagttatagttagtaa

SEQ ID NO: 650577 - DNA, 25 bp, Homo sapien
agtaacatatctttgtaactagcaa

SEQ ID NO: 650578 - DNA, 25 bp, Homo sapien
ggaacagtatcataaacagctgttt

SEQ ID NO: 650579 - DNA, 25 bp, Homo sapien
aaacagctgtttcatttaaggataa

SEQ ID NO: 650580 - DNA, 25 bp, Homo sapien
gctgtttcatttaaggataatctaa

SEQ ID NO: 650581 - DNA, 25 bp, Homo sapien
gactcagattttaatatacacatgt

SEQ ID NO: 650582 - DNA, 25 bp, Homo sapien
gcctccaagggaggcagcttcacag

SEQ ID NO: 650583 - DNA, 25 bp, Homo sapien
gaggcccagggatgccccgtcagtt

SEQ ID NO: 650584 - DNA, 25 bp, Homo sapien
gtcagttgggcacctgtgtgaacct

SEQ ID NO: 650585 - DNA, 25 bp, Homo sapien
ggcacctgtgtgaacctgaaacctg

SEQ ID NO: 650586 - DNA, 25 bp, Homo sapien
tgtgtgaacctgaaacctgcccagc

SEQ ID NO: 650587 - DNA, 25 bp, Homo sapien
gggcattccttacttaaagcagaaa

SEQ ID NO: 650588 - DNA, 25 bp, Homo sapien
aacaaaatgacctgtgatggagccc

SEQ ID NO: 650589 - DNA, 25 bp, Homo sapien
agccccagctgtgtcaggctgcgtg

SEQ ID NO: 650590 - DNA, 25 bp, Homo sapien
ccagctgtgtcaggctgcgtgctga

SEQ ID NO: 650591 - DNA, 25 bp, Homo sapien
gctgcgtgctgagtgcagagacccc

SEQ ID NO: 650592 - DNA, 25 bp, Homo sapien
taccccattaaatcttcccaggcat

SEQ ID NO: 650593 - DNA, 25 bp, Homo sapien
aaaattaaaaattcggctgcgtgtg

SEQ ID NO: 650594 - DNA, 25 bp, Homo sapien
aaattaaaaattcggctgcgtgtgg

SEQ ID NO: 650595 - DNA, 25 bp, Homo sapien
ttaaaaattcggctgcgtgtggtgg

SEQ ID NO: 650596 - DNA, 25 bp, Homo sapien
gtacttccagctactaggcaaggct

SEQ ID NO: 650597 - DNA, 25 bp, Homo sapien
gagttcgaggctgcatgggccatga

SEQ ID NO: 650598 - DNA, 25 bp, Homo sapien
aactacaccaacacgtggccgggca

SEQ ID NO: 650599 - DNA, 25 bp, Homo sapien
tacaccaacacgtggccgggcatga

SEQ ID NO: 650600 - DNA, 25 bp, Homo sapien
acaccaacacgtggccgggcatgat

SEQ ID NO: 650601 - DNA, 25 bp, Homo sapien
ggcatgatggctcagtcccgtaacc

SEQ ID NO: 650602 - DNA, 25 bp, Homo sapien
gcatgatggctcagtcccgtaaccc

SEQ ID NO: 650603 - DNA, 25 bp, Homo sapien
tgatggctcagtcccgtaaccccag

SEQ ID NO: 650604 - DNA, 25 bp, Homo sapien
atgcctggcccaataattctttaat

SEQ ID NO: 650605 - DNA, 25 bp, Homo sapien
gcctggcccaataattctttaatat

SEQ ID NO: 650606 - DNA, 25 bp, Homo sapien
ggcccaataattctttaatatcttc

SEQ ID NO: 650607 - DNA, 25 bp, Homo sapien
tatcttcaaatacacaatgtttccg

SEQ ID NO: 650608 - DNA, 25 bp, Homo sapien
tacacaatgtttccgtttctttgct

SEQ ID NO: 650609 - DNA, 25 bp, Homo sapien
gtttcttgagaaacaatttgcataa

SEQ ID NO: 650610 - DNA, 25 bp, Homo sapien
gcataacatttactcttttaaactg

SEQ ID NO: 650611 - DNA, 25 bp, Homo sapien
attgagtgatttttagtactttcat

SEQ ID NO: 650612 - DNA, 25 bp, Homo sapien
gtactttcatgaacttgtgcaacca

SEQ ID NO: 650613 - DNA, 25 bp, Homo sapien
gaacttgtgcaaccatgaccataga

SEQ ID NO: 650614 - DNA, 25 bp, Homo sapien
aaccatgaccatagattgcagaaca

SEQ ID NO: 650615 - DNA, 25 bp, Homo sapien
gagactaaaatggtctctccatgtt

SEQ ID NO: 650616 - DNA, 25 bp, Homo sapien
agactaaaatggtctctccatgttg

SEQ ID NO: 650617 - DNA, 25 bp, Homo sapien
tgtgcccggccaatagaggttttta

SEQ ID NO: 650618 - DNA, 25 bp, Homo sapien
gatatttttgaaagatcctgtcttc

SEQ ID NO: 650619 - DNA, 25 bp, Homo sapien
atatttttgaaagatcctgtcttcc

SEQ ID NO: 650620 - DNA, 25 bp, Homo sapien
tatttttgaaagatcctgtcttcct

SEQ ID NO: 650621 - DNA, 25 bp, Homo sapien
atttttgaaagatcctgtcttcctt

SEQ ID NO: 650622 - DNA, 25 bp, Homo sapien
tttgaaagatcctgtcttcctttaa

SEQ ID NO: 650623 - DNA, 25 bp, Homo sapien
ttgaaagatcctgtcttcctttaag

SEQ ID NO: 650624 - DNA, 25 bp, Homo sapien
tgaaagatcctgtcttcctttaaga

SEQ ID NO: 650625 - DNA, 25 bp, Homo sapien
gaaagatcctgtcttcctttaagaa

SEQ ID NO: 650626 - DNA, 25 bp, Homo sapien
tatttctacaagaggcgaccattgg

SEQ ID NO: 650627 - DNA, 25 bp, Homo sapien
atttctacaagaggcgaccattggc

SEQ ID NO: 650628 - DNA, 25 bp, Homo sapien
tctacaagaggcgaccattggccaa

SEQ ID NO: 650629 - DNA, 25 bp, Homo sapien
tacaagaggcgaccattggccaacg

SEQ ID NO: 650630 - DNA, 25 bp, Homo sapien
aagaggcgaccattggccaacggac

SEQ ID NO: 650631 - DNA, 25 bp, Homo sapien
gaggcgaccattggccaacggactg

SEQ ID NO: 650632 - DNA, 25 bp, Homo sapien
gaccattggccaacggactggccat

SEQ ID NO: 650633 - DNA, 25 bp, Homo sapien
attggccaacggactggccatggca

SEQ ID NO: 650634 - DNA, 25 bp, Homo sapien
aacggactggccatggcaggcagcc

SEQ ID NO: 650635 - DNA, 25 bp, Homo sapien
acggactggccatggcaggcagccc

SEQ ID NO: 650636 - DNA, 25 bp, Homo sapien
aggcagccctgtgttcctctgtact

SEQ ID NO: 650637 - DNA, 25 bp, Homo sapien
tcagtttgtacctttctcacggcac

SEQ ID NO: 650638 - DNA, 25 bp, Homo sapien
ttgtacctttctcacggcacagcgt

SEQ ID NO: 650639 - DNA, 25 bp, Homo sapien
ggcacagcgtgtggcctgtctcata

SEQ ID NO: 650640 - DNA, 25 bp, Homo sapien
cctgtctcatattctagcgatctgt

SEQ ID NO: 650641 - DNA, 25 bp, Homo sapien
agcgatctgtttactaatcctgttc

SEQ ID NO: 650642 - DNA, 25 bp, Homo sapien
aatcctgttcttctaaccagattag

SEQ ID NO: 650643 - DNA, 25 bp, Homo sapien
aagtccttgaggcagaaacaaagtc

SEQ ID NO: 650644 - DNA, 25 bp, Homo sapien
aaagtctgcttcttctttgagccct

SEQ ID NO: 650645 - DNA, 25 bp, Homo sapien
acaggccaggcttggcaccggagtt

SEQ ID NO: 650646 - DNA, 25 bp, Homo sapien
gcttggcaccggagttcatgttcaa

SEQ ID NO: 650647 - DNA, 25 bp, Homo sapien
ggcaccggagttcatgttcaataaa

SEQ ID NO: 650648 - DNA, 25 bp, Homo sapien
aatgttttgaaactgccagatcagc

SEQ ID NO: 650649 - DNA, 25 bp, Homo sapien
gccagatcagctccaggacttgggt

SEQ ID NO: 650650 - DNA, 25 bp, Homo sapien
caggacttgggttaccaggaatcat

SEQ ID NO: 650651 - DNA, 25 bp, Homo sapien
gaactagggtctggaaagtcattaa

SEQ ID NO: 650652 - DNA, 25 bp, Homo sapien
aaatcagtactgctgtgttctgttt

SEQ ID NO: 650653 - DNA, 25 bp, Homo sapien
tcactttcaacagaggtgacccatt

SEQ ID NO: 650654 - DNA, 25 bp, Homo sapien
cagactgtggtttggatttgttcgt

SEQ ID NO: 650655 - DNA, 25 bp, Homo sapien
ggatttgttcgtcagatgtctacag

SEQ ID NO: 650656 - DNA, 25 bp, Homo sapien
atgtctacagttcgataggcagtct

SEQ ID NO: 650657 - DNA, 25 bp, Homo sapien
aggcagtctaaagcgtgcatcagaa

SEQ ID NO: 650658 - DNA, 25 bp, Homo sapien
gtttgcttcattttactggtacagt

SEQ ID NO: 650659 - DNA, 25 bp, Homo sapien
atggcaggtagtttggtctcaaact

SEQ ID NO: 650660 - DNA, 25 bp, Homo sapien
gtctcaaactgggaggtgccatctg

SEQ ID NO: 650661 - DNA, 25 bp, Homo sapien
ctgaggactcagtaactatagtcac

SEQ ID NO: 650662 - DNA, 25 bp, Homo sapien
cagggagctcctagagtaagggact

SEQ ID NO: 650663 - DNA, 25 bp, Homo sapien
gactgagataggtcccaaggaatag

SEQ ID NO: 650664 - DNA, 25 bp, Homo sapien
ggaagaatacctcaaaatcatacga

SEQ ID NO: 650665 - DNA, 25 bp, Homo sapien
atcatacgaggccactctttgacaa

SEQ ID NO: 650666 - DNA, 25 bp, Homo sapien
gaggccactctttgacaagtgtgcc

SEQ ID NO: 650667 - DNA, 25 bp, Homo sapien
tgacaagtgtgcctgtttcaccgtt

SEQ ID NO: 650668 - DNA, 25 bp, Homo sapien
tgtttcaccgttttgtttgcacaag

SEQ ID NO: 650669 - DNA, 25 bp, Homo sapien
gtttgcacaagactctaagacagta

SEQ ID NO: 650670 - DNA, 25 bp, Homo sapien
cactgctctctagcttggctgacag

SEQ ID NO: 650671 - DNA, 25 bp, Homo sapien
gctctctagcttggctgacagagtg

SEQ ID NO: 650672 - DNA, 25 bp, Homo sapien
tagatacacacttttaacttctaaa

SEQ ID NO: 650673 - DNA, 25 bp, Homo sapien
acacacttttaacttctaaatacag

SEQ ID NO: 650674 - DNA, 25 bp, Homo sapien
cacacttttaacttctaaatacaga

SEQ ID NO: 650675 - DNA, 25 bp, Homo sapien
acacttttaacttctaaatacagag

SEQ ID NO: 650676 - DNA, 25 bp, Homo sapien
cacttttaacttctaaatacagagg

SEQ ID NO: 650677 - DNA, 25 bp, Homo sapien
tttaacttctaaatacagaggtgtc

SEQ ID NO: 650678 - DNA, 25 bp, Homo sapien
cttctaaatacagaggtgtccaatc

SEQ ID NO: 650679 - DNA, 25 bp, Homo sapien
aaggattgttttgggccacatatag

SEQ ID NO: 650680 - DNA, 25 bp, Homo sapien
ggccacatatagaatacactaatac

SEQ ID NO: 650681 - DNA, 25 bp, Homo sapien
gagcctgggaggttggatgacagag

SEQ ID NO: 650682 - DNA, 25 bp, Homo sapien
agcctgggaggttggatgacagagt

SEQ ID NO: 650683 - DNA, 25 bp, Homo sapien
gcctgggaggttggatgacagagtt

SEQ ID NO: 650684 - DNA, 25 bp, Homo sapien
cctgggaggttggatgacagagtta

SEQ ID NO: 650685 - DNA, 25 bp, Homo sapien
ggaggttggatgacagagttagacc

SEQ ID NO: 650686 - DNA, 25 bp, Homo sapien
aaagagaaaatacctccctgagcct

SEQ ID NO: 650687 - DNA, 25 bp, Homo sapien
aagagaaaatacctccctgagcctg

SEQ ID NO: 650688 - DNA, 25 bp, Homo sapien
agagaaaatacctccctgagcctgg

SEQ ID NO: 650689 - DNA, 25 bp, Homo sapien
gagaaaatacctccctgagcctggg

SEQ ID NO: 650690 - DNA, 25 bp, Homo sapien
gaaaatacctccctgagcctgggag

SEQ ID NO: 650691 - DNA, 25 bp, Homo sapien
aaaatacctccctgagcctgggagg

SEQ ID NO: 650692 - DNA, 25 bp, Homo sapien
agattcggcctcagattctacagca

SEQ ID NO: 650693 - DNA, 25 bp, Homo sapien
attcggcctcagattctacagcatc

SEQ ID NO: 650694 - DNA, 25 bp, Homo sapien
tcggcctcagattctacagcatctg

SEQ ID NO: 650695 - DNA, 25 bp, Homo sapien
agattctacagcatctgactacatt

SEQ ID NO: 650696 - DNA, 25 bp, Homo sapien
ttctacagcatctgactacattccc

SEQ ID NO: 650697 - DNA, 25 bp, Homo sapien
tacagcatctgactacattcccagt

SEQ ID NO: 650698 - DNA, 25 bp, Homo sapien
cagcatctgactacattcccagtag

SEQ ID NO: 650699 - DNA, 25 bp, Homo sapien
gcatctgactacattcccagtaggt

SEQ ID NO: 650700 - DNA, 25 bp, Homo sapien
atctgactacattcccagtaggttg

SEQ ID NO: 650701 - DNA, 25 bp, Homo sapien
gactacattcccagtaggttgtgac

SEQ ID NO: 650702 - DNA, 25 bp, Homo sapien
ctacattcccagtaggttgtgacag

SEQ ID NO: 650703 - DNA, 25 bp, Homo sapien
aaactgctgccaaacttagaaactt

SEQ ID NO: 650704 - DNA, 25 bp, Homo sapien
aacttggttaaatatcctgcagaaa

SEQ ID NO: 650705 - DNA, 25 bp, Homo sapien
tcctgcagaaaatatcatgggcttt

SEQ ID NO: 650706 - DNA, 25 bp, Homo sapien
atgggcttttcagagtccagttaaa

SEQ ID NO: 650707 - DNA, 25 bp, Homo sapien
gagtccagttaaatatctacagatt

SEQ ID NO: 650708 - DNA, 25 bp, Homo sapien
gggcattaactctattcattttact

SEQ ID NO: 650709 - DNA, 25 bp, Homo sapien
gaattttacttctggagcataacat

SEQ ID NO: 650710 - DNA, 25 bp, Homo sapien
acttctggagcataacattgcattg

SEQ ID NO: 650711 - DNA, 25 bp, Homo sapien
aaatgtgtcctctaacctatgatat

SEQ ID NO: 650712 - DNA, 25 bp, Homo sapien
aaatttatgaggttccatttctgat

SEQ ID NO: 650713 - DNA, 25 bp, Homo sapien
caggatatttacattctttcatttc

SEQ ID NO: 650714 - DNA, 25 bp, Homo sapien
agacaagggcccctcgtgtgtccgc

SEQ ID NO: 650715 - DNA, 25 bp, Homo sapien
ccatctccacggacgagtgcagcat

SEQ ID NO: 650716 - DNA, 25 bp, Homo sapien
tccacggacgagtgcagcatccagg

SEQ ID NO: 650717 - DNA, 25 bp, Homo sapien
cggacgagtgcagcatccaggagct

SEQ ID NO: 650718 - DNA, 25 bp, Homo sapien
tgttggagagggagggcgccctcca

SEQ ID NO: 650719 - DNA, 25 bp, Homo sapien
ggagaaggagcttgcctccagcctg

SEQ ID NO: 650720 - DNA, 25 bp, Homo sapien
gagaaggagcttgcctccagcctgg

SEQ ID NO: 650721 - DNA, 25 bp, Homo sapien
cggcgctgcagggacgagctggagg

SEQ ID NO: 650722 - DNA, 25 bp, Homo sapien
ggcccggagcccaaaggcggcaaca

SEQ ID NO: 650723 - DNA, 25 bp, Homo sapien
gcccaaaggcggcaacaagctcaag

SEQ ID NO: 650724 - DNA, 25 bp, Homo sapien
tcctacgagagggagaagaccagct

SEQ ID NO: 650725 - DNA, 25 bp, Homo sapien
agcatcccttgctgctagatgtgac

SEQ ID NO: 650726 - DNA, 25 bp, Homo sapien
tcccttgctgctagatgtgaccatg

SEQ ID NO: 650727 - DNA, 25 bp, Homo sapien
gctgctagatgtgaccatgtgatca

SEQ ID NO: 650728 - DNA, 25 bp, Homo sapien
catgtgatcaagttctggccaatga

SEQ ID NO: 650729 - DNA, 25 bp, Homo sapien
tgccaggagaagtggtttggcccac

SEQ ID NO: 650730 - DNA, 25 bp, Homo sapien
gagaagtggtttggcccacttcctg

SEQ ID NO: 650731 - DNA, 25 bp, Homo sapien
cactgtgaggttgaagccgtgtgtt

SEQ ID NO: 650732 - DNA, 25 bp, Homo sapien
gaagccgtgtgttgagaatagcaga

SEQ ID NO: 650733 - DNA, 25 bp, Homo sapien
gagaatagcagagcaacaaagcaat

SEQ ID NO: 650734 - DNA, 25 bp, Homo sapien
ccagccctggactgcttagatttac

SEQ ID NO: 650735 - DNA, 25 bp, Homo sapien
cctggactgcttagatttacttgag

SEQ ID NO: 650736 - DNA, 25 bp, Homo sapien
cagcaaggtgggtagaaataggaac

SEQ ID NO: 650737 - DNA, 25 bp, Homo sapien
caaggtgggtagaaataggaactgt

SEQ ID NO: 650738 - DNA, 25 bp, Homo sapien
ggtgggtagaaataggaactgtcca

SEQ ID NO: 650739 - DNA, 25 bp, Homo sapien
gtgggtagaaataggaactgtccaa

SEQ ID NO: 650740 - DNA, 25 bp, Homo sapien
tgggtagaaataggaactgtccaat

SEQ ID NO: 650741 - DNA, 25 bp, Homo sapien
gggtagaaataggaactgtccaatt

SEQ ID NO: 650742 - DNA, 25 bp, Homo sapien
ggtagaaataggaactgtccaattt

SEQ ID NO: 650743 - DNA, 25 bp, Homo sapien
gtagaaataggaactgtccaatttc

SEQ ID NO: 650744 - DNA, 25 bp, Homo sapien
agaaataggaactgtccaatttctt

SEQ ID NO: 650745 - DNA, 25 bp, Homo sapien
taggaactgtccaatttcttttaat

SEQ ID NO: 650746 - DNA, 25 bp, Homo sapien
ggaactgtccaatttcttttaatca

SEQ ID NO: 650747 - DNA, 25 bp, Homo sapien
ttttgttgtttttggctaatcactg

SEQ ID NO: 650748 - DNA, 25 bp, Homo sapien
gttgtttttggctaatcactgttga

SEQ ID NO: 650749 - DNA, 25 bp, Homo sapien
gtttttggctaatcactgttgatga

SEQ ID NO: 650750 - DNA, 25 bp, Homo sapien
ggctaatcactgttgatgaaagaat

SEQ ID NO: 650751 - DNA, 25 bp, Homo sapien
gaaagaataatctcttaacaccaag

SEQ ID NO: 650752 - DNA, 25 bp, Homo sapien
gaataatctcttaacaccaaggagc

SEQ ID NO: 650753 - DNA, 25 bp, Homo sapien
taatctcttaacaccaaggagctga

SEQ ID NO: 650754 - DNA, 25 bp, Homo sapien
aaggagctgaaattcttggctgggt

SEQ ID NO: 650755 - DNA, 25 bp, Homo sapien
aatttttgcaaaatcaacatggaat

SEQ ID NO: 650756 - DNA, 25 bp, Homo sapien
gaatttttctgaactgtttgtttca

SEQ ID NO: 650757 - DNA, 25 bp, Homo sapien
atttttctgaactgtttgtttcata

SEQ ID NO: 650758 - DNA, 25 bp, Homo sapien
attgagtttttcaaatcggttcata

SEQ ID NO: 650759 - DNA, 25 bp, Homo sapien
ggttcatatgaaatcctaggcaata

SEQ ID NO: 650760 - DNA, 25 bp, Homo sapien
gaaatcctaggcaatattgtaaaat

SEQ ID NO: 650761 - DNA, 25 bp, Homo sapien
atacagacctgtcaactttttccac

SEQ ID NO: 650762 - DNA, 25 bp, Homo sapien
cagacctgtcaactttttccactta

SEQ ID NO: 650763 - DNA, 25 bp, Homo sapien
gagcaaaatttaagggcatagtcgt

SEQ ID NO: 650764 - DNA, 25 bp, Homo sapien
taagggcatagtcgttttcaagtaa

SEQ ID NO: 650765 - DNA, 25 bp, Homo sapien
ggcatagtcgttttcaagtaatttt

SEQ ID NO: 650766 - DNA, 25 bp, Homo sapien
agtttagtgatgttaatggagctat

SEQ ID NO: 650767 - DNA, 25 bp, Homo sapien
aatgagttttaggagttgagaccaa

SEQ ID NO: 650768 - DNA, 25 bp, Homo sapien
aaatatctatatctgtttaaacaca

SEQ ID NO: 650769 - DNA, 25 bp, Homo sapien
ttttattgaaaatgctgacagaggc

SEQ ID NO: 650770 - DNA, 25 bp, Homo sapien
tattgaaaatgctgacagaggccga

SEQ ID NO: 650771 - DNA, 25 bp, Homo sapien
ttgaaaatgctgacagaggccgagt

SEQ ID NO: 650772 - DNA, 25 bp, Homo sapien
gaaaatgctgacagaggccgagtgt

SEQ ID NO: 650773 - DNA, 25 bp, Homo sapien
aaaatgctgacagaggccgagtgta

SEQ ID NO: 650774 - DNA, 25 bp, Homo sapien
aaatgctgacagaggccgagtgtag

SEQ ID NO: 650775 - DNA, 25 bp, Homo sapien
aatgctgacagaggccgagtgtagt

SEQ ID NO: 650776 - DNA, 25 bp, Homo sapien
ctgacagaggccgagtgtagtagct

SEQ ID NO: 650777 - DNA, 25 bp, Homo sapien
gacagaggccgagtgtagtagctca

SEQ ID NO: 650778 - DNA, 25 bp, Homo sapien
acagaggccgagtgtagtagctcac

SEQ ID NO: 650779 - DNA, 25 bp, Homo sapien
cagaggccgagtgtagtagctcaca

SEQ ID NO: 650780 - DNA, 25 bp, Homo sapien
ctaagattgctacaggttcgagaac

SEQ ID NO: 650781 - DNA, 25 bp, Homo sapien
aagaaagagatatcgccttacagat

SEQ ID NO: 650782 - DNA, 25 bp, Homo sapien
gagatatcgccttacagataagaga

SEQ ID NO: 650783 - DNA, 25 bp, Homo sapien
aatcaacaatttacacgtttggcag

SEQ ID NO: 650784 - DNA, 25 bp, Homo sapien
ttacacgtttggcagaggagctaag

SEQ ID NO: 650785 - DNA, 25 bp, Homo sapien
gaatgggaagaatcacaaactcaga

SEQ ID NO: 650786 - DNA, 25 bp, Homo sapien
gagagggacatcgacaggccaaaga

SEQ ID NO: 650787 - DNA, 25 bp, Homo sapien
gaacctgatttggatgctttggcac

SEQ ID NO: 650788 - DNA, 25 bp, Homo sapien
tttggatgctttggcacagcgggca

SEQ ID NO: 650789 - DNA, 25 bp, Homo sapien
tgctttggcacagcgggcagcagaa

SEQ ID NO: 650790 - DNA, 25 bp, Homo sapien
gaaaagcagatttgaggcataaaga

SEQ ID NO: 650791 - DNA, 25 bp, Homo sapien
gctcttccttggtgaggacaacagc

SEQ ID NO: 650792 - DNA, 25 bp, Homo sapien
ggacaacagccacgtccttgaatat

SEQ ID NO: 650793 - DNA, 25 bp, Homo sapien
tccttgaatatcaccctttcctaaa

SEQ ID NO: 650794 - DNA, 25 bp, Homo sapien
ttcctaaaacatcaaccacatgcca

SEQ ID NO: 650795 - DNA, 25 bp, Homo sapien
tgccacatcaatcatccacacaaat

SEQ ID NO: 650796 - DNA, 25 bp, Homo sapien
cacaaatgactggtcttagtctgtt

SEQ ID NO: 650797 - DNA, 25 bp, Homo sapien
aaaataccatagtctgggttagatt

SEQ ID NO: 650798 - DNA, 25 bp, Homo sapien
gtctaagatcaagtaccaccaagat

SEQ ID NO: 650799 - DNA, 25 bp, Homo sapien
gataggtttcattcaggtttcttct

SEQ ID NO: 650800 - DNA, 25 bp, Homo sapien
ttcattcaggtttcttctcttggct

SEQ ID NO: 650801 - DNA, 25 bp, Homo sapien
tcttctcttggcttgtagacagctg

SEQ ID NO: 650802 - DNA, 25 bp, Homo sapien
ggaaaatatactggagtggttaatc

SEQ ID NO: 650803 - DNA, 25 bp, Homo sapien
gaaaatatactggagtggttaatca

SEQ ID NO: 650804 - DNA, 25 bp, Homo sapien
aaaatatactggagtggttaatcag

SEQ ID NO: 650805 - DNA, 25 bp, Homo sapien
aaatatactggagtggttaatcaga

SEQ ID NO: 650806 - DNA, 25 bp, Homo sapien
aatatactggagtggttaatcagat

SEQ ID NO: 650807 - DNA, 25 bp, Homo sapien
atatactggagtggttaatcagatt

SEQ ID NO: 650808 - DNA, 25 bp, Homo sapien
tatactggagtggttaatcagattt

SEQ ID NO: 650809 - DNA, 25 bp, Homo sapien
atactggagtggttaatcagatttt

SEQ ID NO: 650810 - DNA, 25 bp, Homo sapien
tactggagtggttaatcagattttc

SEQ ID NO: 650811 - DNA, 25 bp, Homo sapien
ggagtcttttgagataaattatgtc

SEQ ID NO: 650812 - DNA, 25 bp, Homo sapien
gtcttttgagataaattatgtcatt

SEQ ID NO: 650813 - DNA, 25 bp, Homo sapien
tgcccagcccctaatttgtgtattt

SEQ ID NO: 650814 - DNA, 25 bp, Homo sapien
tgagccaccgtgctttgagttttta

SEQ ID NO: 650815 - DNA, 25 bp, Homo sapien
gagccaccgtgctttgagtttttac

SEQ ID NO: 650816 - DNA, 25 bp, Homo sapien
agccaccgtgctttgagtttttaca

SEQ ID NO: 650817 - DNA, 25 bp, Homo sapien
gagtttttacagtaagtcttggccg

SEQ ID NO: 650818 - DNA, 25 bp, Homo sapien
tttttacagtaagtcttggccggag

SEQ ID NO: 650819 - DNA, 25 bp, Homo sapien
ttttacagtaagtcttggccggagt

SEQ ID NO: 650820 - DNA, 25 bp, Homo sapien
ttacagtaagtcttggccggagtgc

SEQ ID NO: 650821 - DNA, 25 bp, Homo sapien
tacagtaagtcttggccggagtgca

SEQ ID NO: 650822 - DNA, 25 bp, Homo sapien
acagtaagtcttggccggagtgcag

SEQ ID NO: 650823 - DNA, 25 bp, Homo sapien
cagtaagtcttggccggagtgcagt

SEQ ID NO: 650824 - DNA, 25 bp, Homo sapien
ttttggagatgaagtctgtcaccca

SEQ ID NO: 650825 - DNA, 25 bp, Homo sapien
ttggagatgaagtctgtcacccagg

SEQ ID NO: 650826 - DNA, 25 bp, Homo sapien
gagttcagtggcctgattgatcact

SEQ ID NO: 650827 - DNA, 25 bp, Homo sapien
agtggcctgattgatcactgcagcc

SEQ ID NO: 650828 - DNA, 25 bp, Homo sapien
gcctgattgatcactgcagcctcga

SEQ ID NO: 650829 - DNA, 25 bp, Homo sapien
agcctcgacctccagctcacataat

SEQ ID NO: 650830 - DNA, 25 bp, Homo sapien
tcgacctccagctcacataatcctc

SEQ ID NO: 650831 - DNA, 25 bp, Homo sapien
ctccagctcacataatcctcctgct

SEQ ID NO: 650832 - DNA, 25 bp, Homo sapien
cccaagctgatgtcaaacttctgga

SEQ ID NO: 650833 - DNA, 25 bp, Homo sapien
gctgatgtcaaacttctggattcaa

SEQ ID NO: 650834 - DNA, 25 bp, Homo sapien
agcacttctgcccaaagtgctagga

SEQ ID NO: 650835 - DNA, 25 bp, Homo sapien
tgcgactcctgcagggatgaaggta

SEQ ID NO: 650836 - DNA, 25 bp, Homo sapien
gggctcacctggcaaattggcagca

SEQ ID NO: 650837 - DNA, 25 bp, Homo sapien
tggcagcaccagactccggaagaga

SEQ ID NO: 650838 - DNA, 25 bp, Homo sapien
gagaaaggcgccaaggcactggcaa

SEQ ID NO: 650839 - DNA, 25 bp, Homo sapien
aaggcactggcaagatcctagcgcc

SEQ ID NO: 650840 - DNA, 25 bp, Homo sapien
agcgcctcagatcctgaccgtggca

SEQ ID NO: 650841 - DNA, 25 bp, Homo sapien
gaccattttcacttttcacccaatg

SEQ ID NO: 650842 - DNA, 25 bp, Homo sapien
acttttcacccaatgcagtcggtag

SEQ ID NO: 650843 - DNA, 25 bp, Homo sapien
atgcagtcggtagtttgctctgcgc

SEQ ID NO: 650844 - DNA, 25 bp, Homo sapien
ggtagtttgctctgcgcttctcatt

SEQ ID NO: 650845 - DNA, 25 bp, Homo sapien
gcttctcattctcagcagttctgat

SEQ ID NO: 650846 - DNA, 25 bp, Homo sapien
gtaaactgattaagttttaggcatt

SEQ ID NO: 650847 - DNA, 25 bp, Homo sapien
aaagattgggaactattctatttgg

SEQ ID NO: 650848 - DNA, 25 bp, Homo sapien
attagtatatgtgccagttattgcc

SEQ ID NO: 650849 - DNA, 25 bp, Homo sapien
gtatatgtgccagttattgccattt

SEQ ID NO: 650850 - DNA, 25 bp, Homo sapien
tatgtgccagttattgccatttctt

SEQ ID NO: 650851 - DNA, 25 bp, Homo sapien
gtgccagttattgccatttcttaag

SEQ ID NO: 650852 - DNA, 25 bp, Homo sapien
gccagttattgccatttcttaagtc

SEQ ID NO: 650853 - DNA, 25 bp, Homo sapien
cagttattgccatttcttaagtcca

SEQ ID NO: 650854 - DNA, 25 bp, Homo sapien
gttattgccatttcttaagtccaaa

SEQ ID NO: 650855 - DNA, 25 bp, Homo sapien
tcttaagtccaaaatgtttttctgg

SEQ ID NO: 650856 - DNA, 25 bp, Homo sapien
atgtttttctggtcaaataaatagc

SEQ ID NO: 650857 - DNA, 25 bp, Homo sapien
tcaaatctctcccttccaagaaata

SEQ ID NO: 650858 - DNA, 25 bp, Homo sapien
aagccatatatcactctgtggtatt

SEQ ID NO: 650859 - DNA, 25 bp, Homo sapien
aatgtcaccttgtatcatgactgct

SEQ ID NO: 650860 - DNA, 25 bp, Homo sapien
gtatcatgactgctagagttctcat

SEQ ID NO: 650861 - DNA, 25 bp, Homo sapien
tagagttctcataatcaggtgtcaa

SEQ ID NO: 650862 - DNA, 25 bp, Homo sapien
aatcaggtgtcaaactctttaacaa

SEQ ID NO: 650863 - DNA, 25 bp, Homo sapien
gctgctttagtaatttttgtgccca

SEQ ID NO: 650864 - DNA, 25 bp, Homo sapien
agtaatttttgtgcccaccatcact

SEQ ID NO: 650865 - DNA, 25 bp, Homo sapien
catcactcagagcttgtacatatta

SEQ ID NO: 650866 - DNA, 25 bp, Homo sapien
attaagggccgagcagtatttactg

SEQ ID NO: 650867 - DNA, 25 bp, Homo sapien
tttactgctaggaacaaaggaacga

SEQ ID NO: 650868 - DNA, 25 bp, Homo sapien
aagcatttgtagatcaatgtgttgt

SEQ ID NO: 650869 - DNA, 25 bp, Homo sapien
gcatttgtagatcaatgtgttgtgt

SEQ ID NO: 650870 - DNA, 25 bp, Homo sapien
ttgtagatcaatgtgttgtgtggta

SEQ ID NO: 650871 - DNA, 25 bp, Homo sapien
gtagatcaatgtgttgtgtggtata

SEQ ID NO: 650872 - DNA, 25 bp, Homo sapien
agatcaatgtgttgtgtggtatatt

SEQ ID NO: 650873 - DNA, 25 bp, Homo sapien
gatcaatgtgttgtgtggtatatta

SEQ ID NO: 650874 - DNA, 25 bp, Homo sapien
atcaatgtgttgtgtggtatattaa

SEQ ID NO: 650875 - DNA, 25 bp, Homo sapien
caatgtgttgtgtggtatattaaaa

SEQ ID NO: 650876 - DNA, 25 bp, Homo sapien
atgtgttgtgtggtatattaaaaat

SEQ ID NO: 650877 - DNA, 25 bp, Homo sapien
aaacagttggcaggtaaatttaatg

SEQ ID NO: 650878 - DNA, 25 bp, Homo sapien
cagttggcaggtaaatttaatgtaa

SEQ ID NO: 650879 - DNA, 25 bp, Homo sapien
gtctcctgtagactcatatctcaca

SEQ ID NO: 650880 - DNA, 25 bp, Homo sapien
gactcatatctcacaggcaggacta

SEQ ID NO: 650881 - DNA, 25 bp, Homo sapien
gtgggatagctctaaaccaggatta

SEQ ID NO: 650882 - DNA, 25 bp, Homo sapien
agcaagcaaagttagggcgcaaatt

SEQ ID NO: 650883 - DNA, 25 bp, Homo sapien
gttagggcgcaaattcctggaatct

SEQ ID NO: 650884 - DNA, 25 bp, Homo sapien
cctggaatctgactgggaccctggc

SEQ ID NO: 650885 - DNA, 25 bp, Homo sapien
gctgggactgttgaaaacccaattt

SEQ ID NO: 650886 - DNA, 25 bp, Homo sapien
gaagggattatttctattccatttc

SEQ ID NO: 650887 - DNA, 25 bp, Homo sapien
gagtgagaatgacaggacctctttc

SEQ ID NO: 650888 - DNA, 25 bp, Homo sapien
aggacctctttctaactcctcttga

SEQ ID NO: 650889 - DNA, 25 bp, Homo sapien
ctaactcctcttgagggtgtgagaa

SEQ ID NO: 650890 - DNA, 25 bp, Homo sapien
tgggcaacaaatctccgtctcacca

SEQ ID NO: 650891 - DNA, 25 bp, Homo sapien
ggcaacaaatctccgtctcaccaaa

SEQ ID NO: 650892 - DNA, 25 bp, Homo sapien
agaaaaccgtggcttttatccatga

SEQ ID NO: 650893 - DNA, 25 bp, Homo sapien
aaaaccgtggcttttatccatgaag

SEQ ID NO: 650894 - DNA, 25 bp, Homo sapien
aaccgtggcttttatccatgaagct

SEQ ID NO: 650895 - DNA, 25 bp, Homo sapien
ccgtggcttttatccatgaagctat

SEQ ID NO: 650896 - DNA, 25 bp, Homo sapien
gtggcttttatccatgaagctatta

SEQ ID NO: 650897 - DNA, 25 bp, Homo sapien
ggcttttatccatgaagctattaat

SEQ ID NO: 650898 - DNA, 25 bp, Homo sapien
gctattaatatattgccttcttttg

SEQ ID NO: 650899 - DNA, 25 bp, Homo sapien
atatattgccttcttttgaagtgga

SEQ ID NO: 650900 - DNA, 25 bp, Homo sapien
attgccttcttttgaagtggaataa

SEQ ID NO: 650901 - DNA, 25 bp, Homo sapien
gaaatgatgttgtcactggtggctc

SEQ ID NO: 650902 - DNA, 25 bp, Homo sapien
gatgttgtcactggtggctcattca

SEQ ID NO: 650903 - DNA, 25 bp, Homo sapien
tgtcactggtggctcattcagggaa

SEQ ID NO: 650904 - DNA, 25 bp, Homo sapien
actggtggctcattcagggaagctc

SEQ ID NO: 650905 - DNA, 25 bp, Homo sapien
gtggctcattcagggaagctcatca

SEQ ID NO: 650906 - DNA, 25 bp, Homo sapien
ctcattcagggaagctcatcaaagc

SEQ ID NO: 650907 - DNA, 25 bp, Homo sapien
tcatcaaagcccactttgttcgcag

SEQ ID NO: 650908 - DNA, 25 bp, Homo sapien
aaagcccactttgttcgcagtgtag

SEQ ID NO: 650909 - DNA, 25 bp, Homo sapien
ccactttgttcgcagtgtagctgaa

SEQ ID NO: 650910 - DNA, 25 bp, Homo sapien
tttgttcgcagtgtagctgaaatac

SEQ ID NO: 650911 - DNA, 25 bp, Homo sapien
gaattcacaatgcatttttcaagag

SEQ ID NO: 650912 - DNA, 25 bp, Homo sapien
atggggaaaggtctttcttgccctg

SEQ ID NO: 650913 - DNA, 25 bp, Homo sapien
agatctgatggctgtataaggtgga

SEQ ID NO: 650914 - DNA, 25 bp, Homo sapien
gatggctgtataaggtggagtttcc

SEQ ID NO: 650915 - DNA, 25 bp, Homo sapien
ggctgtataaggtggagtttccttg

SEQ ID NO: 650916 - DNA, 25 bp, Homo sapien
ttccttgcacaagctttttttcacc

SEQ ID NO: 650917 - DNA, 25 bp, Homo sapien
tgcacaagctttttttcacctgctg

SEQ ID NO: 650918 - DNA, 25 bp, Homo sapien
aagctttttttcacctgctgccatc

SEQ ID NO: 650919 - DNA, 25 bp, Homo sapien
ccatccacgtaagatcgtaagatgt

SEQ ID NO: 650920 - DNA, 25 bp, Homo sapien
cacgtaagatcgtaagatgtgactt

SEQ ID NO: 650921 - DNA, 25 bp, Homo sapien
cttgggtatgtctttgtcagttgca

SEQ ID NO: 650922 - DNA, 25 bp, Homo sapien
tgggtatgtctttgtcagttgcatg

SEQ ID NO: 650923 - DNA, 25 bp, Homo sapien
aacaccgttcttcccgaaggcagca

SEQ ID NO: 650924 - DNA, 25 bp, Homo sapien
tgtttccccagttctgggcatcagt

SEQ ID NO: 650925 - DNA, 25 bp, Homo sapien
ggcatcagtcccagaggcaaagacg

SEQ ID NO: 650926 - DNA, 25 bp, Homo sapien
ggcaaagacgggagccatccactct

SEQ ID NO: 650927 - DNA, 25 bp, Homo sapien
ctctgactctgccaacaattctgtg

SEQ ID NO: 650928 - DNA, 25 bp, Homo sapien
aattctgtgagcacccagttctctg

SEQ ID NO: 650929 - DNA, 25 bp, Homo sapien
ctctgtatgaaattcctttctgctt

SEQ ID NO: 650930 - DNA, 25 bp, Homo sapien
cagggtttgattttgcttatgtgga

SEQ ID NO: 650931 - DNA, 25 bp, Homo sapien
ttgcttatgtggaccggcaggtgca

SEQ ID NO: 650932 - DNA, 25 bp, Homo sapien
tgcattttagtgcagggcttcctga

SEQ ID NO: 650933 - DNA, 25 bp, Homo sapien
gatcctgctgcacagctaacaccgt

SEQ ID NO: 650934 - DNA, 25 bp, Homo sapien
ggagccacccttacctggggtcagg

SEQ ID NO: 650935 - DNA, 25 bp, Homo sapien
caggacatctgctgacaagggcagt

SEQ ID NO: 650936 - DNA, 25 bp, Homo sapien
atctgctgacaagggcagtgtgaat

SEQ ID NO: 650937 - DNA, 25 bp, Homo sapien
cagtgtgaatctgccaagggttggc

SEQ ID NO: 650938 - DNA, 25 bp, Homo sapien
tgaatctgccaagggttggcaccca

SEQ ID NO: 650939 - DNA, 25 bp, Homo sapien
atctgccaagggttggcacccacca

SEQ ID NO: 650940 - DNA, 25 bp, Homo sapien
gagacctcacgtgtgtgctttgtaa

SEQ ID NO: 650941 - DNA, 25 bp, Homo sapien
gtgctttgtaagtgaggctgcccaa

SEQ ID NO: 650942 - DNA, 25 bp, Homo sapien
ctttgtaagtgaggctgcccaagct

SEQ ID NO: 650943 - DNA, 25 bp, Homo sapien
caaaagctcttgtttcaaatctata

SEQ ID NO: 650944 - DNA, 25 bp, Homo sapien
agctcttgtttcaaatctatatttg

SEQ ID NO: 650945 - DNA, 25 bp, Homo sapien
ttcctaatctccagacgcacaaaga

SEQ ID NO: 650946 - DNA, 25 bp, Homo sapien
aatcctgtgttggatgttgtgtcca

SEQ ID NO: 650947 - DNA, 25 bp, Homo sapien
gttgtgtccaatcctgaacaaacag

SEQ ID NO: 650948 - DNA, 25 bp, Homo sapien
aaacaaggttgcagaccctgtggat

SEQ ID NO: 650949 - DNA, 25 bp, Homo sapien
gaccctgtggattcttctaacttgg

SEQ ID NO: 650950 - DNA, 25 bp, Homo sapien
gattcttctaacttggacacatgtg

SEQ ID NO: 650951 - DNA, 25 bp, Homo sapien
gacacatgtggttccatcagtcagg

SEQ ID NO: 650952 - DNA, 25 bp, Homo sapien
atcagtcaggtcattgagcagttac

SEQ ID NO: 650953 - DNA, 25 bp, Homo sapien
gagcagttacctcagccaaacagga

SEQ ID NO: 650954 - DNA, 25 bp, Homo sapien
caagcagtgttctgggaatgtcagt

SEQ ID NO: 650955 - DNA, 25 bp, Homo sapien
aatgtcagtggaatctgctcctgct

SEQ ID NO: 650956 - DNA, 25 bp, Homo sapien
ctccagcaaggatccagctgtgact

SEQ ID NO: 650957 - DNA, 25 bp, Homo sapien
agcaaggatccagctgtgactcagg

SEQ ID NO: 650958 - DNA, 25 bp, Homo sapien
aggatccagctgtgactcagggcat

SEQ ID NO: 650959 - DNA, 25 bp, Homo sapien
gatccagctgtgactcagggcatgg

SEQ ID NO: 650960 - DNA, 25 bp, Homo sapien
agctgtgactcagggcatggctcaa

SEQ ID NO: 650961 - DNA, 25 bp, Homo sapien
tgactcagggcatggctcaaggaca

SEQ ID NO: 650962 - DNA, 25 bp, Homo sapien
tcagggcatggctcaaggacagtga

SEQ ID NO: 650963 - DNA, 25 bp, Homo sapien
cagtgatggcgtagggtgtaggcaa

SEQ ID NO: 650964 - DNA, 25 bp, Homo sapien
tgtaggcaaggagggctatgcagtt

SEQ ID NO: 650965 - DNA, 25 bp, Homo sapien
gctatgcagttgtagtgggaacttc

SEQ ID NO: 650966 - DNA, 25 bp, Homo sapien
cagttgtagtgggaacttcatttgg

SEQ ID NO: 650967 - DNA, 25 bp, Homo sapien
tttttgttcaagtggagcagcggca

SEQ ID NO: 650968 - DNA, 25 bp, Homo sapien
aaaccttgtgcagttgtacagtaca

SEQ ID NO: 650969 - DNA, 25 bp, Homo sapien
gaagctcgtgcatttggagtcacta

SEQ ID NO: 650970 - DNA, 25 bp, Homo sapien
gatgatgctaagaagttatgtccag

SEQ ID NO: 650971 - DNA, 25 bp, Homo sapien
agatcttctactggcacaagttcgt

SEQ ID NO: 650972 - DNA, 25 bp, Homo sapien
cacaagttcgtgagtcccgtgggaa

SEQ ID NO: 650973 - DNA, 25 bp, Homo sapien
gagtcccgtgggaaagctaacctca

SEQ ID NO: 650974 - DNA, 25 bp, Homo sapien
gctaacctcaccaagtaccgggaag

SEQ ID NO: 650975 - DNA, 25 bp, Homo sapien
accgggaagccagtgttgaagtgat

SEQ ID NO: 650976 - DNA, 25 bp, Homo sapien
gatggagataatgtctcgttttgct

SEQ ID NO: 650977 - DNA, 25 bp, Homo sapien
gattgaacgtgccagcattgatgag

SEQ ID NO: 650978 - DNA, 25 bp, Homo sapien
gcttgatcgcagtttcttaatacca

SEQ ID NO: 650979 - DNA, 25 bp, Homo sapien
gatcgcagtttcttaataccatttc

SEQ ID NO: 650980 - DNA, 25 bp, Homo sapien
cagtttcttaataccatttctgtgc

SEQ ID NO: 650981 - DNA, 25 bp, Homo sapien
gccatggctcctgaagcacctagaa

SEQ ID NO: 650982 - DNA, 25 bp, Homo sapien
gctcctgaagcacctagaaccggaa

SEQ ID NO: 650983 - DNA, 25 bp, Homo sapien
gaagcacctagaaccggaagctata

SEQ ID NO: 650984 - DNA, 25 bp, Homo sapien
gaaccggaagctatattcagcaatt

SEQ ID NO: 650985 - DNA, 25 bp, Homo sapien
taagttgaatttctgttaatacctt

SEQ ID NO: 650986 - DNA, 25 bp, Homo sapien
ttctgttaatacctttagatttaag

SEQ ID NO: 650987 - DNA, 25 bp, Homo sapien
accacacctggcttgatcgcagttt

SEQ ID NO: 650988 - DNA, 25 bp, Homo sapien
acctggcttgatcgcagtttcttaa

SEQ ID NO: 650989 - DNA, 25 bp, Homo sapien
agcctgtggaaagctcaagtgcaca

SEQ ID NO: 650990 - DNA, 25 bp, Homo sapien
gaaagctcaagtgcacagacatggg

SEQ ID NO: 650991 - DNA, 25 bp, Homo sapien
gacatgggaggtaaataacttctct

SEQ ID NO: 650992 - DNA, 25 bp, Homo sapien
agttttgatctcacagacctcccag

SEQ ID NO: 650993 - DNA, 25 bp, Homo sapien
gatctcacagacctcccagaagggt

SEQ ID NO: 650994 - DNA, 25 bp, Homo sapien
aggagtccccagactacattttgag

SEQ ID NO: 650995 - DNA, 25 bp, Homo sapien
agaactgttgctctcttatacacca

SEQ ID NO: 650996 - DNA, 25 bp, Homo sapien
gttgctctcttatacaccaagggat

SEQ ID NO: 650997 - DNA, 25 bp, Homo sapien
ttggtgatgtaaattggcagggact

SEQ ID NO: 650998 - DNA, 25 bp, Homo sapien
gggccaagaaaaatgtactcacatc

SEQ ID NO: 650999 - DNA, 25 bp, Homo sapien
gtactcacatctatgatcaacaagt

SEQ ID NO: 651000 - DNA, 25 bp, Homo sapien
tgctggtgtgtctcatcttctggct

SEQ ID NO: 651001 - DNA, 25 bp, Homo sapien
atcatgggagttaacttgtttgcgg

SEQ ID NO: 651002 - DNA, 25 bp, Homo sapien
ttgtttgcgggaaagtaccactact

SEQ ID NO: 651003 - DNA, 25 bp, Homo sapien
gcgggaaagtaccactactgcttta

SEQ ID NO: 651004 - DNA, 25 bp, Homo sapien
agtaccactactgctttaatgagac

SEQ ID NO: 651005 - DNA, 25 bp, Homo sapien
actactgctttaatgagacttctga

SEQ ID NO: 651006 - DNA, 25 bp, Homo sapien
tgagacttctgaaatccgatttgaa

SEQ ID NO: 651007 - DNA, 25 bp, Homo sapien
ggcaggatacctggcccttcttcaa

SEQ ID NO: 651008 - DNA, 25 bp, Homo sapien
tacctggcccttcttcaagtagcaa

SEQ ID NO: 651009 - DNA, 25 bp, Homo sapien
tggcccttcttcaagtagcaacctt

SEQ ID NO: 651010 - DNA, 25 bp, Homo sapien
aagtagcaaccttcaaaggctggat

SEQ ID NO: 651011 - DNA, 25 bp, Homo sapien
cctcgacctccagctcacataatcc

SEQ ID NO: 651012 - DNA, 25 bp, Homo sapien
ctcgacctccagctcacataatcct

SEQ ID NO: 651013 - DNA, 25 bp, Homo sapien
tcgacctccagctcacataatcctc

SEQ ID NO: 651014 - DNA, 25 bp, Homo sapien
cgacctccagctcacataatcctcc

SEQ ID NO: 651015 - DNA, 25 bp, Homo sapien
gacctccagctcacataatcctcct

SEQ ID NO: 651016 - DNA, 25 bp, Homo sapien
acctccagctcacataatcctcctg

SEQ ID NO: 651017 - DNA, 25 bp, Homo sapien
cctccagctcacataatcctcctgc

SEQ ID NO: 651018 - DNA, 25 bp, Homo sapien
ctccagctcacataatcctcctgct

SEQ ID NO: 651019 - DNA, 25 bp, Homo sapien
catcaagatagcagcaactactcta

SEQ ID NO: 651020 - DNA, 25 bp, Homo sapien
tagcagcaactactctatcattact

SEQ ID NO: 651021 - DNA, 25 bp, Homo sapien
aactactctatcattactgtaccac

SEQ ID NO: 651022 - DNA, 25 bp, Homo sapien
accaccacctgtatggatctcgttg

SEQ ID NO: 651023 - DNA, 25 bp, Homo sapien
acctgtatggatctcgttgcccata

SEQ ID NO: 651024 - DNA, 25 bp, Homo sapien
gtatggatctcgttgcccatatgaa

SEQ ID NO: 651025 - DNA, 25 bp, Homo sapien
gatctcgttgcccatatgaaactga

SEQ ID NO: 651026 - DNA, 25 bp, Homo sapien
tcgttgcccatatgaaactgagtaa

SEQ ID NO: 651027 - DNA, 25 bp, Homo sapien
aactgagtaaggaacaatgtgcatc

SEQ ID NO: 651028 - DNA, 25 bp, Homo sapien
aacaatgtgcatcacactcacagag

SEQ ID NO: 651029 - DNA, 25 bp, Homo sapien
caatgtgcatcacactcacagagaa

SEQ ID NO: 651030 - DNA, 25 bp, Homo sapien
aggatctatgcaatttttaaactag

SEQ ID NO: 651031 - DNA, 25 bp, Homo sapien
gatctatgcaatttttaaactagta

SEQ ID NO: 651032 - DNA, 25 bp, Homo sapien
tttactacttgttacctttcccatg

SEQ ID NO: 651033 - DNA, 25 bp, Homo sapien
ttactacttgttacctttcccatgc

SEQ ID NO: 651034 - DNA, 25 bp, Homo sapien
tactacttgttacctttcccatgct

SEQ ID NO: 651035 - DNA, 25 bp, Homo sapien
gactttttataatgtggatttccta

SEQ ID NO: 651036 - DNA, 25 bp, Homo sapien
aaaccatgcagcttcatcaattttt

SEQ ID NO: 651037 - DNA, 25 bp, Homo sapien
aaccatgcagcttcatcaattttta

SEQ ID NO: 651038 - DNA, 25 bp, Homo sapien
accatgcagcttcatcaatttttat

SEQ ID NO: 651039 - DNA, 25 bp, Homo sapien
ccatgcagcttcatcaatttttata

SEQ ID NO: 651040 - DNA, 25 bp, Homo sapien
catcaatttttatacatatcagaaa

SEQ ID NO: 651041 - DNA, 25 bp, Homo sapien
agtcataagcaagcctgtcattcgc

SEQ ID NO: 651042 - DNA, 25 bp, Homo sapien
ataagcaagcctgtcattcgcccag

SEQ ID NO: 651043 - DNA, 25 bp, Homo sapien
cagccctgctatacattctcattat

SEQ ID NO: 651044 - DNA, 25 bp, Homo sapien
ttctcattatagtttcgtttcaaat

SEQ ID NO: 651045 - DNA, 25 bp, Homo sapien
gtttcgtttcaaatccagtgttaca

SEQ ID NO: 651046 - DNA, 25 bp, Homo sapien
gaaacaaaacaccaagccctcaatc

SEQ ID NO: 651047 - DNA, 25 bp, Homo sapien
aagccctcaatcatgctatgcgtat

SEQ ID NO: 651048 - DNA, 25 bp, Homo sapien
tcatgctatgcgtatctttatgtgt

SEQ ID NO: 651049 - DNA, 25 bp, Homo sapien
gcgtatctttatgtgtgcatgtctt

SEQ ID NO: 651050 - DNA, 25 bp, Homo sapien
tgtgtgcatgtcttatgtatgttta

SEQ ID NO: 651051 - DNA, 25 bp, Homo sapien
catctgtggtttctgtttatattca

SEQ ID NO: 651052 - DNA, 25 bp, Homo sapien
aaaaggaacctcatcagtcgttaga

SEQ ID NO: 651053 - DNA, 25 bp, Homo sapien
gaacctcatcagtcgttagagagta

SEQ ID NO: 651054 - DNA, 25 bp, Homo sapien
atgactacaaacctaacatggtgag

SEQ ID NO: 651055 - DNA, 25 bp, Homo sapien
gaatgaaagacaccctcagcatcca

SEQ ID NO: 651056 - DNA, 25 bp, Homo sapien
gcatccatgtccctagttccagttg

SEQ ID NO: 651057 - DNA, 25 bp, Homo sapien
tagttccagttgctctgaagatgca

SEQ ID NO: 651058 - DNA, 25 bp, Homo sapien
gaagatgcagtcaatatctttaccc

SEQ ID NO: 651059 - DNA, 25 bp, Homo sapien
atatctttacccttcctgtggctta

SEQ ID NO: 651060 - DNA, 25 bp, Homo sapien
ctgtggcttagctcttcaacccttc

SEQ ID NO: 651061 - DNA, 25 bp, Homo sapien
gctacttcaagatggctttctgtca

SEQ ID NO: 651062 - DNA, 25 bp, Homo sapien
atggctttctgtcactttcaactaa

SEQ ID NO: 651063 - DNA, 25 bp, Homo sapien
agtttctacctgctcctgttttcat

SEQ ID NO: 651064 - DNA, 25 bp, Homo sapien
tgctcctgttttcatgctttcaggt

SEQ ID NO: 651065 - DNA, 25 bp, Homo sapien
gttttcatgctttcaggtgtttcgt

SEQ ID NO: 651066 - DNA, 25 bp, Homo sapien
atgctttcaggtgtttcgttttgta

SEQ ID NO: 651067 - DNA, 25 bp, Homo sapien
tcgttttgtagtttgtgcagtgctt

SEQ ID NO: 651068 - DNA, 25 bp, Homo sapien
ttgtgcagtgcttatagttgtttct

SEQ ID NO: 651069 - DNA, 25 bp, Homo sapien
gtgcttatagttgtttctgtgagaa

SEQ ID NO: 651070 - DNA, 25 bp, Homo sapien
gtttctgtgagaaggtaatgcctac

SEQ ID NO: 651071 - DNA, 25 bp, Homo sapien
taatgcctacagataggagcccctg

SEQ ID NO: 651072 - DNA, 25 bp, Homo sapien
ataggagcccctggccatcgctggg

SEQ ID NO: 651073 - DNA, 25 bp, Homo sapien
catcgctgggagtccagccaggcag

SEQ ID NO: 651074 - DNA, 25 bp, Homo sapien
gttggagaccaacgtaggcaataca

SEQ ID NO: 651075 - DNA, 25 bp, Homo sapien
ttggagaccaacgtaggcaatacag

SEQ ID NO: 651076 - DNA, 25 bp, Homo sapien
tggagaccaacgtaggcaatacagc

SEQ ID NO: 651077 - DNA, 25 bp, Homo sapien
ggagaccaacgtaggcaatacagca

SEQ ID NO: 651078 - DNA, 25 bp, Homo sapien
gagaccaacgtaggcaatacagcaa

SEQ ID NO: 651079 - DNA, 25 bp, Homo sapien
agaccaacgtaggcaatacagcaag

SEQ ID NO: 651080 - DNA, 25 bp, Homo sapien
gaccaacgtaggcaatacagcaaga

SEQ ID NO: 651081 - DNA, 25 bp, Homo sapien
accattgcatttcagcctcagtgac

SEQ ID NO: 651082 - DNA, 25 bp, Homo sapien
tgctttataaagcaggaaaacccca

SEQ ID NO: 651083 - DNA, 25 bp, Homo sapien
cactggaacattttgggtgtttaca

SEQ ID NO: 651084 - DNA, 25 bp, Homo sapien
ctggaacattttgggtgtttacaga

SEQ ID NO: 651085 - DNA, 25 bp, Homo sapien
gtgtttacagaaatgggtattccat

SEQ ID NO: 651086 - DNA, 25 bp, Homo sapien
tacagaaatgggtattccatgggag

SEQ ID NO: 651087 - DNA, 25 bp, Homo sapien
atgggtattccatgggagagaacgt

SEQ ID NO: 651088 - DNA, 25 bp, Homo sapien
attccatgggagagaacgtggtaac

SEQ ID NO: 651089 - DNA, 25 bp, Homo sapien
catgggagagaacgtggtaacctat

SEQ ID NO: 651090 - DNA, 25 bp, Homo sapien
tgggagagaacgtggtaacctatgt

SEQ ID NO: 651091 - DNA, 25 bp, Homo sapien
ggagagaacgtggtaacctatgttt

SEQ ID NO: 651092 - DNA, 25 bp, Homo sapien
tcatcatttgtttaatcactgaaaa

SEQ ID NO: 651093 - DNA, 25 bp, Homo sapien
gtcagataactgaaccggcctctat

SEQ ID NO: 651094 - DNA, 25 bp, Homo sapien
tcagataactgaaccggcctctatc

SEQ ID NO: 651095 - DNA, 25 bp, Homo sapien
cagataactgaaccggcctctatcc

SEQ ID NO: 651096 - DNA, 25 bp, Homo sapien
gataactgaaccggcctctatcctt

SEQ ID NO: 651097 - DNA, 25 bp, Homo sapien
tgaaccggcctctatccttcccatt

SEQ ID NO: 651098 - DNA, 25 bp, Homo sapien
ttcccattgcaaggtaacctaaaag

SEQ ID NO: 651099 - DNA, 25 bp, Homo sapien
tgcaaggtaacctaaaagattcttt

SEQ ID NO: 651100 - DNA, 25 bp, Homo sapien
taaatttcctgtagttgtgctggat

SEQ ID NO: 651101 - DNA, 25 bp, Homo sapien
aatttcctgtagttgtgctggatga

SEQ ID NO: 651102 - DNA, 25 bp, Homo sapien
tttcctgtagttgtgctggatgagt

SEQ ID NO: 651103 - DNA, 25 bp, Homo sapien
gctggatgagtgtagtcagataact

SEQ ID NO: 651104 - DNA, 25 bp, Homo sapien
atgggagtggcaccagtcaccatca

SEQ ID NO: 651105 - DNA, 25 bp, Homo sapien
ttttttcctgttcttgagactttat

SEQ ID NO: 651106 - DNA, 25 bp, Homo sapien
tcttgagactttatgctttgctggc

SEQ ID NO: 651107 - DNA, 25 bp, Homo sapien
agactttatgctttgctggcctaga

SEQ ID NO: 651108 - DNA, 25 bp, Homo sapien
agaatgctgccaccagaagacaaaa

SEQ ID NO: 651109 - DNA, 25 bp, Homo sapien
gaagacaaaacaatgatttcactga

SEQ ID NO: 651110 - DNA, 25 bp, Homo sapien
ggctcttcatgcctttgagtcaaca

SEQ ID NO: 651111 - DNA, 25 bp, Homo sapien
catgcctttgagtcaacaggctaag

SEQ ID NO: 651112 - DNA, 25 bp, Homo sapien
aatagccaatgatcagtaactgtgc

SEQ ID NO: 651113 - DNA, 25 bp, Homo sapien
agtaactgtgcagagccaggatcaa

SEQ ID NO: 651114 - DNA, 25 bp, Homo sapien
gccaggatcaaaaactcaaatgccc

SEQ ID NO: 651115 - DNA, 25 bp, Homo sapien
ttcatatgaagtcttgcgctccagc

SEQ ID NO: 651116 - DNA, 25 bp, Homo sapien
ttgcttttcattctatagccagatt

SEQ ID NO: 651117 - DNA, 25 bp, Homo sapien
tcattctatagccagattttcttgt

SEQ ID NO: 651118 - DNA, 25 bp, Homo sapien
gaaaattgtcctggttccttcttga

SEQ ID NO: 651119 - DNA, 25 bp, Homo sapien
gtcctggttccttcttgaaactagt

SEQ ID NO: 651120 - DNA, 25 bp, Homo sapien
ttcttgaaactagtgagggaggcat

SEQ ID NO: 651121 - DNA, 25 bp, Homo sapien
aagaatgggctgtggcatcagagac

SEQ ID NO: 651122 - DNA, 25 bp, Homo sapien
ctgtggcatcagagacttgggttca

SEQ ID NO: 651123 - DNA, 25 bp, Homo sapien
gagacttgggttcagattcttggtc

SEQ ID NO: 651124 - DNA, 25 bp, Homo sapien
tcttggtctgttgtgttcattagcc

SEQ ID NO: 651125 - DNA, 25 bp, Homo sapien
ttgtgttcattagcctctgagagcc

SEQ ID NO: 651126 - DNA, 25 bp, Homo sapien
aagagtggcctcgtatgattttgag

SEQ ID NO: 651127 - DNA, 25 bp, Homo sapien
aagtctattccttgggacctatctc

SEQ ID NO: 651128 - DNA, 25 bp, Homo sapien
ctatctcagtcccttactctaggag

SEQ ID NO: 651129 - DNA, 25 bp, Homo sapien
cttactctaggagctccctgagcaa

SEQ ID NO: 651130 - DNA, 25 bp, Homo sapien
gtgactatagttactgagtcctcag

SEQ ID NO: 651131 - DNA, 25 bp, Homo sapien
tactgagtcctcagttcatctccac

SEQ ID NO: 651132 - DNA, 25 bp, Homo sapien
agtttgagaccaaactacctgccat

SEQ ID NO: 651133 - DNA, 25 bp, Homo sapien
ggcagtatactgtcttagagtcttg

SEQ ID NO: 651134 - DNA, 25 bp, Homo sapien
actgtcttagagtcttgtgcaaaca

SEQ ID NO: 651135 - DNA, 25 bp, Homo sapien
aacggtgaaacaggcacacttgtca

SEQ ID NO: 651136 - DNA, 25 bp, Homo sapien
gaaacaggcacacttgtcaaagagt

SEQ ID NO: 651137 - DNA, 25 bp, Homo sapien
gcagcaacgcgcacggacagcatct

SEQ ID NO: 651138 - DNA, 25 bp, Homo sapien
acgcgcacggacagcatctttgcag

SEQ ID NO: 651139 - DNA, 25 bp, Homo sapien
agcatctttgcagttactccgcagg

SEQ ID NO: 651140 - DNA, 25 bp, Homo sapien
tttgcagttactccgcaggcggtac

SEQ ID NO: 651141 - DNA, 25 bp, Homo sapien
gcaggcggtacttctgcagccgcag

SEQ ID NO: 651142 - DNA, 25 bp, Homo sapien
actgggacaaaatggccgagccgca

SEQ ID NO: 651143 - DNA, 25 bp, Homo sapien
atggccgagccgcaaagaaggtcaa

SEQ ID NO: 651144 - DNA, 25 bp, Homo sapien
aagaaggtcaagacagccggcccac

SEQ ID NO: 651145 - DNA, 25 bp, Homo sapien
gccgccactctgcattttttggcag

SEQ ID NO: 651146 - DNA, 25 bp, Homo sapien
gccactctgcattttttggcaggtt

SEQ ID NO: 651147 - DNA, 25 bp, Homo sapien
gcattttttggcaggttacttattt

SEQ ID NO: 651148 - DNA, 25 bp, Homo sapien
aaatttcatgattgctttccgtgat

SEQ ID NO: 651149 - DNA, 25 bp, Homo sapien
ttgctttccgtgatgtcattttgaa

SEQ ID NO: 651150 - DNA, 25 bp, Homo sapien
ctccagcaaggatccagctgtgact

SEQ ID NO: 651151 - DNA, 25 bp, Homo sapien
aaggatccagctgtgactcagggca

SEQ ID NO: 651152 - DNA, 25 bp, Homo sapien
gatccagctgtgactcagggcatgg

SEQ ID NO: 651153 - DNA, 25 bp, Homo sapien
agctgtgactcagggcatggctcaa

SEQ ID NO: 651154 - DNA, 25 bp, Homo sapien
tgactcagggcatggctcaaggaca

SEQ ID NO: 651155 - DNA, 25 bp, Homo sapien
tcagggcatggctcaaggacagtga

SEQ ID NO: 651156 - DNA, 25 bp, Homo sapien
cagtgatggcgtagggtgtaggcaa

SEQ ID NO: 651157 - DNA, 25 bp, Homo sapien
ggctatgcagttgtagtgggaactt

SEQ ID NO: 651158 - DNA, 25 bp, Homo sapien
cagttgtagtgggaacttcatttgg

SEQ ID NO: 651159 - DNA, 25 bp, Homo sapien
gatacttaaggtccatcctgctaca

SEQ ID NO: 651160 - DNA, 25 bp, Homo sapien
tgctacaacttccacaatggcgtct

SEQ ID NO: 651161 - DNA, 25 bp, Homo sapien
aatggcgtcttgaccatgagggctc

SEQ ID NO: 651162 - DNA, 25 bp, Homo sapien
gggctccacagacactgaagcggtc

SEQ ID NO: 651163 - DNA, 25 bp, Homo sapien
gacactgaagcggtcacccaggctg

SEQ ID NO: 651164 - DNA, 25 bp, Homo sapien
tcacccaggctgcaagtcttggaag

SEQ ID NO: 651165 - DNA, 25 bp, Homo sapien
cttggaagcattctctaggaatcac

SEQ ID NO: 651166 - DNA, 25 bp, Homo sapien
agtcccattcttctgcaggcaaacg

SEQ ID NO: 651167 - DNA, 25 bp, Homo sapien
aaacggagtcgccatatgacccagt

SEQ ID NO: 651168 - DNA, 25 bp, Homo sapien
atgacccagtaagtttactcttagg

SEQ ID NO: 651169 - DNA, 25 bp, Homo sapien
gtttactcttaggtacattccctag

SEQ ID NO: 651170 - DNA, 25 bp, Homo sapien
tcaatcccttgacctcgcaatctac

SEQ ID NO: 651171 - DNA, 25 bp, Homo sapien
ggccctgctgtactctggctttaaa

SEQ ID NO: 651172 - DNA, 25 bp, Homo sapien
gccctgctgtactctggctttaaag

SEQ ID NO: 651173 - DNA, 25 bp, Homo sapien
ccctgctgtactctggctttaaagg

SEQ ID NO: 651174 - DNA, 25 bp, Homo sapien
cctgctgtactctggctttaaaggt

SEQ ID NO: 651175 - DNA, 25 bp, Homo sapien
ctgctgtactctggctttaaaggta

SEQ ID NO: 651176 - DNA, 25 bp, Homo sapien
ctgtactctggctttaaaggtaatg

SEQ ID NO: 651177 - DNA, 25 bp, Homo sapien
gtactctggctttaaaggtaatgta

SEQ ID NO: 651178 - DNA, 25 bp, Homo sapien
ctggctttaaaggtaatgtacgctt

SEQ ID NO: 651179 - DNA, 25 bp, Homo sapien
aaaggtaatgtacgcttagtgaata

SEQ ID NO: 651180 - DNA, 25 bp, Homo sapien
taatgtacgcttagtgaatacaggg

SEQ ID NO: 651181 - DNA, 25 bp, Homo sapien
caatcagataaaaagttgtcgggcc

SEQ ID NO: 651182 - DNA, 25 bp, Homo sapien
aatcagataaaaagttgtcgggcca

SEQ ID NO: 651183 - DNA, 25 bp, Homo sapien
atcagataaaaagttgtcgggccag

SEQ ID NO: 651184 - DNA, 25 bp, Homo sapien
tcagataaaaagttgtcgggccagt

SEQ ID NO: 651185 - DNA, 25 bp, Homo sapien
cagataaaaagttgtcgggccagtc

SEQ ID NO: 651186 - DNA, 25 bp, Homo sapien
agataaaaagttgtcgggccagtcg

SEQ ID NO: 651187 - DNA, 25 bp, Homo sapien
gataaaaagttgtcgggccagtcgt

SEQ ID NO: 651188 - DNA, 25 bp, Homo sapien
ataaaaagttgtcgggccagtcgtg

SEQ ID NO: 651189 - DNA, 25 bp, Homo sapien
taaaaagttgtcgggccagtcgtgg

SEQ ID NO: 651190 - DNA, 25 bp, Homo sapien
aaaagttgtcgggccagtcgtggtg

SEQ ID NO: 651191 - DNA, 25 bp, Homo sapien
aagttgtcgggccagtcgtggtggc

SEQ ID NO: 651192 - DNA, 25 bp, Homo sapien
tacccttctcatttactttaagaat

SEQ ID NO: 651193 - DNA, 25 bp, Homo sapien
atgaattcttctatccaaacacttg

SEQ ID NO: 651194 - DNA, 25 bp, Homo sapien
ttctatccaaacacttggctaggtt

SEQ ID NO: 651195 - DNA, 25 bp, Homo sapien
aacacttggctaggttgatcatggg

SEQ ID NO: 651196 - DNA, 25 bp, Homo sapien
agagctctggtctgagcggtgtcct

SEQ ID NO: 651197 - DNA, 25 bp, Homo sapien
gagcggtgtcctcaacatggcagac

SEQ ID NO: 651198 - DNA, 25 bp, Homo sapien
ggtgtcctcaacatggcagacctcc

SEQ ID NO: 651199 - DNA, 25 bp, Homo sapien
acctccatccctctgggagtttgag

SEQ ID NO: 651200 - DNA, 25 bp, Homo sapien
cccagccaggacagcttgtcagggc

SEQ ID NO: 651201 - DNA, 25 bp, Homo sapien
cccagggcctggatctagcagaggt

SEQ ID NO: 651202 - DNA, 25 bp, Homo sapien
ctagcagaggtgtttggcagcattt

SEQ ID NO: 651203 - DNA, 25 bp, Homo sapien
tgatatgggcggaattcagaggaca

SEQ ID NO: 651204 - DNA, 25 bp, Homo sapien
gtgtctactcatacatagaattgcc

SEQ ID NO: 651205 - DNA, 25 bp, Homo sapien
agaattgcctagaagctaatatttg

SEQ ID NO: 651206 - DNA, 25 bp, Homo sapien
taccatattactgttggctttctat

SEQ ID NO: 651207 - DNA, 25 bp, Homo sapien
attactgttggctttctatttttct

SEQ ID NO: 651208 - DNA, 25 bp, Homo sapien
tttctatttttctcatttgttctgt

SEQ ID NO: 651209 - DNA, 25 bp, Homo sapien
gtttcttttctgtccttttgtgcct

SEQ ID NO: 651210 - DNA, 25 bp, Homo sapien
tccttttgtgccttcttgtagatta

SEQ ID NO: 651211 - DNA, 25 bp, Homo sapien
gtagattattaattccactcccttg

SEQ ID NO: 651212 - DNA, 25 bp, Homo sapien
aattccactcccttgtaacaattag

SEQ ID NO: 651213 - DNA, 25 bp, Homo sapien
acattctttatgcttttagtagtat

SEQ ID NO: 651214 - DNA, 25 bp, Homo sapien
gtggttagaagacatactagatctg

SEQ ID NO: 651215 - DNA, 25 bp, Homo sapien
actagatctgtcaattgtattattt

SEQ ID NO: 651216 - DNA, 25 bp, Homo sapien
ctatacagattgcactggtggcttc

SEQ ID NO: 651217 - DNA, 25 bp, Homo sapien
catggtcatggctgatattcagtac

SEQ ID NO: 651218 - DNA, 25 bp, Homo sapien
gatattcagtacaagtggttcacag

SEQ ID NO: 651219 - DNA, 25 bp, Homo sapien
gtagaagaggctccatggtacacct

SEQ ID NO: 651220 - DNA, 25 bp, Homo sapien
agaggctccatggtacaccttgaga

SEQ ID NO: 651221 - DNA, 25 bp, Homo sapien
ggtacaccttgagaggttgctttct

SEQ ID NO: 651222 - DNA, 25 bp, Homo sapien
gaggttgctttctcagacactagtt

SEQ ID NO: 651223 - DNA, 25 bp, Homo sapien
gctttctcagacactagtttatttt

SEQ ID NO: 651224 - DNA, 25 bp, Homo sapien
atacctgcaagatatatcatatgtc

SEQ ID NO: 651225 - DNA, 25 bp, Homo sapien
ttgaatccatcatcaaggaagcagc

SEQ ID NO: 651226 - DNA, 25 bp, Homo sapien
atcttcgaaatgcttgaaggagtgc

SEQ ID NO: 651227 - DNA, 25 bp, Homo sapien
ttgaaggagtgcaaggacctactgc

SEQ ID NO: 651228 - DNA, 25 bp, Homo sapien
tgaaggagtgcaaggacctactgca

SEQ ID NO: 651229 - DNA, 25 bp, Homo sapien
gagtgcaaggacctactgcagtcag

SEQ ID NO: 651230 - DNA, 25 bp, Homo sapien
agtgcaaggacctactgcagtcagg

SEQ ID NO: 651231 - DNA, 25 bp, Homo sapien
gtgcaaggacctactgcagtcagga

SEQ ID NO: 651232 - DNA, 25 bp, Homo sapien
tgcaaggacctactgcagtcaggaa

SEQ ID NO: 651233 - DNA, 25 bp, Homo sapien
cgattttttgaatccatcatcaagg

SEQ ID NO: 651234 - DNA, 25 bp, Homo sapien
gattttttgaatccatcatcaagga

SEQ ID NO: 651235 - DNA, 25 bp, Homo sapien
tttttgaatccatcatcaaggaagc

SEQ ID NO: 651236 - DNA, 25 bp, Homo sapien
ggaaaatatactggagtggttaatc

SEQ ID NO: 651237 - DNA, 25 bp, Homo sapien
gaaaatatactggagtggttaatca

SEQ ID NO: 651238 - DNA, 25 bp, Homo sapien
aaaatatactggagtggttaatcag

SEQ ID NO: 651239 - DNA, 25 bp, Homo sapien
aaatatactggagtggttaatcaga

SEQ ID NO: 651240 - DNA, 25 bp, Homo sapien
aatatactggagtggttaatcagat

SEQ ID NO: 651241 - DNA, 25 bp, Homo sapien
atatactggagtggttaatcagatt

SEQ ID NO: 651242 - DNA, 25 bp, Homo sapien
tatactggagtggttaatcagattt

SEQ ID NO: 651243 - DNA, 25 bp, Homo sapien
atactggagtggttaatcagatttt

SEQ ID NO: 651244 - DNA, 25 bp, Homo sapien
tactggagtggttaatcagattttc

SEQ ID NO: 651245 - DNA, 25 bp, Homo sapien
aaagatttagagactgccagagacc

SEQ ID NO: 651246 - DNA, 25 bp, Homo sapien
gagactgccagagaccactggagat

SEQ ID NO: 651247 - DNA, 25 bp, Homo sapien
aaatgactgccatcttctgacaaga

SEQ ID NO: 651248 - DNA, 25 bp, Homo sapien
tgacaagatctgcagaccaccccaa

SEQ ID NO: 651249 - DNA, 25 bp, Homo sapien
ggctcttttgtgcatcctatgaggg

SEQ ID NO: 651250 - DNA, 25 bp, Homo sapien
gtgcatcctatgagggactgtattt

SEQ ID NO: 651251 - DNA, 25 bp, Homo sapien
gacagctggtagttggtgaagatca

SEQ ID NO: 651252 - DNA, 25 bp, Homo sapien
ggaatgatcttcaaactactcagaa

SEQ ID NO: 651253 - DNA, 25 bp, Homo sapien
aaactactcagaatcaggtcatatt

SEQ ID NO: 651254 - DNA, 25 bp, Homo sapien
aaaactgcacacattactaaatcat

SEQ ID NO: 651255 - DNA, 25 bp, Homo sapien
tatatttaattctcgaacctttagg

SEQ ID NO: 651256 - DNA, 25 bp, Homo sapien
gttggaccctaaccttacctcatat

SEQ ID NO: 651257 - DNA, 25 bp, Homo sapien
ccctaaccttacctcatatgcaaaa

SEQ ID NO: 651258 - DNA, 25 bp, Homo sapien
ttacctcatatgcaaaaattacctc

SEQ ID NO: 651259 - DNA, 25 bp, Homo sapien
gattaaaggcctaacttgaagaact

SEQ ID NO: 651260 - DNA, 25 bp, Homo sapien
aaacagggacaaatcttcatgacaa

SEQ ID NO: 651261 - DNA, 25 bp, Homo sapien
agggacaaatcttcatgacaaatat

SEQ ID NO: 651262 - DNA, 25 bp, Homo sapien
atgaagagtctcagcatccttagtc

SEQ ID NO: 651263 - DNA, 25 bp, Homo sapien
gaagagtctcagcatccttagtcat

SEQ ID NO: 651264 - DNA, 25 bp, Homo sapien
gagtctcagcatccttagtcattag

SEQ ID NO: 651265 - DNA, 25 bp, Homo sapien
gcaaatcaaaaacacagtgagctgt

SEQ ID NO: 651266 - DNA, 25 bp, Homo sapien
agtgagctgtgacttcatgcttact

SEQ ID NO: 651267 - DNA, 25 bp, Homo sapien
acaactttaagaagtcaaggaacat

SEQ ID NO: 651268 - DNA, 25 bp, Homo sapien
gagatctgggttggagatgtaaatt

SEQ ID NO: 651269 - DNA, 25 bp, Homo sapien
taatgggaatccttaaaggactaca

SEQ ID NO: 651270 - DNA, 25 bp, Homo sapien
aaaatggtctaaggactgatcccca

SEQ ID NO: 651271 - DNA, 25 bp, Homo sapien
tggtctaaggactgatccccatgac

SEQ ID NO: 651272 - DNA, 25 bp, Homo sapien
gtctaaggactgatccccatgacat

SEQ ID NO: 651273 - DNA, 25 bp, Homo sapien
ctaaggactgatccccatgacatgc

SEQ ID NO: 651274 - DNA, 25 bp, Homo sapien
aggactgatccccatgacatgccaa

SEQ ID NO: 651275 - DNA, 25 bp, Homo sapien
gatccccatgacatgccaactttaa

SEQ ID NO: 651276 - DNA, 25 bp, Homo sapien
catgacatgccaactttaacaactt

SEQ ID NO: 651277 - DNA, 25 bp, Homo sapien
gacatgccaactttaacaactttaa

SEQ ID NO: 651278 - DNA, 25 bp, Homo sapien
tgtaaaataaactccaaggccactt

SEQ ID NO: 651279 - DNA, 25 bp, Homo sapien
aattcaggacacttaattctccagg

SEQ ID NO: 651280 - DNA, 25 bp, Homo sapien
aggacacttaattctccaggtgaca

SEQ ID NO: 651281 - DNA, 25 bp, Homo sapien
tctccaggtgacagctaaattattt

SEQ ID NO: 651282 - DNA, 25 bp, Homo sapien
tttggattgaggatacatgcctgca

SEQ ID NO: 651283 - DNA, 25 bp, Homo sapien
acatgcctgcattttcagtctggac

SEQ ID NO: 651284 - DNA, 25 bp, Homo sapien
gcctgcattttcagtctggacctaa

SEQ ID NO: 651285 - DNA, 25 bp, Homo sapien
ttcagtctggacctaaagagagaaa

SEQ ID NO: 651286 - DNA, 25 bp, Homo sapien
ggaaattgataaacagaacccaagt

SEQ ID NO: 651287 - DNA, 25 bp, Homo sapien
gaacccaagtttatctttgttgctg

SEQ ID NO: 651288 - DNA, 25 bp, Homo sapien
caagtttatctttgttgctgttgtt

SEQ ID NO: 651289 - DNA, 25 bp, Homo sapien
tactgagtttagatcatacccattt

SEQ ID NO: 651290 - DNA, 25 bp, Homo sapien
tagacattctcatacatctctccag

SEQ ID NO: 651291 - DNA, 25 bp, Homo sapien
atacatctctccagtgtggttttct

SEQ ID NO: 651292 - DNA, 25 bp, Homo sapien
tctccagtgtggttttcttcatata

SEQ ID NO: 651293 - DNA, 25 bp, Homo sapien
catcacttctttttgaaagttccta

SEQ ID NO: 651294 - DNA, 25 bp, Homo sapien
ttatcaacatttagtattttcagtc

SEQ ID NO: 651295 - DNA, 25 bp, Homo sapien
aatcgtatcttaatgtcgggtttat

SEQ ID NO: 651296 - DNA, 25 bp, Homo sapien
atttgtccttctttgatgaccaata

SEQ ID NO: 651297 - DNA, 25 bp, Homo sapien
catttgttgaccatttaggcctttt

SEQ ID NO: 651298 - DNA, 25 bp, Homo sapien
tgttgaccatttaggccttttcttt

SEQ ID NO: 651299 - DNA, 25 bp, Homo sapien
tttcttttctcagtgattgttcatt

SEQ ID NO: 651300 - DNA, 25 bp, Homo sapien
tagctgcggactgctcacaacggag

SEQ ID NO: 651301 - DNA, 25 bp, Homo sapien
aacggagtctcttctagggattgcc

SEQ ID NO: 651302 - DNA, 25 bp, Homo sapien
tagggattgccctcaaccgaaggaa

SEQ ID NO: 651303 - DNA, 25 bp, Homo sapien
aaccgaaggaagctgcattgcccaa

SEQ ID NO: 651304 - DNA, 25 bp, Homo sapien
tgcattgcccaagatgagatcccct

SEQ ID NO: 651305 - DNA, 25 bp, Homo sapien
gggcatcctgcatccaatgacaagt

SEQ ID NO: 651306 - DNA, 25 bp, Homo sapien
tggcttcctcatctcgattggacat

SEQ ID NO: 651307 - DNA, 25 bp, Homo sapien
tgatctccccgtagaatctcctgaa

SEQ ID NO: 651308 - DNA, 25 bp, Homo sapien
gaagcctctgttgtgactgcatcag

SEQ ID NO: 651309 - DNA, 25 bp, Homo sapien
ttgtgactgcatcagagcccaacct

SEQ ID NO: 651310 - DNA, 25 bp, Homo sapien
ttccttctcacaggtgttgttccca

SEQ ID NO: 651311 - DNA, 25 bp, Homo sapien
gggtgcctacatgatcaaccttcaa

SEQ ID NO: 651312 - DNA, 25 bp, Homo sapien
gtgcctacatgatcaaccttcaata

SEQ ID NO: 651313 - DNA, 25 bp, Homo sapien
gcctacatgatcaaccttcaatata

SEQ ID NO: 651314 - DNA, 25 bp, Homo sapien
gatcaaccttcaatataaaacacct

SEQ ID NO: 651315 - DNA, 25 bp, Homo sapien
aacacctccccctagcgaaatgtgt

SEQ ID NO: 651316 - DNA, 25 bp, Homo sapien
cccctagcgaaatgtgtaaagtatt

SEQ ID NO: 651317 - DNA, 25 bp, Homo sapien
ttgccataatgggtgagttcaaact

SEQ ID NO: 651318 - DNA, 25 bp, Homo sapien
gccataatgggtgagttcaaactaa

SEQ ID NO: 651319 - DNA, 25 bp, Homo sapien
aatgggtgagttcaaactaaaagca

SEQ ID NO: 651320 - DNA, 25 bp, Homo sapien
aaaagcatttttcagcaataattaa

SEQ ID NO: 651321 - DNA, 25 bp, Homo sapien
gcatttttcagcaataattaaagga

SEQ ID NO: 651322 - DNA, 25 bp, Homo sapien
gaagaaggctatcaatgatctagac

SEQ ID NO: 651323 - DNA, 25 bp, Homo sapien
ggctatcaatgatctagacagagac

SEQ ID NO: 651324 - DNA, 25 bp, Homo sapien
tcaatgatctagacagagacttttg

SEQ ID NO: 651325 - DNA, 25 bp, Homo sapien
acagagacttttggaataacaatga

SEQ ID NO: 651326 - DNA, 25 bp, Homo sapien
ataacaatgagagcacagtgcagca

SEQ ID NO: 651327 - DNA, 25 bp, Homo sapien
atgagagcacagtgcagcagaaatg

SEQ ID NO: 651328 - DNA, 25 bp, Homo sapien
agcagaaatggagctcctaccctcc

SEQ ID NO: 651329 - DNA, 25 bp, Homo sapien
gctcctaccctcccaaggagtttat

SEQ ID NO: 651330 - DNA, 25 bp, Homo sapien
ctcccaaggagtttattctaaacat

SEQ ID NO: 651331 - DNA, 25 bp, Homo sapien
aacatttcaccctacgccccttatg

SEQ ID NO: 651332 - DNA, 25 bp, Homo sapien
ttatggcgacccacgactgtccctc

SEQ ID NO: 651333 - DNA, 25 bp, Homo sapien
caggaaaggagctgtccaggacaat

SEQ ID NO: 651334 - DNA, 25 bp, Homo sapien
ggaaagacaggccacggccttgcct

SEQ ID NO: 651335 - DNA, 25 bp, Homo sapien
tctgtgccagctctcatgggccagg

SEQ ID NO: 651336 - DNA, 25 bp, Homo sapien
ggccaggcagagtatcccaggacaa

SEQ ID NO: 651337 - DNA, 25 bp, Homo sapien
gagtatcccaggacaactgcctcca

SEQ ID NO: 651338 - DNA, 25 bp, Homo sapien
agctccatccttcatcagcaattca

SEQ ID NO: 651339 - DNA, 25 bp, Homo sapien
gattaacaaatctgtaccccaggag

SEQ ID NO: 651340 - DNA, 25 bp, Homo sapien
atctgtaccccaggaggttatgcca

SEQ ID NO: 651341 - DNA, 25 bp, Homo sapien
ggaggttatgccaagtccaacttct

SEQ ID NO: 651342 - DNA, 25 bp, Homo sapien
ttcttccagagaccacaacaataaa

SEQ ID NO: 651343 - DNA, 25 bp, Homo sapien
aacaataaatccaagccactgctaa

SEQ ID NO: 651344 - DNA, 25 bp, Homo sapien
ctcatgaaatagttatcttaggcca

SEQ ID NO: 651345 - DNA, 25 bp, Homo sapien
tcatgaaatagttatcttaggccag

SEQ ID NO: 651346 - DNA, 25 bp, Homo sapien
catgaaatagttatcttaggccagg

SEQ ID NO: 651347 - DNA, 25 bp, Homo sapien
ttagccagacatgattgtgcgcgcc

SEQ ID NO: 651348 - DNA, 25 bp, Homo sapien
tagccagacatgattgtgcgcgcct

SEQ ID NO: 651349 - DNA, 25 bp, Homo sapien
agccagacatgattgtgcgcgcctg

SEQ ID NO: 651350 - DNA, 25 bp, Homo sapien
gccagacatgattgtgcgcgcctgt

SEQ ID NO: 651351 - DNA, 25 bp, Homo sapien
ccagacatgattgtgcgcgcctgta

SEQ ID NO: 651352 - DNA, 25 bp, Homo sapien
cagacatgattgtgcgcgcctgtaa

SEQ ID NO: 651353 - DNA, 25 bp, Homo sapien
agacatgattgtgcgcgcctgtaat

SEQ ID NO: 651354 - DNA, 25 bp, Homo sapien
gaaagtgtctcaaaccacaactaag

SEQ ID NO: 651355 - DNA, 25 bp, Homo sapien
gaagcacttcaacggaccagaggtc

SEQ ID NO: 651356 - DNA, 25 bp, Homo sapien
ggaccagaggtcaagtaactttaca

SEQ ID NO: 651357 - DNA, 25 bp, Homo sapien
aagtaactttacactgcttaacata

SEQ ID NO: 651358 - DNA, 25 bp, Homo sapien
ggatcttaatttaacagtagacaca

SEQ ID NO: 651359 - DNA, 25 bp, Homo sapien
gctatacatagagccagaacttcct

SEQ ID NO: 651360 - DNA, 25 bp, Homo sapien
gagccagaacttcctacaagtacct

SEQ ID NO: 651361 - DNA, 25 bp, Homo sapien
aaagctgtgagttgtattttggcca

SEQ ID NO: 651362 - DNA, 25 bp, Homo sapien
gtattttggccacttaatcactgaa

SEQ ID NO: 651363 - DNA, 25 bp, Homo sapien
cactgaatatttacccacggacctt

SEQ ID NO: 651364 - DNA, 25 bp, Homo sapien
tgaatatttacccacggacctttca

SEQ ID NO: 651365 - DNA, 25 bp, Homo sapien
ggaccacaccgcagcgtaactgcag

SEQ ID NO: 651366 - DNA, 25 bp, Homo sapien
ctgcaggcctctcagcgaaaaaggg

SEQ ID NO: 651367 - DNA, 25 bp, Homo sapien
gcaaagacccgggtgtgcatcctct

SEQ ID NO: 651368 - DNA, 25 bp, Homo sapien
aaagacccgggtgtgcatcctcttc

SEQ ID NO: 651369 - DNA, 25 bp, Homo sapien
gggtgtgcatcctcttcctcggctt

SEQ ID NO: 651370 - DNA, 25 bp, Homo sapien
ctttccggcggagtggagatcctat

SEQ ID NO: 651371 - DNA, 25 bp, Homo sapien
tccggcggagtggagatcctattca

SEQ ID NO: 651372 - DNA, 25 bp, Homo sapien
cggcggagtggagatcctattcaga

SEQ ID NO: 651373 - DNA, 25 bp, Homo sapien
gatcctattcagaggggccggtctc

SEQ ID NO: 651374 - DNA, 25 bp, Homo sapien
ggccggtctctctaaatatgcccca

SEQ ID NO: 651375 - DNA, 25 bp, Homo sapien
gccggtctctctaaatatgccccag

SEQ ID NO: 651376 - DNA, 25 bp, Homo sapien
actaaaaaaatctgcactggggtcg

SEQ ID NO: 651377 - DNA, 25 bp, Homo sapien
ctaaaaaaatctgcactggggtcgg

SEQ ID NO: 651378 - DNA, 25 bp, Homo sapien
taaaaaaatctgcactggggtcggg

SEQ ID NO: 651379 - DNA, 25 bp, Homo sapien
aaaaaatctgcactggggtcgggca

SEQ ID NO: 651380 - DNA, 25 bp, Homo sapien
aaaaatctgcactggggtcgggcac

SEQ ID NO: 651381 - DNA, 25 bp, Homo sapien
aaaatctgcactggggtcgggcaca

SEQ ID NO: 651382 - DNA, 25 bp, Homo sapien
aaatctgcactggggtcgggcacag

SEQ ID NO: 651383 - DNA, 25 bp, Homo sapien
aatctgcactggggtcgggcacagt

SEQ ID NO: 651384 - DNA, 25 bp, Homo sapien
atctgcactggggtcgggcacagtg

SEQ ID NO: 651385 - DNA, 25 bp, Homo sapien
tgcactggggtcgggcacagtggct

SEQ ID NO: 651386 - DNA, 25 bp, Homo sapien
gcactggggtcgggcacagtggctc

SEQ ID NO: 651387 - DNA, 25 bp, Homo sapien
ttgaatccatcatcaaggaagcagc

SEQ ID NO: 651388 - DNA, 25 bp, Homo sapien
cagcaaggtgggtagaaataggaac

SEQ ID NO: 651389 - DNA, 25 bp, Homo sapien
gtgggtagaaataggaactgtccaa

SEQ ID NO: 651390 - DNA, 25 bp, Homo sapien
ggtagaaataggaactgtccaattt

SEQ ID NO: 651391 - DNA, 25 bp, Homo sapien
taggaactgtccaatttcttttaat

SEQ ID NO: 651392 - DNA, 25 bp, Homo sapien
ggaactgtccaatttcttttaatca

SEQ ID NO: 651393 - DNA, 25 bp, Homo sapien
gtccaatttcttttaatcactattt

SEQ ID NO: 651394 - DNA, 25 bp, Homo sapien
ttgaaggagtgcaaggacctactgc

SEQ ID NO: 651395 - DNA, 25 bp, Homo sapien
gcaaggacctactgcagtcaggaag

SEQ ID NO: 651396 - DNA, 25 bp, Homo sapien
actgcagtcaggaagcgattttttg

SEQ ID NO: 651397 - DNA, 25 bp, Homo sapien
ggaagcgattttttgaatccatcat

SEQ ID NO: 651398 - DNA, 25 bp, Homo sapien
catgaatttaatgcctctgctgaaa

SEQ ID NO: 651399 - DNA, 25 bp, Homo sapien
gcctctgctgaaattttagtcccca

SEQ ID NO: 651400 - DNA, 25 bp, Homo sapien
tgaaattttagtccccaccaggaga

SEQ ID NO: 651401 - DNA, 25 bp, Homo sapien
ccacattcccagtgcaagcaaaagg

SEQ ID NO: 651402 - DNA, 25 bp, Homo sapien
agtgcaagcaaaaggaattcctgcc

SEQ ID NO: 651403 - DNA, 25 bp, Homo sapien
gagggatgctttagaacatgtcttt

SEQ ID NO: 651404 - DNA, 25 bp, Homo sapien
catgtcttttgttggttattttgca

SEQ ID NO: 651405 - DNA, 25 bp, Homo sapien
ttgcctcccaattcagcacagcaat

SEQ ID NO: 651406 - DNA, 25 bp, Homo sapien
tctttcaactacaatgctttccctg

SEQ ID NO: 651407 - DNA, 25 bp, Homo sapien
aactacaatgctttccctgagatga

SEQ ID NO: 651408 - DNA, 25 bp, Homo sapien
aatgctttccctgagatgaagtcat

SEQ ID NO: 651409 - DNA, 25 bp, Homo sapien
aacattttattacagtcaccctcat

SEQ ID NO: 651410 - DNA, 25 bp, Homo sapien
tttattacagtcaccctcatttgtt

SEQ ID NO: 651411 - DNA, 25 bp, Homo sapien
ggcagcttttgtgttatgttagcag

SEQ ID NO: 651412 - DNA, 25 bp, Homo sapien
tgtgttatgttagcagagttgagta

SEQ ID NO: 651413 - DNA, 25 bp, Homo sapien
gagttgagtagtttcagcaaagacc

SEQ ID NO: 651414 - DNA, 25 bp, Homo sapien
ggtctgcagagactgaaatatgtat

SEQ ID NO: 651415 - DNA, 25 bp, Homo sapien
gaaatatgtattgtatggcccttta

SEQ ID NO: 651416 - DNA, 25 bp, Homo sapien
atatgtattgtatggccctttacag

SEQ ID NO: 651417 - DNA, 25 bp, Homo sapien
ttgctgacctctactttatgacatt

SEQ ID NO: 651418 - DNA, 25 bp, Homo sapien
gacctctactttatgacattctcaa

SEQ ID NO: 651419 - DNA, 25 bp, Homo sapien
aaagaatggcttaaattcagcttta

SEQ ID NO: 651420 - DNA, 25 bp, Homo sapien
caaggcagggagaataggatgggaa

SEQ ID NO: 651421 - DNA, 25 bp, Homo sapien
gggaagggctgtaaccacaccagat

SEQ ID NO: 651422 - DNA, 25 bp, Homo sapien
ggaagggctgtaaccacaccagatg

SEQ ID NO: 651423 - DNA, 25 bp, Homo sapien
gaagggctgtaaccacaccagatgc

SEQ ID NO: 651424 - DNA, 25 bp, Homo sapien
aagggctgtaaccacaccagatgcg

SEQ ID NO: 651425 - DNA, 25 bp, Homo sapien
agggctgtaaccacaccagatgcgg

SEQ ID NO: 651426 - DNA, 25 bp, Homo sapien
gggctgtaaccacaccagatgcggt

SEQ ID NO: 651427 - DNA, 25 bp, Homo sapien
ggctgtaaccacaccagatgcggtg

SEQ ID NO: 651428 - DNA, 25 bp, Homo sapien
gctgtaaccacaccagatgcggtgg

SEQ ID NO: 651429 - DNA, 25 bp, Homo sapien
ctgtaaccacaccagatgcggtggc

SEQ ID NO: 651430 - DNA, 25 bp, Homo sapien
tgtaaccacaccagatgcggtggct

SEQ ID NO: 651431 - DNA, 25 bp, Homo sapien
acgggcccacggtgagcttgctgct

SEQ ID NO: 651432 - DNA, 25 bp, Homo sapien
cttgctgctgcatcgggaagacttc

SEQ ID NO: 651433 - DNA, 25 bp, Homo sapien
ggaagacttccgtggatacgccctg

SEQ ID NO: 651434 - DNA, 25 bp, Homo sapien
tgccctggctcctgaaccagtataa

SEQ ID NO: 651435 - DNA, 25 bp, Homo sapien
gatttccatgtcactcagagcctaa

SEQ ID NO: 651436 - DNA, 25 bp, Homo sapien
aacaaatactgactgcagcagttct

SEQ ID NO: 651437 - DNA, 25 bp, Homo sapien
ttctttatgacattggccttccaag

SEQ ID NO: 651438 - DNA, 25 bp, Homo sapien
gacattggccttccaaggagcttga

SEQ ID NO: 651439 - DNA, 25 bp, Homo sapien
atccatctttatcaatttactccag

SEQ ID NO: 651440 - DNA, 25 bp, Homo sapien
tcaatttactccagcagatctgcag

SEQ ID NO: 651441 - DNA, 25 bp, Homo sapien
gcttcaagctgttttctcattctag

SEQ ID NO: 651442 - DNA, 25 bp, Homo sapien
actgtttttggctgagacttggttc

SEQ ID NO: 651443 - DNA, 25 bp, Homo sapien
ttttggctgagacttggttcatttg

SEQ ID NO: 651444 - DNA, 25 bp, Homo sapien
ttttaagggtgcttgtcattgctcc

SEQ ID NO: 651445 - DNA, 25 bp, Homo sapien
gcttgtcattgctccttgaagcatt

SEQ ID NO: 651446 - DNA, 25 bp, Homo sapien
gcattttgtcgtggctgctttaaaa

SEQ ID NO: 651447 - DNA, 25 bp, Homo sapien
aaaatgtttgtcaggtagtgccagc

SEQ ID NO: 651448 - DNA, 25 bp, Homo sapien
gtttgtcaggtagtgccagcaccag

SEQ ID NO: 651449 - DNA, 25 bp, Homo sapien
agcaccagtgtcgtcttggcattgg

SEQ ID NO: 651450 - DNA, 25 bp, Homo sapien
tgtcgtcttggcattggcaggtatt

SEQ ID NO: 651451 - DNA, 25 bp, Homo sapien
gcattggcaggtattgtctttttgt

SEQ ID NO: 651452 - DNA, 25 bp, Homo sapien
cccttgcggtaagtattacagttct

SEQ ID NO: 651453 - DNA, 25 bp, Homo sapien
tggagactagcagaggtacttggaa

SEQ ID NO: 651454 - DNA, 25 bp, Homo sapien
ggaaatgtacatcttatagctacca

SEQ ID NO: 651455 - DNA, 25 bp, Homo sapien
tcttatagctaccaagacttgctgc

SEQ ID NO: 651456 - DNA, 25 bp, Homo sapien
gacttgctgctggtgtgaatgttca

SEQ ID NO: 651457 - DNA, 25 bp, Homo sapien
gctgctggtgtgaatgttcaggtaa

SEQ ID NO: 651458 - DNA, 25 bp, Homo sapien
aatcaagaatggctctaggctgggt

SEQ ID NO: 651459 - DNA, 25 bp, Homo sapien
actttgagaaccgaggcggatggat

SEQ ID NO: 651460 - DNA, 25 bp, Homo sapien
gaggaaggttcatctgaattgcaga

SEQ ID NO: 651461 - DNA, 25 bp, Homo sapien
aagcagagagcccagttaggagcta

SEQ ID NO: 651462 - DNA, 25 bp, Homo sapien
gagcccagttaggagctactacaac

SEQ ID NO: 651463 - DNA, 25 bp, Homo sapien
gagctactacaactatccaggcaag

SEQ ID NO: 651464 - DNA, 25 bp, Homo sapien
gaaatccaggcccttgagcaatgta

SEQ ID NO: 651465 - DNA, 25 bp, Homo sapien
aatccaggcccttgagcaatgtatt

SEQ ID NO: 651466 - DNA, 25 bp, Homo sapien
ccaggcccttgagcaatgtattgat

SEQ ID NO: 651467 - DNA, 25 bp, Homo sapien
ggcccttgagcaatgtattgatgaa

SEQ ID NO: 651468 - DNA, 25 bp, Homo sapien
aaacgatggcggcactggactgttt

SEQ ID NO: 651469 - DNA, 25 bp, Homo sapien
acgatggcggcactggactgttttc

SEQ ID NO: 651470 - DNA, 25 bp, Homo sapien
atggcggcactggactgttttccag

SEQ ID NO: 651471 - DNA, 25 bp, Homo sapien
gactgttttccagaaaccatttaca

SEQ ID NO: 651472 - DNA, 25 bp, Homo sapien
tacacaggctcaccagaagagggca

SEQ ID NO: 651473 - DNA, 25 bp, Homo sapien
agtgaaaatctctgcatgaaagtag

SEQ ID NO: 651474 - DNA, 25 bp, Homo sapien
atctctgcatgaaagtagccgtttt

SEQ ID NO: 651475 - DNA, 25 bp, Homo sapien
taaaaatacacaaattaggggctgg

SEQ ID NO: 651476 - DNA, 25 bp, Homo sapien
aaatacacaaattaggggctgggca

SEQ ID NO: 651477 - DNA, 25 bp, Homo sapien
aatacacaaattaggggctgggcac

SEQ ID NO: 651478 - DNA, 25 bp, Homo sapien
atacacaaattaggggctgggcaca

SEQ ID NO: 651479 - DNA, 25 bp, Homo sapien
tacacaaattaggggctgggcacag

SEQ ID NO: 651480 - DNA, 25 bp, Homo sapien
acacaaattaggggctgggcacagt

SEQ ID NO: 651481 - DNA, 25 bp, Homo sapien
cacaaattaggggctgggcacagtg

SEQ ID NO: 651482 - DNA, 25 bp, Homo sapien
acaaattaggggctgggcacagtgg

SEQ ID NO: 651483 - DNA, 25 bp, Homo sapien
ggcaggagaatctgggaggcagagg

SEQ ID NO: 651484 - DNA, 25 bp, Homo sapien
gcaggagaatctgggaggcagaggt

SEQ ID NO: 651485 - DNA, 25 bp, Homo sapien
gaatttacttgggttctattaatag

SEQ ID NO: 651486 - DNA, 25 bp, Homo sapien
aagcaacaacaaatccaacctaaat

SEQ ID NO: 651487 - DNA, 25 bp, Homo sapien
agcaacaacaaatccaacctaaatg

SEQ ID NO: 651488 - DNA, 25 bp, Homo sapien
gcaacaacaaatccaacctaaatgt

SEQ ID NO: 651489 - DNA, 25 bp, Homo sapien
caacaacaaatccaacctaaatgtt

SEQ ID NO: 651490 - DNA, 25 bp, Homo sapien
acaacaaatccaacctaaatgtttg

SEQ ID NO: 651491 - DNA, 25 bp, Homo sapien
caacaaatccaacctaaatgtttga

SEQ ID NO: 651492 - DNA, 25 bp, Homo sapien
acaaatccaacctaaatgtttgact

SEQ ID NO: 651493 - DNA, 25 bp, Homo sapien
caaatccaacctaaatgtttgactt

SEQ ID NO: 651494 - DNA, 25 bp, Homo sapien
caaccctgtacctcattggttgggt

SEQ ID NO: 651495 - DNA, 25 bp, Homo sapien
gttgggtaacacaaatgccagtgga

SEQ ID NO: 651496 - DNA, 25 bp, Homo sapien
gatgatgtgactgttccacgtggct

SEQ ID NO: 651497 - DNA, 25 bp, Homo sapien
tccacgtggctcagcttggccaatt

SEQ ID NO: 651498 - DNA, 25 bp, Homo sapien
ttggccaatttcctcagctcctggt

SEQ ID NO: 651499 - DNA, 25 bp, Homo sapien
cagctcctggtgttctgtggtcatg

SEQ ID NO: 651500 - DNA, 25 bp, Homo sapien
tgtccaagggactaaagcagcagta

SEQ ID NO: 651501 - DNA, 25 bp, Homo sapien
aaagcagcagtaaagctccatagtc

SEQ ID NO: 651502 - DNA, 25 bp, Homo sapien
gatgtctttgatttacccattttag

SEQ ID NO: 651503 - DNA, 25 bp, Homo sapien
cccattttaggtagcaagtatcttc

SEQ ID NO: 651504 - DNA, 25 bp, Homo sapien
gcaacctagaatttgttagtgggta

SEQ ID NO: 651505 - DNA, 25 bp, Homo sapien
tcccagggtcaagcgattgtcgtgc

SEQ ID NO: 651506 - DNA, 25 bp, Homo sapien
ggaatacaggggcatgcctccacac

SEQ ID NO: 651507 - DNA, 25 bp, Homo sapien
gaatacaggggcatgcctccacacc

SEQ ID NO: 651508 - DNA, 25 bp, Homo sapien
aatacaggggcatgcctccacacct

SEQ ID NO: 651509 - DNA, 25 bp, Homo sapien
gggcatgcctccacacctagctaat

SEQ ID NO: 651510 - DNA, 25 bp, Homo sapien
cctggactcaagtgagcgaccacgc

SEQ ID NO: 651511 - DNA, 25 bp, Homo sapien
ctggactcaagtgagcgaccacgcc

SEQ ID NO: 651512 - DNA, 25 bp, Homo sapien
tgagcgaccacgcccagccgacatt

SEQ ID NO: 651513 - DNA, 25 bp, Homo sapien
ccagccgacattcccaggttttctt

SEQ ID NO: 651514 - DNA, 25 bp, Homo sapien
cagccgacattcccaggttttcttt

SEQ ID NO: 651515 - DNA, 25 bp, Homo sapien
ttctttacgttttaataaatatgag

SEQ ID NO: 651516 - DNA, 25 bp, Homo sapien
gcataaatcccagctgtgaattcaa

SEQ ID NO: 651517 - DNA, 25 bp, Homo sapien
gctgtgaattcaaaagggatgccta

SEQ ID NO: 651518 - DNA, 25 bp, Homo sapien
ggatgcctaggcttgaatattcctt

SEQ ID NO: 651519 - DNA, 25 bp, Homo sapien
agctaatgtgtgtactgacctctgc

SEQ ID NO: 651520 - DNA, 25 bp, Homo sapien
gtgtgtactgacctctgcttaaaga

SEQ ID NO: 651521 - DNA, 25 bp, Homo sapien
gacctctgcttaaagagcttggaaa

SEQ ID NO: 651522 - DNA, 25 bp, Homo sapien
atttggttcccataaatagaatgtc

SEQ ID NO: 651523 - DNA, 25 bp, Homo sapien
aatagaatgtcctcttcaggtgtta

SEQ ID NO: 651524 - DNA, 25 bp, Homo sapien
caggtgttacgtgaggaagaactaa

SEQ ID NO: 651525 - DNA, 25 bp, Homo sapien
agtgcaaatgatcctcagaccttcc

SEQ ID NO: 651526 - DNA, 25 bp, Homo sapien
cttccaccacctgaaagagctttaa

SEQ ID NO: 651527 - DNA, 25 bp, Homo sapien
gtaaactgattaagttttaggcatt

SEQ ID NO: 651528 - DNA, 25 bp, Homo sapien
aaagattgggaactattctatttgg

SEQ ID NO: 651529 - DNA, 25 bp, Homo sapien
ggaactattctatttggtgctttgt

SEQ ID NO: 651530 - DNA, 25 bp, Homo sapien
attagtatatgtgccagttattgcc

SEQ ID NO: 651531 - DNA, 25 bp, Homo sapien
atatgtgccagttattgccatttct

SEQ ID NO: 651532 - DNA, 25 bp, Homo sapien
gtgccagttattgccatttcttaag

SEQ ID NO: 651533 - DNA, 25 bp, Homo sapien
gccagttattgccatttcttaagtc

SEQ ID NO: 651534 - DNA, 25 bp, Homo sapien
gttattgccatttcttaagtccaaa

SEQ ID NO: 651535 - DNA, 25 bp, Homo sapien
tcttaagtccaaaatgtttttctgg

SEQ ID NO: 651536 - DNA, 25 bp, Homo sapien
atgtttttctggtcaaataaatagc

SEQ ID NO: 651537 - DNA, 25 bp, Homo sapien
ctgcagtaagctaagatggtgtcac

SEQ ID NO: 651538 - DNA, 25 bp, Homo sapien
gaaggcaaggtaaggtctctgattt

SEQ ID NO: 651539 - DNA, 25 bp, Homo sapien
caaggtaaggtctctgatttacggg

SEQ ID NO: 651540 - DNA, 25 bp, Homo sapien
gggcatgccagttaatcctcctgaa

SEQ ID NO: 651541 - DNA, 25 bp, Homo sapien
catgccagttaatcctcctgaatga

SEQ ID NO: 651542 - DNA, 25 bp, Homo sapien
gctttgtcttctgagatgaggcttt

SEQ ID NO: 651543 - DNA, 25 bp, Homo sapien
tgtcttctgagatgaggcttttaaa

SEQ ID NO: 651544 - DNA, 25 bp, Homo sapien
gagatgaggcttttaaaatgaacca

SEQ ID NO: 651545 - DNA, 25 bp, Homo sapien
aagcaaatataacccagtatctctg

SEQ ID NO: 651546 - DNA, 25 bp, Homo sapien
tcttcaatactgctgctgcttacgc

SEQ ID NO: 651547 - DNA, 25 bp, Homo sapien
tgctgctgcttacgcgccgggaaac

SEQ ID NO: 651548 - DNA, 25 bp, Homo sapien
tgcttacgcgccgggaaactgggaa

SEQ ID NO: 651549 - DNA, 25 bp, Homo sapien
atcaggcccacaactgaccagaata

SEQ ID NO: 651550 - DNA, 25 bp, Homo sapien
gaccagaatagacttcctttctctt

SEQ ID NO: 651551 - DNA, 25 bp, Homo sapien
tcttttctgtctgctccctatggag

SEQ ID NO: 651552 - DNA, 25 bp, Homo sapien
ggttcatttgcatacatcttcattt

SEQ ID NO: 651553 - DNA, 25 bp, Homo sapien
tttattgtccttccaaagcctttga

SEQ ID NO: 651554 - DNA, 25 bp, Homo sapien
aagcctttgataccgagcacgctaa

SEQ ID NO: 651555 - DNA, 25 bp, Homo sapien
gcacgctaagatgggtatcctcatt

SEQ ID NO: 651556 - DNA, 25 bp, Homo sapien
gactcgcctaggatcacacaattga

SEQ ID NO: 651557 - DNA, 25 bp, Homo sapien
gacatgtcatcgctgtaagtatttt

SEQ ID NO: 651558 - DNA, 25 bp, Homo sapien
aggtatgactcccaaacctatgctc

SEQ ID NO: 651559 - DNA, 25 bp, Homo sapien
agcactctgcttccaggttttcaag

SEQ ID NO: 651560 - DNA, 25 bp, Homo sapien
accgcatccggtctgcttaagtatt

SEQ ID NO: 651561 - DNA, 25 bp, Homo sapien
ccggtctgcttaagtattttctata

SEQ ID NO: 651562 - DNA, 25 bp, Homo sapien
gaaagtaaaaatgctctgagagaag

SEQ ID NO: 651563 - DNA, 25 bp, Homo sapien
gagttcaccgtgaacccttcaaagc

SEQ ID NO: 651564 - DNA, 25 bp, Homo sapien
ttcaaagcctccaacgctgctgaat

SEQ ID NO: 651565 - DNA, 25 bp, Homo sapien
tccaacgctgctgaatgacaactag

SEQ ID NO: 651566 - DNA, 25 bp, Homo sapien
gctgaatgacaactagaagcttatt

SEQ ID NO: 651567 - DNA, 25 bp, Homo sapien
gttttgagagaattctggcaagctc

SEQ ID NO: 651568 - DNA, 25 bp, Homo sapien
ggcaagctcagatgtcaggttctcc

SEQ ID NO: 651569 - DNA, 25 bp, Homo sapien
aagctcagatgtcaggttctccaca

SEQ ID NO: 651570 - DNA, 25 bp, Homo sapien
tcagatgtcaggttctccacatacg

SEQ ID NO: 651571 - DNA, 25 bp, Homo sapien
ttcttcctgtcattggtctctctct

SEQ ID NO: 651572 - DNA, 25 bp, Homo sapien
tcttgcaatccatctcccaaatctt

SEQ ID NO: 651573 - DNA, 25 bp, Homo sapien
aaatctttccaccacttgtcattat

SEQ ID NO: 651574 - DNA, 25 bp, Homo sapien
tctttccaccacttgtcattattac

SEQ ID NO: 651575 - DNA, 25 bp, Homo sapien
gtcattattacatctataccactca

SEQ ID NO: 651576 - DNA, 25 bp, Homo sapien
tgttttctcgaagtgttcctttttg

SEQ ID NO: 651577 - DNA, 25 bp, Homo sapien
ttccatttgttctgcttatacacag

SEQ ID NO: 651578 - DNA, 25 bp, Homo sapien
acaggctaaccagtttagttcagtt

SEQ ID NO: 651579 - DNA, 25 bp, Homo sapien
tatataaaatacacctcgcacaggg

SEQ ID NO: 651580 - DNA, 25 bp, Homo sapien
gggttgttgtcttttatacagattt

SEQ ID NO: 651581 - DNA, 25 bp, Homo sapien
acagatttttgtctcttgtctgaaa

SEQ ID NO: 651582 - DNA, 25 bp, Homo sapien
ttttttccaccctctgcctttcgat

SEQ ID NO: 651583 - DNA, 25 bp, Homo sapien
tgcctttcgatctttagtcctgtta

SEQ ID NO: 651584 - DNA, 25 bp, Homo sapien
tagtcctgttacattgaggcccaag

SEQ ID NO: 651585 - DNA, 25 bp, Homo sapien
gaggcccaagacttagggttgaatt

SEQ ID NO: 651586 - DNA, 25 bp, Homo sapien
aattgaagtatctcggtcagcaaga

SEQ ID NO: 651587 - DNA, 25 bp, Homo sapien
tgacttaagaactcaaggcctagga

SEQ ID NO: 651588 - DNA, 25 bp, Homo sapien
gggtcacatggtcacttcacatgtt

SEQ ID NO: 651589 - DNA, 25 bp, Homo sapien
tggtcacttcacatgttctctttag

SEQ ID NO: 651590 - DNA, 25 bp, Homo sapien
tttagcacaccattcctgcatggaa

SEQ ID NO: 651591 - DNA, 25 bp, Homo sapien
tcctgcatggaattccatctctgaa

SEQ ID NO: 651592 - DNA, 25 bp, Homo sapien
gggctatcttgtatgtgacagttta

SEQ ID NO: 651593 - DNA, 25 bp, Homo sapien
ttagcgggacctcaagggctcactg

SEQ ID NO: 651594 - DNA, 25 bp, Homo sapien
gaccgcttgtgatgaaactgtaact

SEQ ID NO: 651595 - DNA, 25 bp, Homo sapien
ggctcactgcggctaagtgaacgct

SEQ ID NO: 651596 - DNA, 25 bp, Homo sapien
gctaagtgaacgctgactggtctca

SEQ ID NO: 651597 - DNA, 25 bp, Homo sapien
ctgactggtctcagcgtgagctaga

SEQ ID NO: 651598 - DNA, 25 bp, Homo sapien
tcagcgtgagctagaacagaccaag

SEQ ID NO: 651599 - DNA, 25 bp, Homo sapien
cttacaagaaagatgggctgggttt

SEQ ID NO: 651600 - DNA, 25 bp, Homo sapien
gatgggctgggttttgaaaataaca

SEQ ID NO: 651601 - DNA, 25 bp, Homo sapien
taacacaggctctaaaaaccctaag

SEQ ID NO: 651602 - DNA, 25 bp, Homo sapien
ccctaagaagcggtgcaacttttgg

SEQ ID NO: 651603 - DNA, 25 bp, Homo sapien
aagcggtgcaacttttggcaggaat

SEQ ID NO: 651604 - DNA, 25 bp, Homo sapien
ttgtctcttcctcccagaataggag

SEQ ID NO: 651605 - DNA, 25 bp, Homo sapien
gagggctctctaggtgagcgcatca

SEQ ID NO: 651606 - DNA, 25 bp, Homo sapien
taggtgagcgcatcagctggctcca

SEQ ID NO: 651607 - DNA, 25 bp, Homo sapien
gagcaagcaagaattttcttcccag

SEQ ID NO: 651608 - DNA, 25 bp, Homo sapien
gaattttcttcccaggaagctcctc

SEQ ID NO: 651609 - DNA, 25 bp, Homo sapien
gcctgggtggctgtatcgttttaac

SEQ ID NO: 651610 - DNA, 25 bp, Homo sapien
gtggctgtatcgttttaactgcata

SEQ ID NO: 651611 - DNA, 25 bp, Homo sapien
taactgcatagagggcaggtctctt

SEQ ID NO: 651612 - DNA, 25 bp, Homo sapien
agggcaggtctcttttggaattagg

SEQ ID NO: 651613 - DNA, 25 bp, Homo sapien
gcaggtctcttttggaattaggatt

SEQ ID NO: 651614 - DNA, 25 bp, Homo sapien
acaccatcacaaaagattcccacaa

SEQ ID NO: 651615 - DNA, 25 bp, Homo sapien
gagagatacctctgagcctggagga

SEQ ID NO: 651616 - DNA, 25 bp, Homo sapien
ggatactttagatgtgaacttggca

SEQ ID NO: 651617 - DNA, 25 bp, Homo sapien
gggccgcataatgggaaatctgttt

SEQ ID NO: 651618 - DNA, 25 bp, Homo sapien
atgggaaatctgttttcatttcttt

SEQ ID NO: 651619 - DNA, 25 bp, Homo sapien
atttctttcatttcagatgccaagg

SEQ ID NO: 651620 - DNA, 25 bp, Homo sapien
aactgctccggtaagtactgcgttt

SEQ ID NO: 651621 - DNA, 25 bp, Homo sapien
ctccggtaagtactgcgtttattgt

SEQ ID NO: 651622 - DNA, 25 bp, Homo sapien
agtactgcgtttattgtaggagaaa

SEQ ID NO: 651623 - DNA, 25 bp, Homo sapien
gaaagtgcagcctcaaaaggaaaaa

SEQ ID NO: 651624 - DNA, 25 bp, Homo sapien
ggcttaggttgtagagacatttccc

SEQ ID NO: 651625 - DNA, 25 bp, Homo sapien
ggttgtagagacatttcccaaatat

SEQ ID NO: 651626 - DNA, 25 bp, Homo sapien
gaagatgaagttattaccagaagcc

SEQ ID NO: 651627 - DNA, 25 bp, Homo sapien
aagatgaagttattaccagaagcca

SEQ ID NO: 651628 - DNA, 25 bp, Homo sapien
agatgaagttattaccagaagccaa

SEQ ID NO: 651629 - DNA, 25 bp, Homo sapien
gatgaagttattaccagaagccaat

SEQ ID NO: 651630 - DNA, 25 bp, Homo sapien
atgaagttattaccagaagccaata

SEQ ID NO: 651631 - DNA, 25 bp, Homo sapien
tgaagttattaccagaagccaatat

SEQ ID NO: 651632 - DNA, 25 bp, Homo sapien
ttattaccagaagccaatataggcc

SEQ ID NO: 651633 - DNA, 25 bp, Homo sapien
cagaagccaatataggccaggcaca

SEQ ID NO: 651634 - DNA, 25 bp, Homo sapien
gcctgcgcagcatggtgagatccca

SEQ ID NO: 651635 - DNA, 25 bp, Homo sapien
atgatcattccgctgcactcagcct

SEQ ID NO: 651636 - DNA, 25 bp, Homo sapien
tgatcattccgctgcactcagcctg

SEQ ID NO: 651637 - DNA, 25 bp, Homo sapien
taaaaacaaagctatgggccgggcg

SEQ ID NO: 651638 - DNA, 25 bp, Homo sapien
aaaacaaagctatgggccgggcgcg

SEQ ID NO: 651639 - DNA, 25 bp, Homo sapien
aaacaaagctatgggccgggcgcgg

SEQ ID NO: 651640 - DNA, 25 bp, Homo sapien
aacaaagctatgggccgggcgcggt

SEQ ID NO: 651641 - DNA, 25 bp, Homo sapien
gccgggcgtgtggtggcgggcccct

SEQ ID NO: 651642 - DNA, 25 bp, Homo sapien
cgggcgtgtggtggcgggcccctgt

SEQ ID NO: 651643 - DNA, 25 bp, Homo sapien
gggcgtgtggtggcgggcccctgta

SEQ ID NO: 651644 - DNA, 25 bp, Homo sapien
ggcgtgtggtggcgggcccctgtaa

SEQ ID NO: 651645 - DNA, 25 bp, Homo sapien
cacgccactgcacccttctcactgc

SEQ ID NO: 651646 - DNA, 25 bp, Homo sapien
ttctcactgcactggtgacagagcg

SEQ ID NO: 651647 - DNA, 25 bp, Homo sapien
tctcactgcactggtgacagagcga

SEQ ID NO: 651648 - DNA, 25 bp, Homo sapien
ggaataattcactgtcgaagtcttc

SEQ ID NO: 651649 - DNA, 25 bp, Homo sapien
cgaagtcttcttgagctgagcagtc

SEQ ID NO: 651650 - DNA, 25 bp, Homo sapien
gtcttcttgagctgagcagtcatgt

SEQ ID NO: 651651 - DNA, 25 bp, Homo sapien
tgagctgagcagtcatgtgagcttg

SEQ ID NO: 651652 - DNA, 25 bp, Homo sapien
tgatccttcagctcaggccatcatc

SEQ ID NO: 651653 - DNA, 25 bp, Homo sapien
tcaggccatcatctacatctggatt

SEQ ID NO: 651654 - DNA, 25 bp, Homo sapien
atcatctacatctggattcctgacc

SEQ ID NO: 651655 - DNA, 25 bp, Homo sapien
tcctgacccggagaaactatgagta

SEQ ID NO: 651656 - DNA, 25 bp, Homo sapien
actatgagtaatgtgtgctgctttt

SEQ ID NO: 651657 - DNA, 25 bp, Homo sapien
tgctgcttttgagccactaagctac

SEQ ID NO: 651658 - DNA, 25 bp, Homo sapien
actaagctacatggtaataggctat

SEQ ID NO: 651659 - DNA, 25 bp, Homo sapien
ttcggtggtgaaaaatacgctcgcc

SEQ ID NO: 651660 - DNA, 25 bp, Homo sapien
gtgaaaaatacgctcgccaaactga

SEQ ID NO: 651661 - DNA, 25 bp, Homo sapien
aatacgctcgccaaactgacaggaa

SEQ ID NO: 651662 - DNA, 25 bp, Homo sapien
gctcgccaaactgacaggaaaatgt

SEQ ID NO: 651663 - DNA, 25 bp, Homo sapien
aatgctaattgcttaattgattatt

SEQ ID NO: 651664 - DNA, 25 bp, Homo sapien
attgattattactaggagtccacaa

SEQ ID NO: 651665 - DNA, 25 bp, Homo sapien
ggagtccacaattttcagtgctttt

SEQ ID NO: 651666 - DNA, 25 bp, Homo sapien
gagacaaattcaccaaaaatcagtt

SEQ ID NO: 651667 - DNA, 25 bp, Homo sapien
tcagtttggcttgaagtatatggac

SEQ ID NO: 651668 - DNA, 25 bp, Homo sapien
gtatatggacacacataaagctctg

SEQ ID NO: 651669 - DNA, 25 bp, Homo sapien
acataaagctctgcacatgtattat

SEQ ID NO: 651670 - DNA, 25 bp, Homo sapien
catctgttgctttttggctctgaga

SEQ ID NO: 651671 - DNA, 25 bp, Homo sapien
gaatcacatataaaggtgctgtcaa

SEQ ID NO: 651672 - DNA, 25 bp, Homo sapien
ataaaggtgctgtcaagaaatctgg

SEQ ID NO: 651673 - DNA, 25 bp, Homo sapien
aagaaatctggttgaaggctggaca

SEQ ID NO: 651674 - DNA, 25 bp, Homo sapien
cttcaagaagagcttgggcaagact

SEQ ID NO: 651675 - DNA, 25 bp, Homo sapien
gagcttgggcaagactgtagccata

SEQ ID NO: 651676 - DNA, 25 bp, Homo sapien
gggcaagactgtagccatagccata

SEQ ID NO: 651677 - DNA, 25 bp, Homo sapien
aagactgtagccatagccatagcaa

SEQ ID NO: 651678 - DNA, 25 bp, Homo sapien
gactgtagccatagccatagcaaga

SEQ ID NO: 651679 - DNA, 25 bp, Homo sapien
gtagccatagccatagcaagaatct

SEQ ID NO: 651680 - DNA, 25 bp, Homo sapien
ccatagccatagcaagaatctgtct

SEQ ID NO: 651681 - DNA, 25 bp, Homo sapien
acaggggacccagtgacaatgatga

SEQ ID NO: 651682 - DNA, 25 bp, Homo sapien
atttttctttccgtaggatttcatg

SEQ ID NO: 651683 - DNA, 25 bp, Homo sapien
ttttctttccgtaggatttcatggt

SEQ ID NO: 651684 - DNA, 25 bp, Homo sapien
ctttccgtaggatttcatggtgctt

SEQ ID NO: 651685 - DNA, 25 bp, Homo sapien
ttccgtaggatttcatggtgcttta

SEQ ID NO: 651686 - DNA, 25 bp, Homo sapien
ccgtaggatttcatggtgctttaaa

SEQ ID NO: 651687 - DNA, 25 bp, Homo sapien
gggagggagatttcataatgttctt

SEQ ID NO: 651688 - DNA, 25 bp, Homo sapien
gagatttcataatgttcttagggaa

SEQ ID NO: 651689 - DNA, 25 bp, Homo sapien
acaaaacaaatttgcttgtgacatt

SEQ ID NO: 651690 - DNA, 25 bp, Homo sapien
ttgtgacatttcaataagctgtgct

SEQ ID NO: 651691 - DNA, 25 bp, Homo sapien
caataagctgtgctgctattgtctt

SEQ ID NO: 651692 - DNA, 25 bp, Homo sapien
cttgggcctgggaagcggtgattgc

SEQ ID NO: 651693 - DNA, 25 bp, Homo sapien
aaaatacatattcccagatcctgga

SEQ ID NO: 651694 - DNA, 25 bp, Homo sapien
atacatattcccagatcctggaatg

SEQ ID NO: 651695 - DNA, 25 bp, Homo sapien
catattcccagatcctggaatgtcc

SEQ ID NO: 651696 - DNA, 25 bp, Homo sapien
atcctggaatgtcctgggaagctat

SEQ ID NO: 651697 - DNA, 25 bp, Homo sapien
tgtcctgggaagctatatgtgtgtc

SEQ ID NO: 651698 - DNA, 25 bp, Homo sapien
tcctgggaagctatatgtgtgtcat

SEQ ID NO: 651699 - DNA, 25 bp, Homo sapien
ggaagctatatgtgtgtcatgccct

SEQ ID NO: 651700 - DNA, 25 bp, Homo sapien
gaagctatatgtgtgtcatgccctc

SEQ ID NO: 651701 - DNA, 25 bp, Homo sapien
aagctatatgtgtgtcatgccctcc

SEQ ID NO: 651702 - DNA, 25 bp, Homo sapien
gctatatgtgtgtcatgccctccca

SEQ ID NO: 651703 - DNA, 25 bp, Homo sapien
ggctagtctcaaactactgatctga

SEQ ID NO: 651704 - DNA, 25 bp, Homo sapien
tagtctcaaactactgatctgaggt

SEQ ID NO: 651705 - DNA, 25 bp, Homo sapien
atgcccggcttatttaagctgattc

SEQ ID NO: 651706 - DNA, 25 bp, Homo sapien
gcccggcttatttaagctgattctt

SEQ ID NO: 651707 - DNA, 25 bp, Homo sapien
ccggcttatttaagctgattcttta

SEQ ID NO: 651708 - DNA, 25 bp, Homo sapien
ataaaaccttgagctattattccaa

SEQ ID NO: 651709 - DNA, 25 bp, Homo sapien
aaaccttgagctattattccaagca

SEQ ID NO: 651710 - DNA, 25 bp, Homo sapien
accttgagctattattccaagcaga

SEQ ID NO: 651711 - DNA, 25 bp, Homo sapien
aagcagagaccagtaggtgcaaaga

SEQ ID NO: 651712 - DNA, 25 bp, Homo sapien
agagaccagtaggtgcaaagacaca

SEQ ID NO: 651713 - DNA, 25 bp, Homo sapien
agaccagtaggtgcaaagacacagg

SEQ ID NO: 651714 - DNA, 25 bp, Homo sapien
ctttacatgctggtttaaattcaga

SEQ ID NO: 651715 - DNA, 25 bp, Homo sapien
catgctggtttaaattcagaaggaa

SEQ ID NO: 651716 - DNA, 25 bp, Homo sapien
aaaaagttctcagtgacctattttg

SEQ ID NO: 651717 - DNA, 25 bp, Homo sapien
aaagttctcagtgacctattttgtg

SEQ ID NO: 651718 - DNA, 25 bp, Homo sapien
tagtatgtttctgcccattatgaaa

SEQ ID NO: 651719 - DNA, 25 bp, Homo sapien
gtcggatgtgtctgtgctttattat

SEQ ID NO: 651720 - DNA, 25 bp, Homo sapien
ctgtgctttattatggccttgttta

SEQ ID NO: 651721 - DNA, 25 bp, Homo sapien
gtgctttattatggccttgtttata

SEQ ID NO: 651722 - DNA, 25 bp, Homo sapien
tgtttatatatcactgaggtatact

SEQ ID NO: 651723 - DNA, 25 bp, Homo sapien
ctgaggtatactatgccatgtaaat

SEQ ID NO: 651724 - DNA, 25 bp, Homo sapien
tactatgccatgtaaatagactatt

SEQ ID NO: 651725 - DNA, 25 bp, Homo sapien
tatatagaaattatagcttaatggc

SEQ ID NO: 651726 - DNA, 25 bp, Homo sapien
atatagaaattatagcttaatggcc

SEQ ID NO: 651727 - DNA, 25 bp, Homo sapien
tatagaaattatagcttaatggcca

SEQ ID NO: 651728 - DNA, 25 bp, Homo sapien
atagaaattatagcttaatggccag

SEQ ID NO: 651729 - DNA, 25 bp, Homo sapien
tagaaattatagcttaatggccagg

SEQ ID NO: 651730 - DNA, 25 bp, Homo sapien
agaaattatagcttaatggccaggt

SEQ ID NO: 651731 - DNA, 25 bp, Homo sapien
gaaattatagcttaatggccaggtg

SEQ ID NO: 651732 - DNA, 25 bp, Homo sapien
aaattatagcttaatggccaggtgc

SEQ ID NO: 651733 - DNA, 25 bp, Homo sapien
aattatagcttaatggccaggtgcg

SEQ ID NO: 651734 - DNA, 25 bp, Homo sapien
gagtctacaggagactcagagctcc

SEQ ID NO: 651735 - DNA, 25 bp, Homo sapien
aggagactcagagctcccaccctct

SEQ ID NO: 651736 - DNA, 25 bp, Homo sapien
ggagttagaaagaggtcctgtcatt

SEQ ID NO: 651737 - DNA, 25 bp, Homo sapien
gttagaaagaggtcctgtcattctc

SEQ ID NO: 651738 - DNA, 25 bp, Homo sapien
ttagaaagaggtcctgtcattctca

SEQ ID NO: 651739 - DNA, 25 bp, Homo sapien
gaggtcctgtcattctcactctaag

SEQ ID NO: 651740 - DNA, 25 bp, Homo sapien
ggtcctgtcattctcactctaagga

SEQ ID NO: 651741 - DNA, 25 bp, Homo sapien
gtcctgtcattctcactctaaggaa

SEQ ID NO: 651742 - DNA, 25 bp, Homo sapien
cctgtcattctcactctaaggaaat

SEQ ID NO: 651743 - DNA, 25 bp, Homo sapien
gtcattctcactctaaggaaatgga

SEQ ID NO: 651744 - DNA, 25 bp, Homo sapien
ttctcactctaaggaaatggaatag

SEQ ID NO: 651745 - DNA, 25 bp, Homo sapien
acccagtccaatccacagtgcaaag

SEQ ID NO: 651746 - DNA, 25 bp, Homo sapien
gtccaatccacagtgcaaagagcga

SEQ ID NO: 651747 - DNA, 25 bp, Homo sapien
tccacagtgcaaagagcgagtccat

SEQ ID NO: 651748 - DNA, 25 bp, Homo sapien
acagtgcaaagagcgagtccattat

SEQ ID NO: 651749 - DNA, 25 bp, Homo sapien
aagagcgagtccattataacccagt

SEQ ID NO: 651750 - DNA, 25 bp, Homo sapien
gagcgagtccattataacccagtca

SEQ ID NO: 651751 - DNA, 25 bp, Homo sapien
aaggcagattttgtgattattcccg

SEQ ID NO: 651752 - DNA, 25 bp, Homo sapien
ggcagattttgtgattattcccgct

SEQ ID NO: 651753 - DNA, 25 bp, Homo sapien
gattttgtgattattcccgctgaag

SEQ ID NO: 651754 - DNA, 25 bp, Homo sapien
tttgtgattattcccgctgaaggaa

SEQ ID NO: 651755 - DNA, 25 bp, Homo sapien
tcccgctgaaggaatagagaacaga

SEQ ID NO: 651756 - DNA, 25 bp, Homo sapien
gagaacgaacatcttctggaccttt

SEQ ID NO: 651757 - DNA, 25 bp, Homo sapien
aaatacaaagaaaactagccgagtg

SEQ ID NO: 651758 - DNA, 25 bp, Homo sapien
atacaaagaaaactagccgagtgtg

SEQ ID NO: 651759 - DNA, 25 bp, Homo sapien
tacaaagaaaactagccgagtgtgg

SEQ ID NO: 651760 - DNA, 25 bp, Homo sapien
acaaagaaaactagccgagtgtggt

SEQ ID NO: 651761 - DNA, 25 bp, Homo sapien
caaagaaaactagccgagtgtggtg

SEQ ID NO: 651762 - DNA, 25 bp, Homo sapien
gcgcacctgtgatcacagctgctcg

SEQ ID NO: 651763 - DNA, 25 bp, Homo sapien
cgcacctgtgatcacagctgctcgg

SEQ ID NO: 651764 - DNA, 25 bp, Homo sapien
gcacctgtgatcacagctgctcggg

SEQ ID NO: 651765 - DNA, 25 bp, Homo sapien
cacctgtgatcacagctgctcggga

SEQ ID NO: 651766 - DNA, 25 bp, Homo sapien
acctgtgatcacagctgctcgggag

SEQ ID NO: 651767 - DNA, 25 bp, Homo sapien
cacttgctgtctctgttgtattttg

SEQ ID NO: 651768 - DNA, 25 bp, Homo sapien
gctgtctctgttgtattttggtatg

SEQ ID NO: 651769 - DNA, 25 bp, Homo sapien
ttggtatgagttttgatagctctat

SEQ ID NO: 651770 - DNA, 25 bp, Homo sapien
ctttccatcttgttgcattatctag

SEQ ID NO: 651771 - DNA, 25 bp, Homo sapien
attcgccagtaaaataatctagctt

SEQ ID NO: 651772 - DNA, 25 bp, Homo sapien
ataacaacaactgaaaaggcactct

SEQ ID NO: 651773 - DNA, 25 bp, Homo sapien
aaggcactctaaattgtggctggct

SEQ ID NO: 651774 - DNA, 25 bp, Homo sapien
ctaaattgtggctggcttccctttc

SEQ ID NO: 651775 - DNA, 25 bp, Homo sapien
aatatattgtctgattgggtaaatg

SEQ ID NO: 651776 - DNA, 25 bp, Homo sapien
gggtaaatgtgattgaccacttgct

SEQ ID NO: 651777 - DNA, 25 bp, Homo sapien
atgtgattgaccacttgctgtctct

SEQ ID NO: 651778 - DNA, 25 bp, Homo sapien
tggtctcatcctcaccctaaagcag

SEQ ID NO: 651779 - DNA, 25 bp, Homo sapien
acctgaggcgccttcgcactgagat

SEQ ID NO: 651780 - DNA, 25 bp, Homo sapien
ttcgcactgagatgcccgctgatct

SEQ ID NO: 651781 - DNA, 25 bp, Homo sapien
gagatgcccgctgatcttcccagga

SEQ ID NO: 651782 - DNA, 25 bp, Homo sapien
atctccgtggctctaagctgttcac

SEQ ID NO: 651783 - DNA, 25 bp, Homo sapien
taagctgttcaccttcaccctggac

SEQ ID NO: 651784 - DNA, 25 bp, Homo sapien
aaagagcaacaactctgctgccagc

SEQ ID NO: 651785 - DNA, 25 bp, Homo sapien
aactctgctgccagcaccaaaaagc

SEQ ID NO: 651786 - DNA, 25 bp, Homo sapien
tccctcaagtcctcttttgcagata

SEQ ID NO: 651787 - DNA, 25 bp, Homo sapien
agtcctcttttgcagatacctacaa

SEQ ID NO: 651788 - DNA, 25 bp, Homo sapien
gcagatacctacaaagggccttgaa

SEQ ID NO: 651789 - DNA, 25 bp, Homo sapien
ggaggagactccctgaactcactgc

SEQ ID NO: 651790 - DNA, 25 bp, Homo sapien
actccctgaactcactgcgcagaag

SEQ ID NO: 651791 - DNA, 25 bp, Homo sapien
tcactgcgcagaagcccccagggag

SEQ ID NO: 651792 - DNA, 25 bp, Homo sapien
gagagggcccaggattttcccttga

SEQ ID NO: 651793 - DNA, 25 bp, Homo sapien
ggcccaggattttcccttgacgcag

SEQ ID NO: 651794 - DNA, 25 bp, Homo sapien
aggattttcccttgacgcagctgcc

SEQ ID NO: 651795 - DNA, 25 bp, Homo sapien
cccctgttcgcacgtctaggaagaa

SEQ ID NO: 651796 - DNA, 25 bp, Homo sapien
gttcgcacgtctaggaagaagggaa

SEQ ID NO: 651797 - DNA, 25 bp, Homo sapien
tggaaaccctgaaagcagtaggctt

SEQ ID NO: 651798 - DNA, 25 bp, Homo sapien
gcagtaggcttagttctggcctgtc

SEQ ID NO: 651799 - DNA, 25 bp, Homo sapien
ttagttctggcctgtcccctccaag

SEQ ID NO: 651800 - DNA, 25 bp, Homo sapien
cctgaattggtatgtgaaatgtctc

SEQ ID NO: 651801 - DNA, 25 bp, Homo sapien
ttttaaacaccatgtaggcccaatg

SEQ ID NO: 651802 - DNA, 25 bp, Homo sapien
gtaggcccaatgaaacacatctcca

SEQ ID NO: 651803 - DNA, 25 bp, Homo sapien
acatctccaagccagatccaaatca

SEQ ID NO: 651804 - DNA, 25 bp, Homo sapien
aatcacagaattccaatcacaggtt

SEQ ID NO: 651805 - DNA, 25 bp, Homo sapien
caggttgaaatccacttctctaaaa

SEQ ID NO: 651806 - DNA, 25 bp, Homo sapien
aatccacttctctaaaatcttttcg

SEQ ID NO: 651807 - DNA, 25 bp, Homo sapien
tctaaaatcttttcgtctctgaccg

SEQ ID NO: 651808 - DNA, 25 bp, Homo sapien
aatcttttcgtctctgaccgggcaa

SEQ ID NO: 651809 - DNA, 25 bp, Homo sapien
tgaccgggcaaggtggcacacgtct

SEQ ID NO: 651810 - DNA, 25 bp, Homo sapien
agccctggagttcgacgctagcctg

SEQ ID NO: 651811 - DNA, 25 bp, Homo sapien
gacagcagcaaagtgaaactgccgc

SEQ ID NO: 651812 - DNA, 25 bp, Homo sapien
cagcagcaaagtgaaactgccgcca

SEQ ID NO: 651813 - DNA, 25 bp, Homo sapien
agcagcaaagtgaaactgccgccaa

SEQ ID NO: 651814 - DNA, 25 bp, Homo sapien
gcagcaaagtgaaactgccgccaag

SEQ ID NO: 651815 - DNA, 25 bp, Homo sapien
cagcaaagtgaaactgccgccaagt

SEQ ID NO: 651816 - DNA, 25 bp, Homo sapien
agcaaagtgaaactgccgccaagtg

SEQ ID NO: 651817 - DNA, 25 bp, Homo sapien
gcaaagtgaaactgccgccaagtgc

SEQ ID NO: 651818 - DNA, 25 bp, Homo sapien
caaagtgaaactgccgccaagtgct

SEQ ID NO: 651819 - DNA, 25 bp, Homo sapien
tgaaactgccgccaagtgctgatat

SEQ ID NO: 651820 - DNA, 25 bp, Homo sapien
gaaactgccgccaagtgctgatatg

SEQ ID NO: 651821 - DNA, 25 bp, Homo sapien
aaactgccgccaagtgctgatatgt

SEQ ID NO: 651822 - DNA, 25 bp, Homo sapien
gcagtaggtccttgcactccttcaa

SEQ ID NO: 651823 - DNA, 25 bp, Homo sapien
taggtccttgcactccttcaagcat

SEQ ID NO: 651824 - DNA, 25 bp, Homo sapien
cttgcactccttcaagcatttcgaa

SEQ ID NO: 651825 - DNA, 25 bp, Homo sapien
gcactccttcaagcatttcgaagat

SEQ ID NO: 651826 - DNA, 25 bp, Homo sapien
attggacagttcctatttctaccca

SEQ ID NO: 651827 - DNA, 25 bp, Homo sapien
agttcctatttctacccaccttgct

SEQ ID NO: 651828 - DNA, 25 bp, Homo sapien
gatggattcaaaaaatcgcttcctg

SEQ ID NO: 651829 - DNA, 25 bp, Homo sapien
aaaaaatcgcttcctgactgcagta

SEQ ID NO: 651830 - DNA, 25 bp, Homo sapien
aaaatcgcttcctgactgcagtagg

SEQ ID NO: 651831 - DNA, 25 bp, Homo sapien
aatcgcttcctgactgcagtaggtc

SEQ ID NO: 651832 - DNA, 25 bp, Homo sapien
cgcttcctgactgcagtaggtcctt

SEQ ID NO: 651833 - DNA, 25 bp, Homo sapien
aacatgcggcgattaagtctttcac

SEQ ID NO: 651834 - DNA, 25 bp, Homo sapien
atgcggcgattaagtctttcaccca

SEQ ID NO: 651835 - DNA, 25 bp, Homo sapien
gcgattaagtctttcacccaccttt

SEQ ID NO: 651836 - DNA, 25 bp, Homo sapien
tttcacccaccttttcaatgggatt

SEQ ID NO: 651837 - DNA, 25 bp, Homo sapien
caatgggatttcatctgttagttac

SEQ ID NO: 651838 - DNA, 25 bp, Homo sapien
atctgttagttactgtgagtctctt

SEQ ID NO: 651839 - DNA, 25 bp, Homo sapien
tgagtctcttattttcccatgtgga

SEQ ID NO: 651840 - DNA, 25 bp, Homo sapien
gtctcttattttcccatgtggacca

SEQ ID NO: 651841 - DNA, 25 bp, Homo sapien
atgtggaccatgtaattgctgagac

SEQ ID NO: 651842 - DNA, 25 bp, Homo sapien
ggaccatgtaattgctgagacagaa

SEQ ID NO: 651843 - DNA, 25 bp, Homo sapien
gaaactggtgaatgtactggatcat

SEQ ID NO: 651844 - DNA, 25 bp, Homo sapien
taggtgcatacattaaggtagtgac

SEQ ID NO: 651845 - DNA, 25 bp, Homo sapien
ggtagtgacgatggagtttctgcct

SEQ ID NO: 651846 - DNA, 25 bp, Homo sapien
gacgatggagtttctgcctcaaaac

SEQ ID NO: 651847 - DNA, 25 bp, Homo sapien
acctcaatttatcaagaatgttcag

SEQ ID NO: 651848 - DNA, 25 bp, Homo sapien
acaaaccttttgagataataccaat

SEQ ID NO: 651849 - DNA, 25 bp, Homo sapien
cagattattgttatttgatgttttc

SEQ ID NO: 651850 - DNA, 25 bp, Homo sapien
gatgttttcagtaaggcctacctgc

SEQ ID NO: 651851 - DNA, 25 bp, Homo sapien
gtaaggcctacctgccttttgttga

SEQ ID NO: 651852 - DNA, 25 bp, Homo sapien
ctacctgccttttgttgatgcatgt

SEQ ID NO: 651853 - DNA, 25 bp, Homo sapien
ctgccttttgttgatgcatgttaag

SEQ ID NO: 651854 - DNA, 25 bp, Homo sapien
tctgttctccagaattttcactgaa

SEQ ID NO: 651855 - DNA, 25 bp, Homo sapien
gagtggtgccattcaggtactgagt

SEQ ID NO: 651856 - DNA, 25 bp, Homo sapien
agcagagccagtcaagacttgccga

SEQ ID NO: 651857 - DNA, 25 bp, Homo sapien
gcagagccagtcaagacttgccgac

SEQ ID NO: 651858 - DNA, 25 bp, Homo sapien
agagccagtcaagacttgccgacaa

SEQ ID NO: 651859 - DNA, 25 bp, Homo sapien
tagaagccaagaaagctgcagctga

SEQ ID NO: 651860 - DNA, 25 bp, Homo sapien
agaagccaagaaagctgcagctgaa

SEQ ID NO: 651861 - DNA, 25 bp, Homo sapien
gccaagaaagctgcagctgaaaagc

SEQ ID NO: 651862 - DNA, 25 bp, Homo sapien
gtacaaaacaaactgaaaacgcaag

SEQ ID NO: 651863 - DNA, 25 bp, Homo sapien
aacaaactgaaaacgcaagccaggc

SEQ ID NO: 651864 - DNA, 25 bp, Homo sapien
gaaaacgcaagccaggctaaacagt

SEQ ID NO: 651865 - DNA, 25 bp, Homo sapien
acgcaagccaggctaaacagttggc

SEQ ID NO: 651866 - DNA, 25 bp, Homo sapien
ttatctgatccatttacagatttat

SEQ ID NO: 651867 - DNA, 25 bp, Homo sapien
tatggtctgttttcaaaggtatgca

SEQ ID NO: 651868 - DNA, 25 bp, Homo sapien
tcaaaggtatgcagaaacttttcta

SEQ ID NO: 651869 - DNA, 25 bp, Homo sapien
cagaaacttttctatatattcctac

SEQ ID NO: 651870 - DNA, 25 bp, Homo sapien
tgtttcttcttttcattatggcatt

SEQ ID NO: 651871 - DNA, 25 bp, Homo sapien
tcttcttttcattatggcattccag

SEQ ID NO: 651872 - DNA, 25 bp, Homo sapien
tatggcattccagttgagtttcacc

SEQ ID NO: 651873 - DNA, 25 bp, Homo sapien
attccagttgagtttcaccacgcat

SEQ ID NO: 651874 - DNA, 25 bp, Homo sapien
gttgagtttcaccacgcattatcat

SEQ ID NO: 651875 - DNA, 25 bp, Homo sapien
agtttcaccacgcattatcatgaga

SEQ ID NO: 651876 - DNA, 25 bp, Homo sapien
tcaccacgcattatcatgagaataa

SEQ ID NO: 651877 - DNA, 25 bp, Homo sapien
attgaaagtggtgggtttgatcttt

SEQ ID NO: 651878 - DNA, 25 bp, Homo sapien
tgatctttttatttagaaacccaca

SEQ ID NO: 651879 - DNA, 25 bp, Homo sapien
gaaacccacaaaatcagaaacacag

SEQ ID NO: 651880 - DNA, 25 bp, Homo sapien
aatcaaactataagttgacttttag

SEQ ID NO: 651881 - DNA, 25 bp, Homo sapien
ggaatctagaattcttataacatga

SEQ ID NO: 651882 - DNA, 25 bp, Homo sapien
caaaatgtacagcaagcctatgtag

SEQ ID NO: 651883 - DNA, 25 bp, Homo sapien
gtacagcaagcctatgtagttcaat

SEQ ID NO: 651884 - DNA, 25 bp, Homo sapien
cagcaagcctatgtagttcaattaa

SEQ ID NO: 651885 - DNA, 25 bp, Homo sapien
caagcctatgtagttcaattaatat

SEQ ID NO: 651886 - DNA, 25 bp, Homo sapien
gatacaagcattataaagtttttac

SEQ ID NO: 651887 - DNA, 25 bp, Homo sapien
actgtagtagtcaattaatggatat

SEQ ID NO: 651888 - DNA, 25 bp, Homo sapien
ttttcaacgcccgagagaaattcct

SEQ ID NO: 651889 - DNA, 25 bp, Homo sapien
ttcaacgcccgagagaaattcctca

SEQ ID NO: 651890 - DNA, 25 bp, Homo sapien
tcaacgcccgagagaaattcctcat

SEQ ID NO: 651891 - DNA, 25 bp, Homo sapien
caacgcccgagagaaattcctcatg

SEQ ID NO: 651892 - DNA, 25 bp, Homo sapien
aacgcccgagagaaattcctcatgc

SEQ ID NO: 651893 - DNA, 25 bp, Homo sapien
acgcccgagagaaattcctcatgct

SEQ ID NO: 651894 - DNA, 25 bp, Homo sapien
gcccgagagaaattcctcatgctca

SEQ ID NO: 651895 - DNA, 25 bp, Homo sapien
ccgagagaaattcctcatgctcata

SEQ ID NO: 651896 - DNA, 25 bp, Homo sapien
gagagaaattcctcatgctcatatg

SEQ ID NO: 651897 - DNA, 25 bp, Homo sapien
agagaaattcctcatgctcatatgc

SEQ ID NO: 651898 - DNA, 25 bp, Homo sapien
gagaaattcctcatgctcatatgca

SEQ ID NO: 651899 - DNA, 25 bp, Homo sapien
tgacatcatgacatttttggccaat

SEQ ID NO: 651900 - DNA, 25 bp, Homo sapien
aattctctgtctaagcctcaacatg

SEQ ID NO: 651901 - DNA, 25 bp, Homo sapien
gcatcgcacatctcagctctttttt

SEQ ID NO: 651902 - DNA, 25 bp, Homo sapien
ctgtcccactactcatatgaaatga

SEQ ID NO: 651903 - DNA, 25 bp, Homo sapien
aaatgacctgagctagcctgctgga

SEQ ID NO: 651904 - DNA, 25 bp, Homo sapien
atagagatgagccatcccagcggaa

SEQ ID NO: 651905 - DNA, 25 bp, Homo sapien
atcccagcggaagttattctacatt

SEQ ID NO: 651906 - DNA, 25 bp, Homo sapien
cattatccaggaaccagccaattta

SEQ ID NO: 651907 - DNA, 25 bp, Homo sapien
cagccaatttagcagctggcctcag

SEQ ID NO: 651908 - DNA, 25 bp, Homo sapien
agctggcctcagacccatgaataaa

SEQ ID NO: 651909 - DNA, 25 bp, Homo sapien
aaactcagccaagaccaggtgaaca

SEQ ID NO: 651910 - DNA, 25 bp, Homo sapien
gggatctgtatgtcaagttcctaag

SEQ ID NO: 651911 - DNA, 25 bp, Homo sapien
caagttcctaagaaaatcctgttgg

SEQ ID NO: 651912 - DNA, 25 bp, Homo sapien
tacagtctaatttctggagaattgc

SEQ ID NO: 651913 - DNA, 25 bp, Homo sapien
gagaattgctctcatgacaacatta

SEQ ID NO: 651914 - DNA, 25 bp, Homo sapien
gacaacattagcctttctactcatt

SEQ ID NO: 651915 - DNA, 25 bp, Homo sapien
gcctttctactcattggaacactca

SEQ ID NO: 651916 - DNA, 25 bp, Homo sapien
tcattggaacactcatttattgaag

SEQ ID NO: 651917 - DNA, 25 bp, Homo sapien
tttattgaaggcttctatgtgcttt

SEQ ID NO: 651918 - DNA, 25 bp, Homo sapien
tttcttctgatagttgtttttcatt

SEQ ID NO: 651919 - DNA, 25 bp, Homo sapien
gttatttcaggtgtacaggtatgct

SEQ ID NO: 651920 - DNA, 25 bp, Homo sapien
gtgtacaggtatgctgttgactttt

SEQ ID NO: 651921 - DNA, 25 bp, Homo sapien
taggattacaggtattacccctggg

SEQ ID NO: 651922 - DNA, 25 bp, Homo sapien
gaatcttttaggttaccttgcaatg

SEQ ID NO: 651923 - DNA, 25 bp, Homo sapien
ttttaggttaccttgcaatgggaag

SEQ ID NO: 651924 - DNA, 25 bp, Homo sapien
aggttaccttgcaatgggaaggata

SEQ ID NO: 651925 - DNA, 25 bp, Homo sapien
atagaggccggttcagttatctgac

SEQ ID NO: 651926 - DNA, 25 bp, Homo sapien
gaggccggttcagttatctgactac

SEQ ID NO: 651927 - DNA, 25 bp, Homo sapien
ggccggttcagttatctgactacac

SEQ ID NO: 651928 - DNA, 25 bp, Homo sapien
ggttcagttatctgactacactcat

SEQ ID NO: 651929 - DNA, 25 bp, Homo sapien
cagttatctgactacactcatccag

SEQ ID NO: 651930 - DNA, 25 bp, Homo sapien
cactcatccagcacaactacaggaa

SEQ ID NO: 651931 - DNA, 25 bp, Homo sapien
ccagcacaactacaggaaatttaag

SEQ ID NO: 651932 - DNA, 25 bp, Homo sapien
aatgggtttaatctgccaaagcatc

SEQ ID NO: 651933 - DNA, 25 bp, Homo sapien
aaagcatctccctctttacaagcat

SEQ ID NO: 651934 - DNA, 25 bp, Homo sapien
tctttacaagcatctacacaggcct

SEQ ID NO: 651935 - DNA, 25 bp, Homo sapien
agccctaagtactttcacctggaca

SEQ ID NO: 651936 - DNA, 25 bp, Homo sapien
tcacctggacaatgttatgaagctt

SEQ ID NO: 651937 - DNA, 25 bp, Homo sapien
atgaagcttaatccagtactagtag

SEQ ID NO: 651938 - DNA, 25 bp, Homo sapien
aagacttgtttactttggagctaag

SEQ ID NO: 651939 - DNA, 25 bp, Homo sapien
gtgagtaggacacttaagactttgt

SEQ ID NO: 651940 - DNA, 25 bp, Homo sapien
tgttttgtccttggactcaaggcaa

SEQ ID NO: 651941 - DNA, 25 bp, Homo sapien
aaactaatggttagcatcactccag

SEQ ID NO: 651942 - DNA, 25 bp, Homo sapien
catcactccagttgttgctatcatt

SEQ ID NO: 651943 - DNA, 25 bp, Homo sapien
gtagagccagagtagttcgtaccca

SEQ ID NO: 651944 - DNA, 25 bp, Homo sapien
gagtagttcgtacccagccttttca

SEQ ID NO: 651945 - DNA, 25 bp, Homo sapien
agccttttcacgtaactcggccgag

SEQ ID NO: 651946 - DNA, 25 bp, Homo sapien
gaattttttccgtcaggcccagatt

SEQ ID NO: 651947 - DNA, 25 bp, Homo sapien
cgtcaggcccagattagcagatttt

SEQ ID NO: 651948 - DNA, 25 bp, Homo sapien
gtcagctgggagaggcgttaacttt

SEQ ID NO: 651949 - DNA, 25 bp, Homo sapien
gttaacttttcttcgcacactcttg

SEQ ID NO: 651950 - DNA, 25 bp, Homo sapien
ttgctttgtgcgctcaaccacagtc

SEQ ID NO: 651951 - DNA, 25 bp, Homo sapien
aaccacagtctgaattctcgcagag

SEQ ID NO: 651952 - DNA, 25 bp, Homo sapien
aattctcgcagaggcgttccttgag

SEQ ID NO: 651953 - DNA, 25 bp, Homo sapien
gttccttgagtagcccttggccaca

SEQ ID NO: 651954 - DNA, 25 bp, Homo sapien
agtgctctctgtctactctatctag

SEQ ID NO: 651955 - DNA, 25 bp, Homo sapien
ctctctgtctactctatctagctaa

SEQ ID NO: 651956 - DNA, 25 bp, Homo sapien
agtggggactgggacaacctttatg

SEQ ID NO: 651957 - DNA, 25 bp, Homo sapien
ggtttgtaaatataccaatcagtac

SEQ ID NO: 651958 - DNA, 25 bp, Homo sapien
caatcagctctctgtaagtggacca

SEQ ID NO: 651959 - DNA, 25 bp, Homo sapien
atcagctctctgtaagtggaccaat

SEQ ID NO: 651960 - DNA, 25 bp, Homo sapien
cagctctctgtaagtggaccaatcc

SEQ ID NO: 651961 - DNA, 25 bp, Homo sapien
agctctctgtaagtggaccaatcca

SEQ ID NO: 651962 - DNA, 25 bp, Homo sapien
gtaagtggaccaatccactgtctgt

SEQ ID NO: 651963 - DNA, 25 bp, Homo sapien
aagtggaccaatccactgtctgtaa

SEQ ID NO: 651964 - DNA, 25 bp, Homo sapien
tggaccaatccactgtctgtaaaat

SEQ ID NO: 651965 - DNA, 25 bp, Homo sapien
ggacgggatgaagaaacggaggcac

SEQ ID NO: 651966 - DNA, 25 bp, Homo sapien
gatgctgaagcccttgaccgagtca

SEQ ID NO: 651967 - DNA, 25 bp, Homo sapien
tgctgaagcccttgaccgagtcacg

SEQ ID NO: 651968 - DNA, 25 bp, Homo sapien
tgaagcccttgaccgagtcacgtgt

SEQ ID NO: 651969 - DNA, 25 bp, Homo sapien
aagcccttgaccgagtcacgtgtca

SEQ ID NO: 651970 - DNA, 25 bp, Homo sapien
ccttgaccgagtcacgtgtcagtaa

SEQ ID NO: 651971 - DNA, 25 bp, Homo sapien
gaccgagtcacgtgtcagtaaatga

SEQ ID NO: 651972 - DNA, 25 bp, Homo sapien
gagtcacgtgtcagtaaatgacaga

SEQ ID NO: 651973 - DNA, 25 bp, Homo sapien
tgtgaccctgaaccatgacattccc

SEQ ID NO: 651974 - DNA, 25 bp, Homo sapien
cctgaaccatgacattcccctttaa

SEQ ID NO: 651975 - DNA, 25 bp, Homo sapien
tgaaccatgacattcccctttaacc

SEQ ID NO: 651976 - DNA, 25 bp, Homo sapien
aacaacttacatctctttgattact

SEQ ID NO: 651977 - DNA, 25 bp, Homo sapien
cttacatctctttgattacttttgt

SEQ ID NO: 651978 - DNA, 25 bp, Homo sapien
tgactgtttgtgttttaaactgacc

SEQ ID NO: 651979 - DNA, 25 bp, Homo sapien
gttcagttcaattctattattatga

SEQ ID NO: 651980 - DNA, 25 bp, Homo sapien
ctattattatgatgtggctgacctc

SEQ ID NO: 651981 - DNA, 25 bp, Homo sapien
caacctattactccttcctatttgt

SEQ ID NO: 651982 - DNA, 25 bp, Homo sapien
tattactccttcctatttgtcactc

SEQ ID NO: 651983 - DNA, 25 bp, Homo sapien
actccttcctatttgtcactctggg

SEQ ID NO: 651984 - DNA, 25 bp, Homo sapien
tggtagtgtacttatcttgcaaaat

SEQ ID NO: 651985 - DNA, 25 bp, Homo sapien
atcttgcaaaatattgcactgtggt

SEQ ID NO: 651986 - DNA, 25 bp, Homo sapien
gcactgtggtaatatgattatttca

SEQ ID NO: 651987 - DNA, 25 bp, Homo sapien
gccttgacagcccaggctcaagtga

SEQ ID NO: 651988 - DNA, 25 bp, Homo sapien
cacacccagctaatatttaaatttt

SEQ ID NO: 651989 - DNA, 25 bp, Homo sapien
gtagagatgggagtctcagtatgtt

SEQ ID NO: 651990 - DNA, 25 bp, Homo sapien
tcccgaagtgctggaattagacatg

SEQ ID NO: 651991 - DNA, 25 bp, Homo sapien
cccgaagtgctggaattagacatga

SEQ ID NO: 651992 - DNA, 25 bp, Homo sapien
ccgaagtgctggaattagacatgag

SEQ ID NO: 651993 - DNA, 25 bp, Homo sapien
cgaagtgctggaattagacatgagc

SEQ ID NO: 651994 - DNA, 25 bp, Homo sapien
aagtgaatgtggagcctcagggcct

SEQ ID NO: 651995 - DNA, 25 bp, Homo sapien
gagcctcagggccttaatcttgaag

SEQ ID NO: 651996 - DNA, 25 bp, Homo sapien
aatcttgaagcaggctctctagaag

SEQ ID NO: 651997 - DNA, 25 bp, Homo sapien
gggactcgatgagatgctgttttct

SEQ ID NO: 651998 - DNA, 25 bp, Homo sapien
tttctcattgtgtttcagtgatgac

SEQ ID NO: 651999 - DNA, 25 bp, Homo sapien
tgaaaatttgttgccagcgtctatc

SEQ ID NO: 652000 - DNA, 25 bp, Homo sapien
gcgtctatctggaaacaatgttttg

SEQ ID NO: 652001 - DNA, 25 bp, Homo sapien
aatgttttgatgatccaccacccca

SEQ ID NO: 652002 - DNA, 25 bp, Homo sapien
cactttcttgcacatactccagaat

SEQ ID NO: 652003 - DNA, 25 bp, Homo sapien
atacatgtgatgctttgccttccat

SEQ ID NO: 652004 - DNA, 25 bp, Homo sapien
ctttgccttccatttacactatcat

SEQ ID NO: 652005 - DNA, 25 bp, Homo sapien
aaaacattccgaaaatgtccacagc

SEQ ID NO: 652006 - DNA, 25 bp, Homo sapien
aaacattccgaaaatgtccacagcc

SEQ ID NO: 652007 - DNA, 25 bp, Homo sapien
aacattccgaaaatgtccacagcct

SEQ ID NO: 652008 - DNA, 25 bp, Homo sapien
ccttaccctcagctcttggctgggt

SEQ ID NO: 652009 - DNA, 25 bp, Homo sapien
cttaccctcagctcttggctgggtc

SEQ ID NO: 652010 - DNA, 25 bp, Homo sapien
ttaccctcagctcttggctgggtct

SEQ ID NO: 652011 - DNA, 25 bp, Homo sapien
taccctcagctcttggctgggtctc

SEQ ID NO: 652012 - DNA, 25 bp, Homo sapien
accctcagctcttggctgggtctcc

SEQ ID NO: 652013 - DNA, 25 bp, Homo sapien
gctgggtctcccactatgccccatc

SEQ ID NO: 652014 - DNA, 25 bp, Homo sapien
tcacagcttgaactgaacacaatat

SEQ ID NO: 652015 - DNA, 25 bp, Homo sapien
cacagcttgaactgaacacaatatt

SEQ ID NO: 652016 - DNA, 25 bp, Homo sapien
tctctccccttgatggccacattta

SEQ ID NO: 652017 - DNA, 25 bp, Homo sapien
cacacactcataagaagacacctat

SEQ ID NO: 652018 - DNA, 25 bp, Homo sapien
gaaccattggtaagtaatttgcaca

SEQ ID NO: 652019 - DNA, 25 bp, Homo sapien
aatttgcacacaggatgtcccttca

SEQ ID NO: 652020 - DNA, 25 bp, Homo sapien
cagtccaccaatacttcggtgtgtt

SEQ ID NO: 652021 - DNA, 25 bp, Homo sapien
caatacttcggtgtgtttcctaaga

SEQ ID NO: 652022 - DNA, 25 bp, Homo sapien
tgtgtttcctaagaacaaaggcctt

SEQ ID NO: 652023 - DNA, 25 bp, Homo sapien
aaaggccttctggaagtttcacatt

SEQ ID NO: 652024 - DNA, 25 bp, Homo sapien
gaagtttcacattaattccatactg

SEQ ID NO: 652025 - DNA, 25 bp, Homo sapien
ttccatactggatctacagtccgag

SEQ ID NO: 652026 - DNA, 25 bp, Homo sapien
acagtccgagttcagatttcaccaa

SEQ ID NO: 652027 - DNA, 25 bp, Homo sapien
gggtgcctacatgatcaaccttcaa

SEQ ID NO: 652028 - DNA, 25 bp, Homo sapien
gtgcctacatgatcaaccttcaata

SEQ ID NO: 652029 - DNA, 25 bp, Homo sapien
gatcaaccttcaatataaaacacct

SEQ ID NO: 652030 - DNA, 25 bp, Homo sapien
cccctagcgaaatgtgtaaagtatt

SEQ ID NO: 652031 - DNA, 25 bp, Homo sapien
gatctgttttatcttctcaggccat

SEQ ID NO: 652032 - DNA, 25 bp, Homo sapien
tcttctcaggccataaagaatgctg

SEQ ID NO: 652033 - DNA, 25 bp, Homo sapien
gctgatgggagaaccattttcctaa

SEQ ID NO: 652034 - DNA, 25 bp, Homo sapien
aaattgttgagctgtttgccataat

SEQ ID NO: 652035 - DNA, 25 bp, Homo sapien
ttgccataatgggtgagttcaaact

SEQ ID NO: 652036 - DNA, 25 bp, Homo sapien
gggtgagttcaaactaaaagcattt

SEQ ID NO: 652037 - DNA, 25 bp, Homo sapien
agcatttttcagcaataattaaagg

SEQ ID NO: 652038 - DNA, 25 bp, Homo sapien
gatgcaagaaacctttgttaacttg

SEQ ID NO: 652039 - DNA, 25 bp, Homo sapien
acctttgttaacttggcctctatag

SEQ ID NO: 652040 - DNA, 25 bp, Homo sapien
ctttgttaacttggcctctataggg

SEQ ID NO: 652041 - DNA, 25 bp, Homo sapien
aaactgggaggagaagaacattgaa

SEQ ID NO: 652042 - DNA, 25 bp, Homo sapien
gaaagaaggtagtcagtttggagaa

SEQ ID NO: 652043 - DNA, 25 bp, Homo sapien
ttggagaaaccatcagtcagactcc

SEQ ID NO: 652044 - DNA, 25 bp, Homo sapien
gagaaaccatcagtcagactccaaa

SEQ ID NO: 652045 - DNA, 25 bp, Homo sapien
accatcagtcagactccaaatccta

SEQ ID NO: 652046 - DNA, 25 bp, Homo sapien
tcagtcagactccaaatcctaaacc

SEQ ID NO: 652047 - DNA, 25 bp, Homo sapien
gtcagactccaaatcctaaaccaaa

SEQ ID NO: 652048 - DNA, 25 bp, Homo sapien
cagactccaaatcctaaaccaaaca

SEQ ID NO: 652049 - DNA, 25 bp, Homo sapien
gataatagcttaacctacagaataa

SEQ ID NO: 652050 - DNA, 25 bp, Homo sapien
ataatagcttaacctacagaataat

SEQ ID NO: 652051 - DNA, 25 bp, Homo sapien
gaataattgtttagactggctgggc

SEQ ID NO: 652052 - DNA, 25 bp, Homo sapien
aataattgtttagactggctgggca

SEQ ID NO: 652053 - DNA, 25 bp, Homo sapien
ataattgtttagactggctgggcat

SEQ ID NO: 652054 - DNA, 25 bp, Homo sapien
aggagcctggcctgaccagtatggt

SEQ ID NO: 652055 - DNA, 25 bp, Homo sapien
gagcctggcctgaccagtatggtga

SEQ ID NO: 652056 - DNA, 25 bp, Homo sapien
agcctggcctgaccagtatggtgat

SEQ ID NO: 652057 - DNA, 25 bp, Homo sapien
gcctggcctgaccagtatggtgata

SEQ ID NO: 652058 - DNA, 25 bp, Homo sapien
cctggcctgaccagtatggtgatac

SEQ ID NO: 652059 - DNA, 25 bp, Homo sapien
ctggcctgaccagtatggtgatacc

SEQ ID NO: 652060 - DNA, 25 bp, Homo sapien
ggaatacaggggcatgcctccacac

SEQ ID NO: 652061 - DNA, 25 bp, Homo sapien
gaatacaggggcatgcctccacacc

SEQ ID NO: 652062 - DNA, 25 bp, Homo sapien
aatacaggggcatgcctccacacct

SEQ ID NO: 652063 - DNA, 25 bp, Homo sapien
gggcatgcctccacacctagctaat

SEQ ID NO: 652064 - DNA, 25 bp, Homo sapien
tgagcgaccacgcccagccgacatt

SEQ ID NO: 652065 - DNA, 25 bp, Homo sapien
gagcgaccacgcccagccgacattc

SEQ ID NO: 652066 - DNA, 25 bp, Homo sapien
agcgaccacgcccagccgacattcc

SEQ ID NO: 652067 - DNA, 25 bp, Homo sapien
gcgaccacgcccagccgacattccc

SEQ ID NO: 652068 - DNA, 25 bp, Homo sapien
ccagccgacattcccaggttttctt

SEQ ID NO: 652069 - DNA, 25 bp, Homo sapien
cagccgacattcccaggttttcttt

SEQ ID NO: 652070 - DNA, 25 bp, Homo sapien
ttctttacgttttaataaatatgag

SEQ ID NO: 652071 - DNA, 25 bp, Homo sapien
gaaaaactgctatttatttgaccag

SEQ ID NO: 652072 - DNA, 25 bp, Homo sapien
ctgctatttatttgaccagaaaaac

SEQ ID NO: 652073 - DNA, 25 bp, Homo sapien
taagaaatggcaataactggcacat

SEQ ID NO: 652074 - DNA, 25 bp, Homo sapien
atggcaataactggcacatatacta

SEQ ID NO: 652075 - DNA, 25 bp, Homo sapien
ggcaataactggcacatatactaat

SEQ ID NO: 652076 - DNA, 25 bp, Homo sapien
aataactggcacatatactaattca

SEQ ID NO: 652077 - DNA, 25 bp, Homo sapien
aatattttcacaaagcaccaaatag

SEQ ID NO: 652078 - DNA, 25 bp, Homo sapien
aaagcaccaaatagaatagttccca

SEQ ID NO: 652079 - DNA, 25 bp, Homo sapien
gaatagttcccaatcttttcactga

SEQ ID NO: 652080 - DNA, 25 bp, Homo sapien
gcagtgacaccatcttagcttactg

SEQ ID NO: 652081 - DNA, 25 bp, Homo sapien
gtgacaccatcttagcttactgcag

SEQ ID NO: 652082 - DNA, 25 bp, Homo sapien
aaagtcattgccatacccaaggtaa

SEQ ID NO: 652083 - DNA, 25 bp, Homo sapien
gccatacccaaggtaatccaggttt

SEQ ID NO: 652084 - DNA, 25 bp, Homo sapien
gtggagggtataacgtctatgtcta

SEQ ID NO: 652085 - DNA, 25 bp, Homo sapien
aacgtctatgtctagattcattttt

SEQ ID NO: 652086 - DNA, 25 bp, Homo sapien
taaaaatctagttgtcagcaccatt

SEQ ID NO: 652087 - DNA, 25 bp, Homo sapien
ttgaaaatactgtctaccccattgt

SEQ ID NO: 652088 - DNA, 25 bp, Homo sapien
cggccagaagtttctaaatcttaat

SEQ ID NO: 652089 - DNA, 25 bp, Homo sapien
ctaaatcttaatgaagtccagctca

SEQ ID NO: 652090 - DNA, 25 bp, Homo sapien
atttctttcatggatcgctactttg

SEQ ID NO: 652091 - DNA, 25 bp, Homo sapien
gatcgctactttggtgttgtatcca

SEQ ID NO: 652092 - DNA, 25 bp, Homo sapien
gttgtatccaaaaagtcattgccat

SEQ ID NO: 652093 - DNA, 25 bp, Homo sapien
cagtgacaacatcatttctcttgaa

SEQ ID NO: 652094 - DNA, 25 bp, Homo sapien
cattgtgaattctatgcaacagtca

SEQ ID NO: 652095 - DNA, 25 bp, Homo sapien
tgcaacagtcataacatggcctatt

SEQ ID NO: 652096 - DNA, 25 bp, Homo sapien
taacatggcctattagaaccttacc

SEQ ID NO: 652097 - DNA, 25 bp, Homo sapien
tagaaccttaccattaccagtgcac

SEQ ID NO: 652098 - DNA, 25 bp, Homo sapien
taccagtgcaccttccatgttccaa

SEQ ID NO: 652099 - DNA, 25 bp, Homo sapien
gtatttcagctacactgcgaacaaa

SEQ ID NO: 652100 - DNA, 25 bp, Homo sapien
ctacactgcgaacaaagtgggcttt

SEQ ID NO: 652101 - DNA, 25 bp, Homo sapien
tttgatgagcttccctgaatgagcc

SEQ ID NO: 652102 - DNA, 25 bp, Homo sapien
tgagcttccctgaatgagccaccag

SEQ ID NO: 652103 - DNA, 25 bp, Homo sapien
gagccaccagtgacaacatcatttc

SEQ ID NO: 652104 - DNA, 25 bp, Homo sapien
ttttcatttatgttggttggtgcta

SEQ ID NO: 652105 - DNA, 25 bp, Homo sapien
ggttggtgctaatgtatctcttttc

SEQ ID NO: 652106 - DNA, 25 bp, Homo sapien
ttttcctttttctctatggacaata

SEQ ID NO: 652107 - DNA, 25 bp, Homo sapien
tatggacaatacaactactatggat

SEQ ID NO: 652108 - DNA, 25 bp, Homo sapien
tttccctgtttaatagcattcctaa

SEQ ID NO: 652109 - DNA, 25 bp, Homo sapien
gcattcctaaatcattagtgtgtta

SEQ ID NO: 652110 - DNA, 25 bp, Homo sapien
gaatttgctataattatggtccaat

SEQ ID NO: 652111 - DNA, 25 bp, Homo sapien
ggtccaatgaccaggctttcttaat

SEQ ID NO: 652112 - DNA, 25 bp, Homo sapien
gaccaggctttcttaatgtaaaaca

SEQ ID NO: 652113 - DNA, 25 bp, Homo sapien
cagtgtaccaatagatgatgtgtgt

SEQ ID NO: 652114 - DNA, 25 bp, Homo sapien
aatagatgatgtgtgtttactcgga

SEQ ID NO: 652115 - DNA, 25 bp, Homo sapien
atggggaaaggtctttcttgccctg

SEQ ID NO: 652116 - DNA, 25 bp, Homo sapien
tgccctgttcccgtgatagtgaata

SEQ ID NO: 652117 - DNA, 25 bp, Homo sapien
agatctgatggctgtataaggtgga

SEQ ID NO: 652118 - DNA, 25 bp, Homo sapien
gatggctgtataaggtggagtttcc

SEQ ID NO: 652119 - DNA, 25 bp, Homo sapien
ggctgtataaggtggagtttccttg

SEQ ID NO: 652120 - DNA, 25 bp, Homo sapien
ttccttgcacaagctttttttcacc

SEQ ID NO: 652121 - DNA, 25 bp, Homo sapien
aagctttttttcacctgctgccatc

SEQ ID NO: 652122 - DNA, 25 bp, Homo sapien
ccatccacgtaagatcgtaagatgt

SEQ ID NO: 652123 - DNA, 25 bp, Homo sapien
cacgtaagatcgtaagatgtgactt

SEQ ID NO: 652124 - DNA, 25 bp, Homo sapien
cttgggtatgtctttgtcagttgca

SEQ ID NO: 652125 - DNA, 25 bp, Homo sapien
tgggtatgtctttgtcagttgcatg

SEQ ID NO: 652126 - DNA, 25 bp, Homo sapien
gtgccatttaggatgtactgcataa

SEQ ID NO: 652127 - DNA, 25 bp, Homo sapien
atgtactgcataagtttttggctgg

SEQ ID NO: 652128 - DNA, 25 bp, Homo sapien
gctgggattttaggactgaaataca

SEQ ID NO: 652129 - DNA, 25 bp, Homo sapien
gaaatacatgtaggtggccatcaaa

SEQ ID NO: 652130 - DNA, 25 bp, Homo sapien
atacatgtaggtggccatcaaatca

SEQ ID NO: 652131 - DNA, 25 bp, Homo sapien
taggtggccatcaaatcagggtttc

SEQ ID NO: 652132 - DNA, 25 bp, Homo sapien
gtggccatcaaatcagggtttcatt

SEQ ID NO: 652133 - DNA, 25 bp, Homo sapien
gccatcaaatcagggtttcattgta

SEQ ID NO: 652134 - DNA, 25 bp, Homo sapien
tcaaatcagggtttcattgtatcac

SEQ ID NO: 652135 - DNA, 25 bp, Homo sapien
tgtagtgactactggggcctatagt

SEQ ID NO: 652136 - DNA, 25 bp, Homo sapien
gagccatcatctcgccattgcattc

SEQ ID NO: 652137 - DNA, 25 bp, Homo sapien
ctggctgctgtttcttattcacacg

SEQ ID NO: 652138 - DNA, 25 bp, Homo sapien
tgtttcttattcacacgccacgtaa

SEQ ID NO: 652139 - DNA, 25 bp, Homo sapien
cacgccacgtaagcccttatatgtg

SEQ ID NO: 652140 - DNA, 25 bp, Homo sapien
gatggttgccatcacaaattgtctt

SEQ ID NO: 652141 - DNA, 25 bp, Homo sapien
caaattgtctttgtgtcattcctga

SEQ ID NO: 652142 - DNA, 25 bp, Homo sapien
attcctgagttcataggttcagacc

SEQ ID NO: 652143 - DNA, 25 bp, Homo sapien
aaacaggcaggaaatgcttaggact

SEQ ID NO: 652144 - DNA, 25 bp, Homo sapien
ttaggacttccttgtattgcctcag

SEQ ID NO: 652145 - DNA, 25 bp, Homo sapien
tattgcctcagcttaggatcgtaga

SEQ ID NO: 652146 - DNA, 25 bp, Homo sapien
atggcaaaactactggcctcagtgg

SEQ ID NO: 652147 - DNA, 25 bp, Homo sapien
gcctcagtggatgatattcttacgt

SEQ ID NO: 652148 - DNA, 25 bp, Homo sapien
ggttttggctcagatgaagaagtca

SEQ ID NO: 652149 - DNA, 25 bp, Homo sapien
gaagaagtcagagtgcgaagtccca

SEQ ID NO: 652150 - DNA, 25 bp, Homo sapien
aagtcagagtgcgaagtcccacaag

SEQ ID NO: 652151 - DNA, 25 bp, Homo sapien
agagtgcgaagtcccacaaggtctc

SEQ ID NO: 652152 - DNA, 25 bp, Homo sapien
gaagtcccacaaggtctccttcagt

SEQ ID NO: 652153 - DNA, 25 bp, Homo sapien
tcccacaaggtctccttcagttaaa

SEQ ID NO: 652154 - DNA, 25 bp, Homo sapien
caaggtctccttcagttaaaactag

SEQ ID NO: 652155 - DNA, 25 bp, Homo sapien
tccttcagttaaaactagtcctcga

SEQ ID NO: 652156 - DNA, 25 bp, Homo sapien
tagtcctcgaaaacctcgtgggaga

SEQ ID NO: 652157 - DNA, 25 bp, Homo sapien
tcgaaaacctcgtgggagacctaga

SEQ ID NO: 652158 - DNA, 25 bp, Homo sapien
tcgtgggagacctagaagtggctct

SEQ ID NO: 652159 - DNA, 25 bp, Homo sapien
acatagccataaaagtatgccctta

SEQ ID NO: 652160 - DNA, 25 bp, Homo sapien
aaagtatgcccttaaagaatatttg

SEQ ID NO: 652161 - DNA, 25 bp, Homo sapien
gacagaaggaaatataccacagtgc

SEQ ID NO: 652162 - DNA, 25 bp, Homo sapien
taatagtggagcattgggcacaact

SEQ ID NO: 652163 - DNA, 25 bp, Homo sapien
gcattgggcacaactgaaatggcca

SEQ ID NO: 652164 - DNA, 25 bp, Homo sapien
ggcacaactgaaatggccaatcttg

SEQ ID NO: 652165 - DNA, 25 bp, Homo sapien
actgaaatggccaatcttgtgagaa

SEQ ID NO: 652166 - DNA, 25 bp, Homo sapien
atggccaatcttgtgagaatggtaa

SEQ ID NO: 652167 - DNA, 25 bp, Homo sapien
ataaacttaggtccgtgagtaagtg

SEQ ID NO: 652168 - DNA, 25 bp, Homo sapien
cttaggtccgtgagtaagtggagta

SEQ ID NO: 652169 - DNA, 25 bp, Homo sapien
gtaagtggagtattacatagccata

SEQ ID NO: 652170 - DNA, 25 bp, Homo sapien
atcatcaccgtcagccttagcgtca

SEQ ID NO: 652171 - DNA, 25 bp, Homo sapien
accgtcagccttagcgtcactgtcg

SEQ ID NO: 652172 - DNA, 25 bp, Homo sapien
tgcggcctctgccactggtgtcagc

SEQ ID NO: 652173 - DNA, 25 bp, Homo sapien
tgccactggtgtcagcgcaaactgg

SEQ ID NO: 652174 - DNA, 25 bp, Homo sapien
tggtgtcagcgcaaactgggcaaac

SEQ ID NO: 652175 - DNA, 25 bp, Homo sapien
gtcagcgcaaactgggcaaacgcta

SEQ ID NO: 652176 - DNA, 25 bp, Homo sapien
gcaaactgggcaaacgctacaagaa

SEQ ID NO: 652177 - DNA, 25 bp, Homo sapien
tgggcaaacgctacaagaattcctt

SEQ ID NO: 652178 - DNA, 25 bp, Homo sapien
gcaaacgctacaagaattccttgga

SEQ ID NO: 652179 - DNA, 25 bp, Homo sapien
aattccttggagacggtgggcacgc

SEQ ID NO: 652180 - DNA, 25 bp, Homo sapien
agacggtgggcacgccagactcagg

SEQ ID NO: 652181 - DNA, 25 bp, Homo sapien
caacatggcaagagcccatgtctat

SEQ ID NO: 652182 - DNA, 25 bp, Homo sapien
aacatggcaagagcccatgtctata

SEQ ID NO: 652183 - DNA, 25 bp, Homo sapien
acatggcaagagcccatgtctataa

SEQ ID NO: 652184 - DNA, 25 bp, Homo sapien
catggcaagagcccatgtctataaa

SEQ ID NO: 652185 - DNA, 25 bp, Homo sapien
atggcaagagcccatgtctataaaa

SEQ ID NO: 652186 - DNA, 25 bp, Homo sapien
tggcaagagcccatgtctataaaaa

SEQ ID NO: 652187 - DNA, 25 bp, Homo sapien
ggcaagagcccatgtctataaaaaa

SEQ ID NO: 652188 - DNA, 25 bp, Homo sapien
gcaagagcccatgtctataaaaaat

SEQ ID NO: 652189 - DNA, 25 bp, Homo sapien
acatatacagtcattcttcgctcaa

SEQ ID NO: 652190 - DNA, 25 bp, Homo sapien
agtcattcttcgctcaatggtgaga

SEQ ID NO: 652191 - DNA, 25 bp, Homo sapien
gagtccttaggtgattttgtcatgt

SEQ ID NO: 652192 - DNA, 25 bp, Homo sapien
gacatcatagagtgtccttacatga

SEQ ID NO: 652193 - DNA, 25 bp, Homo sapien
gtccttacatgaacctagatggtat

SEQ ID NO: 652194 - DNA, 25 bp, Homo sapien
ataacctacttcacacctaggctac

SEQ ID NO: 652195 - DNA, 25 bp, Homo sapien
acctaggctacgtgataagcccatt

SEQ ID NO: 652196 - DNA, 25 bp, Homo sapien
tgataagcccattgcttctaggcta

SEQ ID NO: 652197 - DNA, 25 bp, Homo sapien
gttaccgtatggaacattgcagcca

SEQ ID NO: 652198 - DNA, 25 bp, Homo sapien
acattgcagccaattctaacacaat

SEQ ID NO: 652199 - DNA, 25 bp, Homo sapien
tttgtggatctaagcatgtgtaaac

SEQ ID NO: 652200 - DNA, 25 bp, Homo sapien
tgcggcaaacccctacttctggttt

SEQ ID NO: 652201 - DNA, 25 bp, Homo sapien
ttggaacccctttgttattcatgag

SEQ ID NO: 652202 - DNA, 25 bp, Homo sapien
cctccttcggaggtccatattgaaa

SEQ ID NO: 652203 - DNA, 25 bp, Homo sapien
tattgaaactctggaggcggccgat

SEQ ID NO: 652204 - DNA, 25 bp, Homo sapien
gatacctaggcgcaggcctctcttc

SEQ ID NO: 652205 - DNA, 25 bp, Homo sapien
ttgttactgccacctctttgttcat

SEQ ID NO: 652206 - DNA, 25 bp, Homo sapien
atctggcccagctggcaaagagatt

SEQ ID NO: 652207 - DNA, 25 bp, Homo sapien
agattctgcgggaggtcatccttga

SEQ ID NO: 652208 - DNA, 25 bp, Homo sapien
ggtcatccttgatggaagggcccat

SEQ ID NO: 652209 - DNA, 25 bp, Homo sapien
gatggaagggcccatccgtcatctc

SEQ ID NO: 652210 - DNA, 25 bp, Homo sapien
tcatctccctggtagataggcaccc

SEQ ID NO: 652211 - DNA, 25 bp, Homo sapien
ggccacagagcattaagccccaagc

SEQ ID NO: 652212 - DNA, 25 bp, Homo sapien
ttaagccccaagcactaacaattct

SEQ ID NO: 652213 - DNA, 25 bp, Homo sapien
ttctgagggtaaggccctaagctac

SEQ ID NO: 652214 - DNA, 25 bp, Homo sapien
taagctacctgattgcatgcctctg

SEQ ID NO: 652215 - DNA, 25 bp, Homo sapien
ctgcctccagaaaattttccctgac

SEQ ID NO: 652216 - DNA, 25 bp, Homo sapien
tccagaaaattttccctgaccaggc

SEQ ID NO: 652217 - DNA, 25 bp, Homo sapien
tgttcttcctatttaacccatgctt

SEQ ID NO: 652218 - DNA, 25 bp, Homo sapien
tatttaacccatgcttgcctttgtc

SEQ ID NO: 652219 - DNA, 25 bp, Homo sapien
tgcctttgtcgctgcacttagtaca

SEQ ID NO: 652220 - DNA, 25 bp, Homo sapien
gtcgctgcacttagtacattatatt

SEQ ID NO: 652221 - DNA, 25 bp, Homo sapien
ttcataaggtcaaggaattcggtta

SEQ ID NO: 652222 - DNA, 25 bp, Homo sapien
cacactgcccgagggtgccacggcc

SEQ ID NO: 652223 - DNA, 25 bp, Homo sapien
cactgcccgagggtgccacggccaa

SEQ ID NO: 652224 - DNA, 25 bp, Homo sapien
actgcccgagggtgccacggccaac

SEQ ID NO: 652225 - DNA, 25 bp, Homo sapien
ctgcccgagggtgccacggccaacg

SEQ ID NO: 652226 - DNA, 25 bp, Homo sapien
tgcccgagggtgccacggccaacgg

SEQ ID NO: 652227 - DNA, 25 bp, Homo sapien
cccgagggtgccacggccaacggca

SEQ ID NO: 652228 - DNA, 25 bp, Homo sapien
ccgagggtgccacggccaacggcat

SEQ ID NO: 652229 - DNA, 25 bp, Homo sapien
cgagggtgccacggccaacggcatg

SEQ ID NO: 652230 - DNA, 25 bp, Homo sapien
gggtgccacggccaacggcatgaag

SEQ ID NO: 652231 - DNA, 25 bp, Homo sapien
ggtgccacggccaacggcatgaagg

SEQ ID NO: 652232 - DNA, 25 bp, Homo sapien
gtgccacggccaacggcatgaaggc

SEQ ID NO: 652233 - DNA, 25 bp, Homo sapien
gaggtcggggtgaaaggatcatttg

SEQ ID NO: 652234 - DNA, 25 bp, Homo sapien
tcggggtgaaaggatcatttgagcc

SEQ ID NO: 652235 - DNA, 25 bp, Homo sapien
aagtaaaataacagtcagccaggca

SEQ ID NO: 652236 - DNA, 25 bp, Homo sapien
agtaaaataacagtcagccaggcat

SEQ ID NO: 652237 - DNA, 25 bp, Homo sapien
gtaaaataacagtcagccaggcatg

SEQ ID NO: 652238 - DNA, 25 bp, Homo sapien
taaaataacagtcagccaggcatgg

SEQ ID NO: 652239 - DNA, 25 bp, Homo sapien
ggtgacagggagagatcccttctct

SEQ ID NO: 652240 - DNA, 25 bp, Homo sapien
gtgacagggagagatcccttctctt

SEQ ID NO: 652241 - DNA, 25 bp, Homo sapien
tgacagggagagatcccttctcttg

SEQ ID NO: 652242 - DNA, 25 bp, Homo sapien
gacagggagagatcccttctcttgg

SEQ ID NO: 652243 - DNA, 25 bp, Homo sapien
acagggagagatcccttctcttgga

SEQ ID NO: 652244 - DNA, 25 bp, Homo sapien
tttccaaaatggttctcgctctccg

SEQ ID NO: 652245 - DNA, 25 bp, Homo sapien
atggttctcgctctccgctgaagat

SEQ ID NO: 652246 - DNA, 25 bp, Homo sapien
tccgctgaagatgggccaccgttgg

SEQ ID NO: 652247 - DNA, 25 bp, Homo sapien
aatagccaagagacagacgccttcg

SEQ ID NO: 652248 - DNA, 25 bp, Homo sapien
gacgccttcgcctcaaaaatattct

SEQ ID NO: 652249 - DNA, 25 bp, Homo sapien
aggaaacaagtctcttcagtcacaa

SEQ ID NO: 652250 - DNA, 25 bp, Homo sapien
agtctcttcagtcacaaaatgtcgt

SEQ ID NO: 652251 - DNA, 25 bp, Homo sapien
cacaaaatgtcgtacatcccgcata

SEQ ID NO: 652252 - DNA, 25 bp, Homo sapien
aatgtcgtacatcccgcatatacta

SEQ ID NO: 652253 - DNA, 25 bp, Homo sapien
gtacatcccgcatatactagattca

SEQ ID NO: 652254 - DNA, 25 bp, Homo sapien
tcccgcatatactagattcaattaa

SEQ ID NO: 652255 - DNA, 25 bp, Homo sapien
aggaaatggcctggaagctagcaaa

SEQ ID NO: 652256 - DNA, 25 bp, Homo sapien
aaatggcctggaagctagcaaaagc

SEQ ID NO: 652257 - DNA, 25 bp, Homo sapien
ggcctggaagctagcaaaagctttt

SEQ ID NO: 652258 - DNA, 25 bp, Homo sapien
gcaaaagcttttgcagagaactgaa

SEQ ID NO: 652259 - DNA, 25 bp, Homo sapien
tgcagagaactgaaactgtgtcaca

SEQ ID NO: 652260 - DNA, 25 bp, Homo sapien
aactgtgtcacagagcaccagcact

SEQ ID NO: 652261 - DNA, 25 bp, Homo sapien
ttgtttgatgtgttaagcccctagc

SEQ ID NO: 652262 - DNA, 25 bp, Homo sapien
gtttgatgtgttaagcccctagcta

SEQ ID NO: 652263 - DNA, 25 bp, Homo sapien
gtgttaagcccctagctaagacaaa

SEQ ID NO: 652264 - DNA, 25 bp, Homo sapien
gcccctagctaagacaaaaagacag

SEQ ID NO: 652265 - DNA, 25 bp, Homo sapien
aaatgtttgctctataatatttaat

SEQ ID NO: 652266 - DNA, 25 bp, Homo sapien
aaggatgcaggatgaacattacaaa

SEQ ID NO: 652267 - DNA, 25 bp, Homo sapien
atcaaggaacatctgaataaatgga

SEQ ID NO: 652268 - DNA, 25 bp, Homo sapien
acatacacaagcttattctacgtgg

SEQ ID NO: 652269 - DNA, 25 bp, Homo sapien
acacaagcttattctacgtggaaaa

SEQ ID NO: 652270 - DNA, 25 bp, Homo sapien
ttctacgtggaaaaacacaggtcca

SEQ ID NO: 652271 - DNA, 25 bp, Homo sapien
aggtccaaaaatgtccacaagattt

SEQ ID NO: 652272 - DNA, 25 bp, Homo sapien
caggagagccccttggtagatccat

SEQ ID NO: 652273 - DNA, 25 bp, Homo sapien
agagccccttggtagatccatcttg

SEQ ID NO: 652274 - DNA, 25 bp, Homo sapien
gccccttggtagatccatcttggag

SEQ ID NO: 652275 - DNA, 25 bp, Homo sapien
agatccatcttggagctgtgtccag

SEQ ID NO: 652276 - DNA, 25 bp, Homo sapien
atcttggagctgtgtccagcagcct

SEQ ID NO: 652277 - DNA, 25 bp, Homo sapien
gtattctgtgaatggatacactttt

SEQ ID NO: 652278 - DNA, 25 bp, Homo sapien
ggatacacttttggaagtctcccag

SEQ ID NO: 652279 - DNA, 25 bp, Homo sapien
tacacttttggaagtctcccaggac

SEQ ID NO: 652280 - DNA, 25 bp, Homo sapien
cacttttggaagtctcccaggactc

SEQ ID NO: 652281 - DNA, 25 bp, Homo sapien
tggtacctttttggtatgggtaatg

SEQ ID NO: 652282 - DNA, 25 bp, Homo sapien
gaaaaacatattgaccgagaatttg

SEQ ID NO: 652283 - DNA, 25 bp, Homo sapien
catattgaccgagaatttgtggtga

SEQ ID NO: 652284 - DNA, 25 bp, Homo sapien
atgaaaatttcagctggtacctaga

SEQ ID NO: 652285 - DNA, 25 bp, Homo sapien
acaacattaaaacctactgctcaga

SEQ ID NO: 652286 - DNA, 25 bp, Homo sapien
aaaacctactgctcagaaccagaga

SEQ ID NO: 652287 - DNA, 25 bp, Homo sapien
tactgctcagaaccagagaaagttg

SEQ ID NO: 652288 - DNA, 25 bp, Homo sapien
ccaacatggcgcaggtacacatatg

SEQ ID NO: 652289 - DNA, 25 bp, Homo sapien
catggcgcaggtacacatatgtaac

SEQ ID NO: 652290 - DNA, 25 bp, Homo sapien
tgtttattgtccatttttaactaat

SEQ ID NO: 652291 - DNA, 25 bp, Homo sapien
gcaagcttactaaaaactgcacttc

SEQ ID NO: 652292 - DNA, 25 bp, Homo sapien
aaaaactgcacttcacacttagctt

SEQ ID NO: 652293 - DNA, 25 bp, Homo sapien
aaactgcacttcacacttagcttaa

SEQ ID NO: 652294 - DNA, 25 bp, Homo sapien
actgcacttcacacttagcttaatg

SEQ ID NO: 652295 - DNA, 25 bp, Homo sapien
gcacttcacacttagcttaatgttt

SEQ ID NO: 652296 - DNA, 25 bp, Homo sapien
ttcacacttagcttaatgtttgagg

SEQ ID NO: 652297 - DNA, 25 bp, Homo sapien
cacttagcttaatgtttgagggaat

SEQ ID NO: 652298 - DNA, 25 bp, Homo sapien
taatgtttgagggaattaacttcat

SEQ ID NO: 652299 - DNA, 25 bp, Homo sapien
aaatctctacgctaaggtggatagg

SEQ ID NO: 652300 - DNA, 25 bp, Homo sapien
tctacgctaaggtggataggactcc

SEQ ID NO: 652301 - DNA, 25 bp, Homo sapien
gctaaggtggataggactccatagt

SEQ ID NO: 652302 - DNA, 25 bp, Homo sapien
cacagcagagtgcatgagccctgga

SEQ ID NO: 652303 - DNA, 25 bp, Homo sapien
acccatgcatgtgagaccagcagtt

SEQ ID NO: 652304 - DNA, 25 bp, Homo sapien
atgcatgtgagaccagcagttccct

SEQ ID NO: 652305 - DNA, 25 bp, Homo sapien
atgtgagaccagcagttccctcttc

SEQ ID NO: 652306 - DNA, 25 bp, Homo sapien
tcccccagtgattctctggaagata

SEQ ID NO: 652307 - DNA, 25 bp, Homo sapien
gattctctggaagataaatctctac

SEQ ID NO: 652308 - DNA, 25 bp, Homo sapien
ggaagataaatctctacgctaaggt

SEQ ID NO: 652309 - DNA, 25 bp, Homo sapien
agataaatctctacgctaaggtgga

SEQ ID NO: 652310 - DNA, 25 bp, Homo sapien
tggccctgtgatgtagattttgatg

SEQ ID NO: 652311 - DNA, 25 bp, Homo sapien
ggccctgtgatgtagattttgatgc

SEQ ID NO: 652312 - DNA, 25 bp, Homo sapien
ggagtgcccggcgtctcttgggatc

SEQ ID NO: 652313 - DNA, 25 bp, Homo sapien
ccggcgtctcttgggatcggagcct

SEQ ID NO: 652314 - DNA, 25 bp, Homo sapien
ggcgtctcttgggatcggagcctcc

SEQ ID NO: 652315 - DNA, 25 bp, Homo sapien
gcgtctcttgggatcggagcctcct

SEQ ID NO: 652316 - DNA, 25 bp, Homo sapien
gtctcttgggatcggagcctcctga

SEQ ID NO: 652317 - DNA, 25 bp, Homo sapien
ctcttgggatcggagcctcctgaat

SEQ ID NO: 652318 - DNA, 25 bp, Homo sapien
tcttgggatcggagcctcctgaatt

SEQ ID NO: 652319 - DNA, 25 bp, Homo sapien
cttgggatcggagcctcctgaattc

SEQ ID NO: 652320 - DNA, 25 bp, Homo sapien
ctcctgaattccacgctgggacctt

SEQ ID NO: 652321 - DNA, 25 bp, Homo sapien
gttggaccctaaccttacctcatat

SEQ ID NO: 652322 - DNA, 25 bp, Homo sapien
ccctaaccttacctcatatgcaaaa

SEQ ID NO: 652323 - DNA, 25 bp, Homo sapien
ctcatagaagaaaacagggacaaat

SEQ ID NO: 652324 - DNA, 25 bp, Homo sapien
aaacagggacaaatcttcatgacaa

SEQ ID NO: 652325 - DNA, 25 bp, Homo sapien
agggacaaatcttcatgacaaatat

SEQ ID NO: 652326 - DNA, 25 bp, Homo sapien
aaatcttcatgacaaatatgtacaa

SEQ ID NO: 652327 - DNA, 25 bp, Homo sapien
atgaagagtctcagcatccttagtc

SEQ ID NO: 652328 - DNA, 25 bp, Homo sapien
gaagagtctcagcatccttagtcat

SEQ ID NO: 652329 - DNA, 25 bp, Homo sapien
agagtctcagcatccttagtcatta

SEQ ID NO: 652330 - DNA, 25 bp, Homo sapien
gagtctcagcatccttagtcattag

SEQ ID NO: 652331 - DNA, 25 bp, Homo sapien
gcaaatcaaaaacacagtgagctgt

SEQ ID NO: 652332 - DNA, 25 bp, Homo sapien
gtcacagatgaattatgggttttta

SEQ ID NO: 652333 - DNA, 25 bp, Homo sapien
atgggtttttaacatacatagtcag

SEQ ID NO: 652334 - DNA, 25 bp, Homo sapien
cctactgttcttggacatggtcagc

SEQ ID NO: 652335 - DNA, 25 bp, Homo sapien
ctgttcttggacatggtcagcagta

SEQ ID NO: 652336 - DNA, 25 bp, Homo sapien
cttggacatggtcagcagtatgctg

SEQ ID NO: 652337 - DNA, 25 bp, Homo sapien
agcagtatgctgtggagggacattc

SEQ ID NO: 652338 - DNA, 25 bp, Homo sapien
agggacattcagcacatattatgga

SEQ ID NO: 652339 - DNA, 25 bp, Homo sapien
ggacattcagcacatattatggagt

SEQ ID NO: 652340 - DNA, 25 bp, Homo sapien
gcacatattatggagttggatagta

SEQ ID NO: 652341 - DNA, 25 bp, Homo sapien
ggatattctgcaatatatggttata

SEQ ID NO: 652342 - DNA, 25 bp, Homo sapien
ggaataccatatctgtgagttactt

SEQ ID NO: 652343 - DNA, 25 bp, Homo sapien
aaaacattccgaaaatgtccacagc

SEQ ID NO: 652344 - DNA, 25 bp, Homo sapien
aacattccgaaaatgtccacagcct

SEQ ID NO: 652345 - DNA, 25 bp, Homo sapien
ttaccctcagctcttggctgggtct

SEQ ID NO: 652346 - DNA, 25 bp, Homo sapien
taccctcagctcttggctgggtctc

SEQ ID NO: 652347 - DNA, 25 bp, Homo sapien
gctgggtctcccactatgccccatc

SEQ ID NO: 652348 - DNA, 25 bp, Homo sapien
atatttttcttcacagcttgaactg

SEQ ID NO: 652349 - DNA, 25 bp, Homo sapien
ttttcttcacagcttgaactgaaca

SEQ ID NO: 652350 - DNA, 25 bp, Homo sapien
tcacagcttgaactgaacacaatat

SEQ ID NO: 652351 - DNA, 25 bp, Homo sapien
cacagcttgaactgaacacaatatt

SEQ ID NO: 652352 - DNA, 25 bp, Homo sapien
tgaactgaacacaatattgcccggt

SEQ ID NO: 652353 - DNA, 25 bp, Homo sapien
aactgaacacaatattgcccggttt

SEQ ID NO: 652354 - DNA, 25 bp, Homo sapien
gggatgcactgaagacgggcattca

SEQ ID NO: 652355 - DNA, 25 bp, Homo sapien
agacgggcattcaggcggatgcccc

SEQ ID NO: 652356 - DNA, 25 bp, Homo sapien
ctggtcagacccatcttcctgagca

SEQ ID NO: 652357 - DNA, 25 bp, Homo sapien
gacaggcagggacaaagctgattct

SEQ ID NO: 652358 - DNA, 25 bp, Homo sapien
gattctgagcagatctggcacaagg

SEQ ID NO: 652359 - DNA, 25 bp, Homo sapien
ggcacaaggaagtcaccagaaaaca

SEQ ID NO: 652360 - DNA, 25 bp, Homo sapien
caccagaaaacactattgggttcct

SEQ ID NO: 652361 - DNA, 25 bp, Homo sapien
tcctcaagggtaaagactggatctt

SEQ ID NO: 652362 - DNA, 25 bp, Homo sapien
ggatcttatccatcttgttgcccat

SEQ ID NO: 652363 - DNA, 25 bp, Homo sapien
gcaatcatgtgcactctgggaactt

SEQ ID NO: 652364 - DNA, 25 bp, Homo sapien
gtgcactctgggaacttggaaaata

SEQ ID NO: 652365 - DNA, 25 bp, Homo sapien
gttcttgatccagatgaaatctgat

SEQ ID NO: 652366 - DNA, 25 bp, Homo sapien
gaaatctgattgagcagtgtactta

SEQ ID NO: 652367 - DNA, 25 bp, Homo sapien
atctgattgagcagtgtacttacaa

SEQ ID NO: 652368 - DNA, 25 bp, Homo sapien
ctgattgagcagtgtacttacaagt

SEQ ID NO: 652369 - DNA, 25 bp, Homo sapien
gattgagcagtgtacttacaagttg

SEQ ID NO: 652370 - DNA, 25 bp, Homo sapien
gagcagtgtacttacaagttgtact

SEQ ID NO: 652371 - DNA, 25 bp, Homo sapien
gcagtgtacttacaagttgtactgt

SEQ ID NO: 652372 - DNA, 25 bp, Homo sapien
gtgtacttacaagttgtactgtgta

SEQ ID NO: 652373 - DNA, 25 bp, Homo sapien
caagttgtactgtgtatgtgtttcc

SEQ ID NO: 652374 - DNA, 25 bp, Homo sapien
ctgtgtatgtgtttcctatattgtt

SEQ ID NO: 652375 - DNA, 25 bp, Homo sapien
gtatgtgtttcctatattgttatat

SEQ ID NO: 652376 - DNA, 25 bp, Homo sapien
gaaaccacagatgctattacatatt

SEQ ID NO: 652377 - DNA, 25 bp, Homo sapien
aaccacagatgctattacatattaa

SEQ ID NO: 652378 - DNA, 25 bp, Homo sapien
ccacagatgctattacatattaaat

SEQ ID NO: 652379 - DNA, 25 bp, Homo sapien
gatgctattacatattaaattgata

SEQ ID NO: 652380 - DNA, 25 bp, Homo sapien
gataatataaccattacaggcgtga

SEQ ID NO: 652381 - DNA, 25 bp, Homo sapien
gaatataaacagaaaccacagatgc

SEQ ID NO: 652382 - DNA, 25 bp, Homo sapien
tataaacagaaaccacagatgctat

SEQ ID NO: 652383 - DNA, 25 bp, Homo sapien
taaacagaaaccacagatgctatta

SEQ ID NO: 652384 - DNA, 25 bp, Homo sapien
aacagaaaccacagatgctattaca

SEQ ID NO: 652385 - DNA, 25 bp, Homo sapien
acagaaaccacagatgctattacat

SEQ ID NO: 652386 - DNA, 25 bp, Homo sapien
cagaaaccacagatgctattacata

SEQ ID NO: 652387 - DNA, 25 bp, Homo sapien
caatcagataaaaagttgtcgggcc

SEQ ID NO: 652388 - DNA, 25 bp, Homo sapien
aatcagataaaaagttgtcgggcca

SEQ ID NO: 652389 - DNA, 25 bp, Homo sapien
atcagataaaaagttgtcgggccag

SEQ ID NO: 652390 - DNA, 25 bp, Homo sapien
tcagataaaaagttgtcgggccagt

SEQ ID NO: 652391 - DNA, 25 bp, Homo sapien
cagataaaaagttgtcgggccagtc

SEQ ID NO: 652392 - DNA, 25 bp, Homo sapien
agataaaaagttgtcgggccagtcg

SEQ ID NO: 652393 - DNA, 25 bp, Homo sapien
gataaaaagttgtcgggccagtcgt

SEQ ID NO: 652394 - DNA, 25 bp, Homo sapien
ataaaaagttgtcgggccagtcgtg

SEQ ID NO: 652395 - DNA, 25 bp, Homo sapien
taaaaagttgtcgggccagtcgtgg

SEQ ID NO: 652396 - DNA, 25 bp, Homo sapien
aaaagttgtcgggccagtcgtggtg

SEQ ID NO: 652397 - DNA, 25 bp, Homo sapien
aaagttgtcgggccagtcgtggtgg

SEQ ID NO: 652398 - DNA, 25 bp, Homo sapien
ccatgctgcggttcacaaaagtcca

SEQ ID NO: 652399 - DNA, 25 bp, Homo sapien
acaaaagtccagcatttggctagct

SEQ ID NO: 652400 - DNA, 25 bp, Homo sapien
aaagtccagcatttggctagcttcc

SEQ ID NO: 652401 - DNA, 25 bp, Homo sapien
agtccagcatttggctagcttcctg

SEQ ID NO: 652402 - DNA, 25 bp, Homo sapien
tccagcatttggctagcttcctggg

SEQ ID NO: 652403 - DNA, 25 bp, Homo sapien
tcagagccaaactaatgctatgcat

SEQ ID NO: 652404 - DNA, 25 bp, Homo sapien
gagccaaactaatgctatgcatgca

SEQ ID NO: 652405 - DNA, 25 bp, Homo sapien
aaactaatgctatgcatgcagctta

SEQ ID NO: 652406 - DNA, 25 bp, Homo sapien
taatgctatgcatgcagcttatgat

SEQ ID NO: 652407 - DNA, 25 bp, Homo sapien
gctatgcatgcagcttatgattttt

SEQ ID NO: 652408 - DNA, 25 bp, Homo sapien
gtcttcaacaaagtgaatacttact

SEQ ID NO: 652409 - DNA, 25 bp, Homo sapien
tgagccaccgtgctttgagttttta

SEQ ID NO: 652410 - DNA, 25 bp, Homo sapien
gagccaccgtgctttgagtttttac

SEQ ID NO: 652411 - DNA, 25 bp, Homo sapien
agccaccgtgctttgagtttttaca

SEQ ID NO: 652412 - DNA, 25 bp, Homo sapien
gagtttttacagtaagtcttggccg

SEQ ID NO: 652413 - DNA, 25 bp, Homo sapien
tttttacagtaagtcttggccggag

SEQ ID NO: 652414 - DNA, 25 bp, Homo sapien
ttttacagtaagtcttggccggagt

SEQ ID NO: 652415 - DNA, 25 bp, Homo sapien
tttacagtaagtcttggccggagtg

SEQ ID NO: 652416 - DNA, 25 bp, Homo sapien
ttacagtaagtcttggccggagtgc

SEQ ID NO: 652417 - DNA, 25 bp, Homo sapien
tacagtaagtcttggccggagtgca

SEQ ID NO: 652418 - DNA, 25 bp, Homo sapien
acagtaagtcttggccggagtgcag

SEQ ID NO: 652419 - DNA, 25 bp, Homo sapien
cagtaagtcttggccggagtgcagt

SEQ ID NO: 652420 - DNA, 25 bp, Homo sapien
ggaaacatgtacttctagactggac

SEQ ID NO: 652421 - DNA, 25 bp, Homo sapien
atgtacttctagactggacagtttt

SEQ ID NO: 652422 - DNA, 25 bp, Homo sapien
cagtttccaaatagagacatcactt

SEQ ID NO: 652423 - DNA, 25 bp, Homo sapien
tacatggatgtactgaacgaagaat

SEQ ID NO: 652424 - DNA, 25 bp, Homo sapien
gaataaagtctgtgttgcagtcctg

SEQ ID NO: 652425 - DNA, 25 bp, Homo sapien
gtgttgcagtcctgtctccattgac

SEQ ID NO: 652426 - DNA, 25 bp, Homo sapien
gtctccattgacttttacaaatatg

SEQ ID NO: 652427 - DNA, 25 bp, Homo sapien
gctttggatgaatcacctaagtttt

SEQ ID NO: 652428 - DNA, 25 bp, Homo sapien
gagaatttacgcttaccatgtataa

SEQ ID NO: 652429 - DNA, 25 bp, Homo sapien
tattgctaatatgtttgctgcctac

SEQ ID NO: 652430 - DNA, 25 bp, Homo sapien
tgctgcctaccccattgggttttgt

SEQ ID NO: 652431 - DNA, 25 bp, Homo sapien
aaaaaatggtaatatggctgggtgt

SEQ ID NO: 652432 - DNA, 25 bp, Homo sapien
aaaatggtaatatggctgggtgtga

SEQ ID NO: 652433 - DNA, 25 bp, Homo sapien
tacaaaacccacaaaagttagctag

SEQ ID NO: 652434 - DNA, 25 bp, Homo sapien
aacccacaaaagttagctaggtgtg

SEQ ID NO: 652435 - DNA, 25 bp, Homo sapien
gtagcacacgcctgtgttctcagtt

SEQ ID NO: 652436 - DNA, 25 bp, Homo sapien
tagcacacgcctgtgttctcagtta

SEQ ID NO: 652437 - DNA, 25 bp, Homo sapien
agcacacgcctgtgttctcagttac

SEQ ID NO: 652438 - DNA, 25 bp, Homo sapien
cacgcctgtgttctcagttactcag

SEQ ID NO: 652439 - DNA, 25 bp, Homo sapien
acgcctgtgttctcagttactcagg

SEQ ID NO: 652440 - DNA, 25 bp, Homo sapien
cttgagcgcaggaggtagacgctgc

SEQ ID NO: 652441 - DNA, 25 bp, Homo sapien
ttgagcgcaggaggtagacgctgca

SEQ ID NO: 652442 - DNA, 25 bp, Homo sapien
atgtaaagtatttccggacgtctct

SEQ ID NO: 652443 - DNA, 25 bp, Homo sapien
ggacgtctcttcgttgtatatggca

SEQ ID NO: 652444 - DNA, 25 bp, Homo sapien
cgttgtatatggcatttccctgaaa

SEQ ID NO: 652445 - DNA, 25 bp, Homo sapien
ttccctgaaataagcaactctctga

SEQ ID NO: 652446 - DNA, 25 bp, Homo sapien
aacaaagaaacttgccctcaggctg

SEQ ID NO: 652447 - DNA, 25 bp, Homo sapien
caggctgcacagtaaaacgttggaa

SEQ ID NO: 652448 - DNA, 25 bp, Homo sapien
ggaaatcccagagcagcaacttgga

SEQ ID NO: 652449 - DNA, 25 bp, Homo sapien
agcaacttggaaatcccacctgcta

SEQ ID NO: 652450 - DNA, 25 bp, Homo sapien
ccacctgctacatatttgcctgagt

SEQ ID NO: 652451 - DNA, 25 bp, Homo sapien
tggacaattgtctctctgcgtagat

SEQ ID NO: 652452 - DNA, 25 bp, Homo sapien
gtctctctgcgtagattaaccttaa

SEQ ID NO: 652453 - DNA, 25 bp, Homo sapien
tatagaaattatagcttaatggcca

SEQ ID NO: 652454 - DNA, 25 bp, Homo sapien
atagaaattatagcttaatggccag

SEQ ID NO: 652455 - DNA, 25 bp, Homo sapien
tagaaattatagcttaatggccagg

SEQ ID NO: 652456 - DNA, 25 bp, Homo sapien
agaaattatagcttaatggccaggt

SEQ ID NO: 652457 - DNA, 25 bp, Homo sapien
gaaattatagcttaatggccaggtg

SEQ ID NO: 652458 - DNA, 25 bp, Homo sapien
aaattatagcttaatggccaggtgc

SEQ ID NO: 652459 - DNA, 25 bp, Homo sapien
aattatagcttaatggccaggtgcg

SEQ ID NO: 652460 - DNA, 25 bp, Homo sapien
attatagcttaatggccaggtgcgg

SEQ ID NO: 652461 - DNA, 25 bp, Homo sapien
ttatagcttaatggccaggtgcggt

SEQ ID NO: 652462 - DNA, 25 bp, Homo sapien
tatagcttaatggccaggtgcggtg

SEQ ID NO: 652463 - DNA, 25 bp, Homo sapien
gggcgtggtggcatgctactgtaat

SEQ ID NO: 652464 - DNA, 25 bp, Homo sapien
gaggccagaagtagcaaatcattaa

SEQ ID NO: 652465 - DNA, 25 bp, Homo sapien
ccatgatggactatactcactctgt

SEQ ID NO: 652466 - DNA, 25 bp, Homo sapien
gtgcctgttctactttgtaaattcc

SEQ ID NO: 652467 - DNA, 25 bp, Homo sapien
gaatttttatctaggttgggccata

SEQ ID NO: 652468 - DNA, 25 bp, Homo sapien
ttgggccatatgtctctgcactaga

SEQ ID NO: 652469 - DNA, 25 bp, Homo sapien
actagatcagtcaaccatggccgaa

SEQ ID NO: 652470 - DNA, 25 bp, Homo sapien
catggccgaagagactggtagaagt

SEQ ID NO: 652471 - DNA, 25 bp, Homo sapien
agtgaccattggaagcatcattatg

SEQ ID NO: 652472 - DNA, 25 bp, Homo sapien
gcatcattatgagctctcgagccac

SEQ ID NO: 652473 - DNA, 25 bp, Homo sapien
gcaattacactggttttaccctcat

SEQ ID NO: 652474 - DNA, 25 bp, Homo sapien
gttttaccctcatttccttgagcca

SEQ ID NO: 652475 - DNA, 25 bp, Homo sapien
aagaatgttggttctgagctctgaa

SEQ ID NO: 652476 - DNA, 25 bp, Homo sapien
gagctctgaactaaggaatctggga

SEQ ID NO: 652477 - DNA, 25 bp, Homo sapien
ctgccaacccagaggtttactcctt

SEQ ID NO: 652478 - DNA, 25 bp, Homo sapien
ggtttactccttatctatggagcat

SEQ ID NO: 652479 - DNA, 25 bp, Homo sapien
atggagcataggtgaacccctggcc

SEQ ID NO: 652480 - DNA, 25 bp, Homo sapien
ctggcccatttcttggaacagcatg

SEQ ID NO: 652481 - DNA, 25 bp, Homo sapien
catttcttggaacagcatgtgcggg

SEQ ID NO: 652482 - DNA, 25 bp, Homo sapien
gccctttgttttgagctaggtggag

SEQ ID NO: 652483 - DNA, 25 bp, Homo sapien
gcaaagattgctatattaactgggt

SEQ ID NO: 652484 - DNA, 25 bp, Homo sapien
tgctatattaactgggtgcttttta

SEQ ID NO: 652485 - DNA, 25 bp, Homo sapien
aaccatagtggttaccccattcatc

SEQ ID NO: 652486 - DNA, 25 bp, Homo sapien
gggccttgctccatcacccgagctg

SEQ ID NO: 652487 - DNA, 25 bp, Homo sapien
ggccttgctccatcacccgagctgg

SEQ ID NO: 652488 - DNA, 25 bp, Homo sapien
gccttgctccatcacccgagctgga

SEQ ID NO: 652489 - DNA, 25 bp, Homo sapien
ccttgctccatcacccgagctggag

SEQ ID NO: 652490 - DNA, 25 bp, Homo sapien
aagtagtggggactattggtccatg

SEQ ID NO: 652491 - DNA, 25 bp, Homo sapien
agtagtggggactattggtccatgc

SEQ ID NO: 652492 - DNA, 25 bp, Homo sapien
gtagtggggactattggtccatgcc

SEQ ID NO: 652493 - DNA, 25 bp, Homo sapien
tagtggggactattggtccatgcca

SEQ ID NO: 652494 - DNA, 25 bp, Homo sapien
agtggggactattggtccatgccac

SEQ ID NO: 652495 - DNA, 25 bp, Homo sapien
gtggggactattggtccatgccacc

SEQ ID NO: 652496 - DNA, 25 bp, Homo sapien
tggggactattggtccatgccacca

SEQ ID NO: 652497 - DNA, 25 bp, Homo sapien
ggaacttgctggaacccctgatgca

SEQ ID NO: 652498 - DNA, 25 bp, Homo sapien
tggaacccctgatgcattttccttg

SEQ ID NO: 652499 - DNA, 25 bp, Homo sapien
gggtacttccgccttgccgttagct

SEQ ID NO: 652500 - DNA, 25 bp, Homo sapien
agaacgtgcttcttattcctggcag

SEQ ID NO: 652501 - DNA, 25 bp, Homo sapien
ttcctggcaggcttcaagaacagct

SEQ ID NO: 652502 - DNA, 25 bp, Homo sapien
agaacagctgcacatgtgccgctaa

SEQ ID NO: 652503 - DNA, 25 bp, Homo sapien
acatgtgccgctaactgaccgcgtt

SEQ ID NO: 652504 - DNA, 25 bp, Homo sapien
taactgaccgcgttgccattggcga

SEQ ID NO: 652505 - DNA, 25 bp, Homo sapien
attggcgacctggactctgaactca

SEQ ID NO: 652506 - DNA, 25 bp, Homo sapien
ggactctgaactcaggtttattcta

SEQ ID NO: 652507 - DNA, 25 bp, Homo sapien
gtgtgtgagcacctgacaaatctat

SEQ ID NO: 652508 - DNA, 25 bp, Homo sapien
actgcattcccgcagcgaaagagcg

SEQ ID NO: 652509 - DNA, 25 bp, Homo sapien
cattcccgcagcgaaagagcgagac

SEQ ID NO: 652510 - DNA, 25 bp, Homo sapien
tgctgctgccgactgcttcaacaca

SEQ ID NO: 652511 - DNA, 25 bp, Homo sapien
ctgccgactgcttcaacacattctt

SEQ ID NO: 652512 - DNA, 25 bp, Homo sapien
aacacattcttctgtccctgctgtt

SEQ ID NO: 652513 - DNA, 25 bp, Homo sapien
gtccctgctgtttagatgtcgtgtt

SEQ ID NO: 652514 - DNA, 25 bp, Homo sapien
cctgctgtttagatgtcgtgttgta

SEQ ID NO: 652515 - DNA, 25 bp, Homo sapien
agatgtcgtgttgtaggagcctgtt

SEQ ID NO: 652516 - DNA, 25 bp, Homo sapien
gtcgtgttgtaggagcctgttgctc

SEQ ID NO: 652517 - DNA, 25 bp, Homo sapien
gttgtaggagcctgttgctcagcct

SEQ ID NO: 652518 - DNA, 25 bp, Homo sapien
acacccagctaacgtctctactaaa

SEQ ID NO: 652519 - DNA, 25 bp, Homo sapien
aataccttcacagcactgtgctgta

SEQ ID NO: 652520 - DNA, 25 bp, Homo sapien
acagcactgtgctgtatttatcaat

SEQ ID NO: 652521 - DNA, 25 bp, Homo sapien
agaagttgtctgtctcaagcggcag

SEQ ID NO: 652522 - DNA, 25 bp, Homo sapien
tgtctgtctcaagcggcagtaaccg

SEQ ID NO: 652523 - DNA, 25 bp, Homo sapien
agtaaccgcggctgcagatctcaat

SEQ ID NO: 652524 - DNA, 25 bp, Homo sapien
gcggctgcagatctcaatctgtggt

SEQ ID NO: 652525 - DNA, 25 bp, Homo sapien
gatctcaatctgtggtagatatcaa

SEQ ID NO: 652526 - DNA, 25 bp, Homo sapien
gtagatatcaagcagttcaaccctt

SEQ ID NO: 652527 - DNA, 25 bp, Homo sapien
tcaagcagttcaacccttttttata

SEQ ID NO: 652528 - DNA, 25 bp, Homo sapien
agcagctctggcatcactagtggcc

SEQ ID NO: 652529 - DNA, 25 bp, Homo sapien
ggcatcactagtggcccagcatttg

SEQ ID NO: 652530 - DNA, 25 bp, Homo sapien
gagagatcagcgaaggtattaaccc

SEQ ID NO: 652531 - DNA, 25 bp, Homo sapien
gtattaacccgtgtgtagcggcgaa

SEQ ID NO: 652532 - DNA, 25 bp, Homo sapien
tagcggcgaaacacccggcacagtg

SEQ ID NO: 652533 - DNA, 25 bp, Homo sapien
atcctcagcggagaacccgtcttta

SEQ ID NO: 652534 - DNA, 25 bp, Homo sapien
gggcactgggcgacagcaattcaga

SEQ ID NO: 652535 - DNA, 25 bp, Homo sapien
aattcagatcgcgactggtgaccaa

SEQ ID NO: 652536 - DNA, 25 bp, Homo sapien
ggtgaccaattgtgccagcggacgc

SEQ ID NO: 652537 - DNA, 25 bp, Homo sapien
gcccctgagcaaccaactcagagta

SEQ ID NO: 652538 - DNA, 25 bp, Homo sapien
gtaacgaaacatgatcacgagcact

SEQ ID NO: 652539 - DNA, 25 bp, Homo sapien
gatcacgagcactaacaaacgataa

SEQ ID NO: 652540 - DNA, 25 bp, Homo sapien
taagtgaagcgaacggcccacggct

SEQ ID NO: 652541 - DNA, 25 bp, Homo sapien
taaaatagcttgcagaccttcattg

SEQ ID NO: 652542 - DNA, 25 bp, Homo sapien
aatagcttgcagaccttcattgcca

SEQ ID NO: 652543 - DNA, 25 bp, Homo sapien
accttcattgccaccatcagggtct

SEQ ID NO: 652544 - DNA, 25 bp, Homo sapien
ccatcagggtctcctaagagctaga

SEQ ID NO: 652545 - DNA, 25 bp, Homo sapien
cctaagagctagaaaccccatgttg

SEQ ID NO: 652546 - DNA, 25 bp, Homo sapien
aaccccatgttggtcattgctgatc

SEQ ID NO: 652547 - DNA, 25 bp, Homo sapien
catgttggtcattgctgatctaata

SEQ ID NO: 652548 - DNA, 25 bp, Homo sapien
ggtcattgctgatctaataaaccaa

SEQ ID NO: 652549 - DNA, 25 bp, Homo sapien
gaagtgtatctgtttttgctataaa

SEQ ID NO: 652550 - DNA, 25 bp, Homo sapien
aacctttatggccatatttggcaat

SEQ ID NO: 652551 - DNA, 25 bp, Homo sapien
tatggccatatttggcaataacctt

SEQ ID NO: 652552 - DNA, 25 bp, Homo sapien
gagggaatgggatgacatactcaaa

SEQ ID NO: 652553 - DNA, 25 bp, Homo sapien
gacatactcaaagtgctgacatttt

SEQ ID NO: 652554 - DNA, 25 bp, Homo sapien
gcaagaatactgtgcctgggaaaaa

SEQ ID NO: 652555 - DNA, 25 bp, Homo sapien
ctgtgcctgggaaaaaactgtcttt

SEQ ID NO: 652556 - DNA, 25 bp, Homo sapien
gatgagcgacatactttccagacaa

SEQ ID NO: 652557 - DNA, 25 bp, Homo sapien
gcgacatactttccagacaaacaaa

SEQ ID NO: 652558 - DNA, 25 bp, Homo sapien
aaaagctgacactgttcttcactat

SEQ ID NO: 652559 - DNA, 25 bp, Homo sapien
gttcttcactatgaacttgccttat

SEQ ID NO: 652560 - DNA, 25 bp, Homo sapien
tcactatgaacttgccttataagaa

SEQ ID NO: 652561 - DNA, 25 bp, Homo sapien
tgaagggagttatttcactggaaat

SEQ ID NO: 652562 - DNA, 25 bp, Homo sapien
taaacagcaacatgatagcataaga

SEQ ID NO: 652563 - DNA, 25 bp, Homo sapien
catgcatgcctaaaactgattctgt

SEQ ID NO: 652564 - DNA, 25 bp, Homo sapien
atgcctaaaactgattctgttccag

SEQ ID NO: 652565 - DNA, 25 bp, Homo sapien
tctgttccagttttataagttagta

SEQ ID NO: 652566 - DNA, 25 bp, Homo sapien
gtatactaattttaagacattgtgt

SEQ ID NO: 652567 - DNA, 25 bp, Homo sapien
ttccttcacttaatttctattttct

SEQ ID NO: 652568 - DNA, 25 bp, Homo sapien
aattcagttggtttctttctagagg

SEQ ID NO: 652569 - DNA, 25 bp, Homo sapien
gagtatagtactgggcatcacatgc

SEQ ID NO: 652570 - DNA, 25 bp, Homo sapien
tagtactgggcatcacatgctgctt

SEQ ID NO: 652571 - DNA, 25 bp, Homo sapien
tgggcatcacatgctgcttcccttt

SEQ ID NO: 652572 - DNA, 25 bp, Homo sapien
tgcttccctttgtggctttgaataa

SEQ ID NO: 652573 - DNA, 25 bp, Homo sapien
tttgtggctttgaataaacccttat

SEQ ID NO: 652574 - DNA, 25 bp, Homo sapien
acaattcctcagtaatcataccaaa

SEQ ID NO: 652575 - DNA, 25 bp, Homo sapien
aattcctcagtaatcataccaaagt

SEQ ID NO: 652576 - DNA, 25 bp, Homo sapien
agtaatcataccaaagttcctgctg

SEQ ID NO: 652577 - DNA, 25 bp, Homo sapien
gtaatcataccaaagttcctgctgc

SEQ ID NO: 652578 - DNA, 25 bp, Homo sapien
taatcataccaaagttcctgctgct

SEQ ID NO: 652579 - DNA, 25 bp, Homo sapien
ctctgcccttcaaaagtgatccctg

SEQ ID NO: 652580 - DNA, 25 bp, Homo sapien
tctgcccttcaaaagtgatccctgc

SEQ ID NO: 652581 - DNA, 25 bp, Homo sapien
ctgcccttcaaaagtgatccctgct

SEQ ID NO: 652582 - DNA, 25 bp, Homo sapien
tgcccttcaaaagtgatccctgctg

SEQ ID NO: 652583 - DNA, 25 bp, Homo sapien
gcccttcaaaagtgatccctgctgg

SEQ ID NO: 652584 - DNA, 25 bp, Homo sapien
ccttcaaaagtgatccctgctggga

SEQ ID NO: 652585 - DNA, 25 bp, Homo sapien
tgtccagatccgaaagcgccggtgg

SEQ ID NO: 652586 - DNA, 25 bp, Homo sapien
tggcgctgcgcgtgttttcaaggca

SEQ ID NO: 652587 - DNA, 25 bp, Homo sapien
gcgtgttttcaaggcatggcccctt

SEQ ID NO: 652588 - DNA, 25 bp, Homo sapien
gggacccagttgaacgcctcagtac

SEQ ID NO: 652589 - DNA, 25 bp, Homo sapien
agttgaacgcctcagtacagcctgg

SEQ ID NO: 652590 - DNA, 25 bp, Homo sapien
aacgcctcagtacagcctggagtaa

SEQ ID NO: 652591 - DNA, 25 bp, Homo sapien
gtacagcctggagtaaccaatggtt

SEQ ID NO: 652592 - DNA, 25 bp, Homo sapien
gtaaccaatggttccttccagatca

SEQ ID NO: 652593 - DNA, 25 bp, Homo sapien
aaaaaggctcgagtgaggaaaacat

SEQ ID NO: 652594 - DNA, 25 bp, Homo sapien
gagcctgttagacattcagtcactg

SEQ ID NO: 652595 - DNA, 25 bp, Homo sapien
agtcactgatctgggaatatgtatg

SEQ ID NO: 652596 - DNA, 25 bp, Homo sapien
catattttgcctatttctgtggtag

SEQ ID NO: 652597 - DNA, 25 bp, Homo sapien
tttgcctatttctgtggtagtgtaa

SEQ ID NO: 652598 - DNA, 25 bp, Homo sapien
gtgtgttgttaatagtcactacagg

SEQ ID NO: 652599 - DNA, 25 bp, Homo sapien
gtcactacaggcaaaaaacagtaag

SEQ ID NO: 652600 - DNA, 25 bp, Homo sapien
aacagtaagagcttgcttttaaatt

SEQ ID NO: 652601 - DNA, 25 bp, Homo sapien
tgtcatttatctctgtgacttcggg

SEQ ID NO: 652602 - DNA, 25 bp, Homo sapien
cttcgggctagatgtttaactttct

SEQ ID NO: 652603 - DNA, 25 bp, Homo sapien
gatgtttaactttctaagcctccat

SEQ ID NO: 652604 - DNA, 25 bp, Homo sapien
ggactttaatgagacagtgttagca

SEQ ID NO: 652605 - DNA, 25 bp, Homo sapien
gacagtgttagcaaatggcctagca

SEQ ID NO: 652606 - DNA, 25 bp, Homo sapien
ttagcaaatggcctagcacatagca

SEQ ID NO: 652607 - DNA, 25 bp, Homo sapien
agagactttatctcttggagatagc

SEQ ID NO: 652608 - DNA, 25 bp, Homo sapien
atctcttggagatagctcttaaaga

SEQ ID NO: 652609 - DNA, 25 bp, Homo sapien
tgtttatggctgaaatgttatggca

SEQ ID NO: 652610 - DNA, 25 bp, Homo sapien
gttatggcatcttggatttgcttta

SEQ ID NO: 652611 - DNA, 25 bp, Homo sapien
tttaaaataacccagcttgctgcag

SEQ ID NO: 652612 - DNA, 25 bp, Homo sapien
gatgacccaagattaggcagatgtt

SEQ ID NO: 652613 - DNA, 25 bp, Homo sapien
taggcagatgttgttaactgtggaa

SEQ ID NO: 652614 - DNA, 25 bp, Homo sapien
gggctcatgacattatgctctctac

SEQ ID NO: 652615 - DNA, 25 bp, Homo sapien
tctctactttgtgtacgtgtgaaca

SEQ ID NO: 652616 - DNA, 25 bp, Homo sapien
gtgtacgtgtgaacatttccgtaat

SEQ ID NO: 652617 - DNA, 25 bp, Homo sapien
gtgaacatttccgtaataaaagatg

SEQ ID NO: 652618 - DNA, 25 bp, Homo sapien
ctgtaatgctcaggtttttctttct

SEQ ID NO: 652619 - DNA, 25 bp, Homo sapien
tttcttgtagtctcttaaataacag

SEQ ID NO: 652620 - DNA, 25 bp, Homo sapien
aagctatctgcactgctctgctgaa

SEQ ID NO: 652621 - DNA, 25 bp, Homo sapien
tctgctgaactctaagccacctctg

SEQ ID NO: 652622 - DNA, 25 bp, Homo sapien
ctaagccacctctgctactaaaaca

SEQ ID NO: 652623 - DNA, 25 bp, Homo sapien
aaaacagatagtagcccctgttggg

SEQ ID NO: 652624 - DNA, 25 bp, Homo sapien
ggtctctggagcagggaaatccaag

SEQ ID NO: 652625 - DNA, 25 bp, Homo sapien
aatccaagctgtcatggagcatgta

SEQ ID NO: 652626 - DNA, 25 bp, Homo sapien
ggagcatgtattcagtaaccaaaga

SEQ ID NO: 652627 - DNA, 25 bp, Homo sapien
gtaaccaaagaggattctacaagtt

SEQ ID NO: 652628 - DNA, 25 bp, Homo sapien
ttgtttttctggctaggtgacttca

SEQ ID NO: 652629 - DNA, 25 bp, Homo sapien
aaaggcccgctcatgcatgagcccc

SEQ ID NO: 652630 - DNA, 25 bp, Homo sapien
aaggcccgctcatgcatgagcccct

SEQ ID NO: 652631 - DNA, 25 bp, Homo sapien
aggcccgctcatgcatgagcccctg

SEQ ID NO: 652632 - DNA, 25 bp, Homo sapien
ggcccgctcatgcatgagcccctgc

SEQ ID NO: 652633 - DNA, 25 bp, Homo sapien
gcccgctcatgcatgagcccctgcc

SEQ ID NO: 652634 - DNA, 25 bp, Homo sapien
cccgctcatgcatgagcccctgcca

SEQ ID NO: 652635 - DNA, 25 bp, Homo sapien
ccgctcatgcatgagcccctgccac

SEQ ID NO: 652636 - DNA, 25 bp, Homo sapien
cgctcatgcatgagcccctgccact

SEQ ID NO: 652637 - DNA, 25 bp, Homo sapien
ttctgccttcatagagcttctattc

SEQ ID NO: 652638 - DNA, 25 bp, Homo sapien
gagcttctattcatttctagactta

SEQ ID NO: 652639 - DNA, 25 bp, Homo sapien
ataaaactctgggatatggctttaa

SEQ ID NO: 652640 - DNA, 25 bp, Homo sapien
gggatatggctttaagttcctaaca

SEQ ID NO: 652641 - DNA, 25 bp, Homo sapien
ccaactacttaagtccattaccaag

SEQ ID NO: 652642 - DNA, 25 bp, Homo sapien
gtccattaccaagttgtgtttctct

SEQ ID NO: 652643 - DNA, 25 bp, Homo sapien
gtttctctttgcaacactactgttt

SEQ ID NO: 652644 - DNA, 25 bp, Homo sapien
aacacattgcttacttttcgtaggc

SEQ ID NO: 652645 - DNA, 25 bp, Homo sapien
tttcgtaggcataaagctgacttga

SEQ ID NO: 652646 - DNA, 25 bp, Homo sapien
ctctagccaggtaattttacttaat

SEQ ID NO: 652647 - DNA, 25 bp, Homo sapien
atacagtagcagcaataatgtgact

SEQ ID NO: 652648 - DNA, 25 bp, Homo sapien
gtagctatcctacttttaaataaag

SEQ ID NO: 652649 - DNA, 25 bp, Homo sapien
gagattgcaccacggtgcttcggcc

SEQ ID NO: 652650 - DNA, 25 bp, Homo sapien
agattgcaccacggtgcttcggcct

SEQ ID NO: 652651 - DNA, 25 bp, Homo sapien
gattgcaccacggtgcttcggcctg

SEQ ID NO: 652652 - DNA, 25 bp, Homo sapien
attgcaccacggtgcttcggcctgg

SEQ ID NO: 652653 - DNA, 25 bp, Homo sapien
ttgcaccacggtgcttcggcctggg

SEQ ID NO: 652654 - DNA, 25 bp, Homo sapien
tgcaccacggtgcttcggcctgggc

SEQ ID NO: 652655 - DNA, 25 bp, Homo sapien
gcaccacggtgcttcggcctgggcg

SEQ ID NO: 652656 - DNA, 25 bp, Homo sapien
caccacggtgcttcggcctgggcgg

SEQ ID NO: 652657 - DNA, 25 bp, Homo sapien
accacggtgcttcggcctgggcggc

SEQ ID NO: 652658 - DNA, 25 bp, Homo sapien
cggtgcttcggcctgggcggcagag

SEQ ID NO: 652659 - DNA, 25 bp, Homo sapien
agcaaccccttatcttaggcattgt

SEQ ID NO: 652660 - DNA, 25 bp, Homo sapien
taggcattgtaattatgaccatttt

SEQ ID NO: 652661 - DNA, 25 bp, Homo sapien
aaacatagatgctaagtaacttgcc

SEQ ID NO: 652662 - DNA, 25 bp, Homo sapien
aagtaacttgcctatgatcacctgg

SEQ ID NO: 652663 - DNA, 25 bp, Homo sapien
gagagggctgattctacgtttcaac

SEQ ID NO: 652664 - DNA, 25 bp, Homo sapien
ttctacgtttcaacttgggtcactc

SEQ ID NO: 652665 - DNA, 25 bp, Homo sapien
tcaacttgggtcactcctgttatat

SEQ ID NO: 652666 - DNA, 25 bp, Homo sapien
ttgggtcactcctgttatatatgaa

SEQ ID NO: 652667 - DNA, 25 bp, Homo sapien
tgaactgctcagtgcaacaggtctt

SEQ ID NO: 652668 - DNA, 25 bp, Homo sapien
gctcagtgcaacaggtcttggttga

SEQ ID NO: 652669 - DNA, 25 bp, Homo sapien
ttattttgtgcctaacactctggga

SEQ ID NO: 652670 - DNA, 25 bp, Homo sapien
gaaattttgacatctactatagtta

SEQ ID NO: 652671 - DNA, 25 bp, Homo sapien
tagttaatggtttctattcttgtat

SEQ ID NO: 652672 - DNA, 25 bp, Homo sapien
attcttgtatttgttgctcatgcat

SEQ ID NO: 652673 - DNA, 25 bp, Homo sapien
gttgctcatgcatttaatgtcatat

SEQ ID NO: 652674 - DNA, 25 bp, Homo sapien
gtcatatctaagaaaatggtgccaa

SEQ ID NO: 652675 - DNA, 25 bp, Homo sapien
aatggtgccaagacaatgtcatgtc

SEQ ID NO: 652676 - DNA, 25 bp, Homo sapien
caatgtcatgtctttttcctgtatt

SEQ ID NO: 652677 - DNA, 25 bp, Homo sapien
gatttgttagttttttgtgtctaag

SEQ ID NO: 652678 - DNA, 25 bp, Homo sapien
tatggtttagtttttagagttgttg

SEQ ID NO: 652679 - DNA, 25 bp, Homo sapien
gtaatttgcaaatatattcacccat

SEQ ID NO: 652680 - DNA, 25 bp, Homo sapien
tctcgaattttcttttgatgtacag

SEQ ID NO: 652681 - DNA, 25 bp, Homo sapien
gttccaatggaaaatccgtcacgtg

SEQ ID NO: 652682 - DNA, 25 bp, Homo sapien
atggaaaatccgtcacgtgggccca

SEQ ID NO: 652683 - DNA, 25 bp, Homo sapien
ggaaaatccgtcacgtgggcccaga

SEQ ID NO: 652684 - DNA, 25 bp, Homo sapien
gaaaatccgtcacgtgggcccagaa

SEQ ID NO: 652685 - DNA, 25 bp, Homo sapien
aaaatccgtcacgtgggcccagaat

SEQ ID NO: 652686 - DNA, 25 bp, Homo sapien
aatccgtcacgtgggcccagaatga

SEQ ID NO: 652687 - DNA, 25 bp, Homo sapien
cacgtgggcccagaatgagaagagc

SEQ ID NO: 652688 - DNA, 25 bp, Homo sapien
tgggcccagaatgagaagagcagcc

SEQ ID NO: 652689 - DNA, 25 bp, Homo sapien
gcctgtccatccacatcaacaagaa

SEQ ID NO: 652690 - DNA, 25 bp, Homo sapien
tgtccatccacatcaacaagaaaga

SEQ ID NO: 652691 - DNA, 25 bp, Homo sapien
aaccaaacggccgtcatcaagccct

SEQ ID NO: 652692 - DNA, 25 bp, Homo sapien
gcttaaaacctaggttgataggtgc

SEQ ID NO: 652693 - DNA, 25 bp, Homo sapien
atacctgtgtaacatttacatagac

SEQ ID NO: 652694 - DNA, 25 bp, Homo sapien
aaattattagttcagcttccagtta

SEQ ID NO: 652695 - DNA, 25 bp, Homo sapien
agcttccagttattccttattattg

SEQ ID NO: 652696 - DNA, 25 bp, Homo sapien
attccttattattggtcttgcttta

SEQ ID NO: 652697 - DNA, 25 bp, Homo sapien
gtcttgctttaaccttgtacccagg

SEQ ID NO: 652698 - DNA, 25 bp, Homo sapien
cttgtacccaggtttctacaactag

SEQ ID NO: 652699 - DNA, 25 bp, Homo sapien
gtttctacaactaggccacctcctt

SEQ ID NO: 652700 - DNA, 25 bp, Homo sapien
acaaataagcccgtcttatcctgct

SEQ ID NO: 652701 - DNA, 25 bp, Homo sapien
gtcttatcctgctctgttaacatga

SEQ ID NO: 652702 - DNA, 25 bp, Homo sapien
tatcctgctctgttaacatgataga

SEQ ID NO: 652703 - DNA, 25 bp, Homo sapien
gggctggccgcagtggctcacgctt

SEQ ID NO: 652704 - DNA, 25 bp, Homo sapien
ggctggccgcagtggctcacgcttg

SEQ ID NO: 652705 - DNA, 25 bp, Homo sapien
gctggccgcagtggctcacgcttgt

SEQ ID NO: 652706 - DNA, 25 bp, Homo sapien
ctggccgcagtggctcacgcttgta

SEQ ID NO: 652707 - DNA, 25 bp, Homo sapien
tggccgcagtggctcacgcttgtaa

SEQ ID NO: 652708 - DNA, 25 bp, Homo sapien
tgggtggatcacctggccaacatgg

SEQ ID NO: 652709 - DNA, 25 bp, Homo sapien
aagacaaaaagttagccaggtgtgg

SEQ ID NO: 652710 - DNA, 25 bp, Homo sapien
cgcaccattgtactccagtgtgggc

SEQ ID NO: 652711 - DNA, 25 bp, Homo sapien
gcaccattgtactccagtgtgggca

SEQ ID NO: 652712 - DNA, 25 bp, Homo sapien
caccattgtactccagtgtgggcaa

SEQ ID NO: 652713 - DNA, 25 bp, Homo sapien
attgtactccagtgtgggcaacacg

SEQ ID NO: 652714 - DNA, 25 bp, Homo sapien
agctttgagcagagccctgcctaag

SEQ ID NO: 652715 - DNA, 25 bp, Homo sapien
gagcagagccctgcctaaggtccag

SEQ ID NO: 652716 - DNA, 25 bp, Homo sapien
aggtccagggctcgatctggcccta

SEQ ID NO: 652717 - DNA, 25 bp, Homo sapien
tggccctaaccacagagtcaccttg

SEQ ID NO: 652718 - DNA, 25 bp, Homo sapien
agtcaccttgaggtatgtaacccct

SEQ ID NO: 652719 - DNA, 25 bp, Homo sapien
cttgaggtatgtaacccctcctggc

SEQ ID NO: 652720 - DNA, 25 bp, Homo sapien
cctggcttcaatttcctgactttta

SEQ ID NO: 652721 - DNA, 25 bp, Homo sapien
caatttcctgacttttaggagtgta

SEQ ID NO: 652722 - DNA, 25 bp, Homo sapien
ggagtgtattaatcctatttcatag

SEQ ID NO: 652723 - DNA, 25 bp, Homo sapien
tatttcataggtagagcacttagta

SEQ ID NO: 652724 - DNA, 25 bp, Homo sapien
agcacttagtaagaaattggtggcc

SEQ ID NO: 652725 - DNA, 25 bp, Homo sapien
gaggtaattgactcatggggctgag

SEQ ID NO: 652726 - DNA, 25 bp, Homo sapien
tataaaagggagttccctgcccaag

SEQ ID NO: 652727 - DNA, 25 bp, Homo sapien
taaaagggagttccctgcccaagct

SEQ ID NO: 652728 - DNA, 25 bp, Homo sapien
agggagttccctgcccaagctccct

SEQ ID NO: 652729 - DNA, 25 bp, Homo sapien
tccaaaatttgcagggtgggtgata

SEQ ID NO: 652730 - DNA, 25 bp, Homo sapien
ccaaaatttgcagggtgggtgatac

SEQ ID NO: 652731 - DNA, 25 bp, Homo sapien
caaaatttgcagggtgggtgatacg

SEQ ID NO: 652732 - DNA, 25 bp, Homo sapien
aaatttgcagggtgggtgatacggt

SEQ ID NO: 652733 - DNA, 25 bp, Homo sapien
aatttgcagggtgggtgatacggtt

SEQ ID NO: 652734 - DNA, 25 bp, Homo sapien
tttgcagggtgggtgatacggtttg

SEQ ID NO: 652735 - DNA, 25 bp, Homo sapien
gcagggtgggtgatacggtttggct

SEQ ID NO: 652736 - DNA, 25 bp, Homo sapien
agtagttgcagatcctgttttttac

SEQ ID NO: 652737 - DNA, 25 bp, Homo sapien
tcctgttttttactaagctgtcatg

SEQ ID NO: 652738 - DNA, 25 bp, Homo sapien
tactaagctgtcatggagataaatc

SEQ ID NO: 652739 - DNA, 25 bp, Homo sapien
gtagaacagttagtgagagccttta

SEQ ID NO: 652740 - DNA, 25 bp, Homo sapien
agagcctttatgggagatctttatt

SEQ ID NO: 652741 - DNA, 25 bp, Homo sapien
gaagatgttcctattatcctccagc

SEQ ID NO: 652742 - DNA, 25 bp, Homo sapien
atgttcctattatcctccagcctct

SEQ ID NO: 652743 - DNA, 25 bp, Homo sapien
tccagcctctgggtatgcaaaccaa

SEQ ID NO: 652744 - DNA, 25 bp, Homo sapien
gcctctgggtatgcaaaccaaaaca

SEQ ID NO: 652745 - DNA, 25 bp, Homo sapien
caagcacttaatctagttgtcaaaa

SEQ ID NO: 652746 - DNA, 25 bp, Homo sapien
gaatgtcagaactaaaagggaactt

SEQ ID NO: 652747 - DNA, 25 bp, Homo sapien
gcttctagagccctttctattctag

SEQ ID NO: 652748 - DNA, 25 bp, Homo sapien
gagccctttctattctagggactct

SEQ ID NO: 652749 - DNA, 25 bp, Homo sapien
tagggactctaccttggctgtgaca

SEQ ID NO: 652750 - DNA, 25 bp, Homo sapien
tctaccttggctgtgacataggaag

SEQ ID NO: 652751 - DNA, 25 bp, Homo sapien
ggctgtgacataggaaggttacatt

SEQ ID NO: 652752 - DNA, 25 bp, Homo sapien
aacctgttaaattgagactagcact

SEQ ID NO: 652753 - DNA, 25 bp, Homo sapien
gactagcactggagacataattggt

SEQ ID NO: 652754 - DNA, 25 bp, Homo sapien
gttggactaaataatctcagcagtg

SEQ ID NO: 652755 - DNA, 25 bp, Homo sapien
aataatctcagcagtgatgtatggg

SEQ ID NO: 652756 - DNA, 25 bp, Homo sapien
taccctagataagaacttcgatcat

SEQ ID NO: 652757 - DNA, 25 bp, Homo sapien
ataagaacttcgatcattgcttact

SEQ ID NO: 652758 - DNA, 25 bp, Homo sapien
tggaagacagtagcaaactgaacat

SEQ ID NO: 652759 - DNA, 25 bp, Homo sapien
gaacatataacaaagacttgctttc

SEQ ID NO: 652760 - DNA, 25 bp, Homo sapien
tttgccagatatgatgcttagccca

SEQ ID NO: 652761 - DNA, 25 bp, Homo sapien
gatatgatgcttagcccaatataaa

SEQ ID NO: 652762 - DNA, 25 bp, Homo sapien
ataagaagatctggccggacgcagt

SEQ ID NO: 652763 - DNA, 25 bp, Homo sapien
tggatcacctgagacagctgcaaag

SEQ ID NO: 652764 - DNA, 25 bp, Homo sapien
gagacagctgcaaagatttcgaggt

SEQ ID NO: 652765 - DNA, 25 bp, Homo sapien
atttcgaggtggaagagagctcact

SEQ ID NO: 652766 - DNA, 25 bp, Homo sapien
gagagctcactgagagaccggaaaa

SEQ ID NO: 652767 - DNA, 25 bp, Homo sapien
gaccggaaaaagacttcatggagta

SEQ ID NO: 652768 - DNA, 25 bp, Homo sapien
ggaatgagcttctctcatagagaac

SEQ ID NO: 652769 - DNA, 25 bp, Homo sapien
gcagcaatgacacctgctctgtaga

SEQ ID NO: 652770 - DNA, 25 bp, Homo sapien
tctgtagaagccttccctggctgac

SEQ ID NO: 652771 - DNA, 25 bp, Homo sapien
ggctgacccatctaaaattgcctca

SEQ ID NO: 652772 - DNA, 25 bp, Homo sapien
ccccaactttctgtctgtcataaga

SEQ ID NO: 652773 - DNA, 25 bp, Homo sapien
tgtctgtcataagagtcaacttcat

SEQ ID NO: 652774 - DNA, 25 bp, Homo sapien
tactcatatcacttatctccatctg

SEQ ID NO: 652775 - DNA, 25 bp, Homo sapien
tatttatgtagtctctctgtcttcc

SEQ ID NO: 652776 - DNA, 25 bp, Homo sapien
catcccctcagcttatattctgagc

SEQ ID NO: 652777 - DNA, 25 bp, Homo sapien
gctcaatgtgaggtcttttcttcat

SEQ ID NO: 652778 - DNA, 25 bp, Homo sapien
tttcttcattactaggtccatagag

SEQ ID NO: 652779 - DNA, 25 bp, Homo sapien
gaaactcagatcactatttgatggg

SEQ ID NO: 652780 - DNA, 25 bp, Homo sapien
gattttcaattaagtaggcacaaga

SEQ ID NO: 652781 - DNA, 25 bp, Homo sapien
gtaggcacaagagattttcagtgta

SEQ ID NO: 652782 - DNA, 25 bp, Homo sapien
gtgaactagacaaaggactgagatc

SEQ ID NO: 652783 - DNA, 25 bp, Homo sapien
aggactgagatcttacgtgcgtgta

SEQ ID NO: 652784 - DNA, 25 bp, Homo sapien
tacgtgcgtgtaagtccagggccat

SEQ ID NO: 652785 - DNA, 25 bp, Homo sapien
taagtccagggccatgtgacacact

SEQ ID NO: 652786 - DNA, 25 bp, Homo sapien
gggccatgtgacacactttgcaaat

SEQ ID NO: 652787 - DNA, 25 bp, Homo sapien
ggaaagaacacagcactggtaaact

SEQ ID NO: 652788 - DNA, 25 bp, Homo sapien
gcactggtaaacttagctgtcgtca

SEQ ID NO: 652789 - DNA, 25 bp, Homo sapien
gctgtcgtcaagttgatattctaga

SEQ ID NO: 652790 - DNA, 25 bp, Homo sapien
ttaacatttataaggtgacccacac

SEQ ID NO: 652791 - DNA, 25 bp, Homo sapien
atgggctgccttaagtcaccttgat

SEQ ID NO: 652792 - DNA, 25 bp, Homo sapien
gtcaccttgatagaagctgcttagt

SEQ ID NO: 652793 - DNA, 25 bp, Homo sapien
gaagctgcttagtttcttctaactg

SEQ ID NO: 652794 - DNA, 25 bp, Homo sapien
gtttcttctaactgtaatttgaaca

SEQ ID NO: 652795 - DNA, 25 bp, Homo sapien
aaaggtgtgaaatgtcacagccggg

SEQ ID NO: 652796 - DNA, 25 bp, Homo sapien
ggagtttacctatgaagctcttttc

SEQ ID NO: 652797 - DNA, 25 bp, Homo sapien
ttacctatgaagctcttttctgtta

SEQ ID NO: 652798 - DNA, 25 bp, Homo sapien
aaaatgtgtctccagatttattctg

SEQ ID NO: 652799 - DNA, 25 bp, Homo sapien
tggtgacttaacagactttatttac

SEQ ID NO: 652800 - DNA, 25 bp, Homo sapien
taacagactttatttacctccttgt

SEQ ID NO: 652801 - DNA, 25 bp, Homo sapien
ttacctccttgttctaaaagagagg

SEQ ID NO: 652802 - DNA, 25 bp, Homo sapien
agacttaagccaccttgttcaatat

SEQ ID NO: 652803 - DNA, 25 bp, Homo sapien
gccaccttgttcaatattctagtca

SEQ ID NO: 652804 - DNA, 25 bp, Homo sapien
atgtttactaagcatctaccatgtg

SEQ ID NO: 652805 - DNA, 25 bp, Homo sapien
aagcatctaccatgtgtggtactaa

SEQ ID NO: 652806 - DNA, 25 bp, Homo sapien
accatgtgtggtactaagatattaa

SEQ ID NO: 652807 - DNA, 25 bp, Homo sapien
gtttgattaatctagcactggctct

SEQ ID NO: 652808 - DNA, 25 bp, Homo sapien
taatctagcactggctctggcatta

SEQ ID NO: 652809 - DNA, 25 bp, Homo sapien
gctctggcattactggctgacttaa

SEQ ID NO: 652810 - DNA, 25 bp, Homo sapien
attactggctgacttaattagggta

SEQ ID NO: 652811 - DNA, 25 bp, Homo sapien
attagggtaagtcagcatctttggg

SEQ ID NO: 652812 - DNA, 25 bp, Homo sapien
gtatttgaggatggaaacacacaca

SEQ ID NO: 652813 - DNA, 25 bp, Homo sapien
aaattttgtaggaagctggtagaga

SEQ ID NO: 652814 - DNA, 25 bp, Homo sapien
aattttgtaggaagctggtagagaa

SEQ ID NO: 652815 - DNA, 25 bp, Homo sapien
attttgtaggaagctggtagagaat

SEQ ID NO: 652816 - DNA, 25 bp, Homo sapien
tttgtaggaagctggtagagaattt

SEQ ID NO: 652817 - DNA, 25 bp, Homo sapien
taggaagctggtagagaatttggtt

SEQ ID NO: 652818 - DNA, 25 bp, Homo sapien
ggaagctggtagagaatttggtttt

SEQ ID NO: 652819 - DNA, 25 bp, Homo sapien
gaagctggtagagaatttggtttta

SEQ ID NO: 652820 - DNA, 25 bp, Homo sapien
ttaaagaggtctgtgttggccgggc

SEQ ID NO: 652821 - DNA, 25 bp, Homo sapien
taaagaggtctgtgttggccgggca

SEQ ID NO: 652822 - DNA, 25 bp, Homo sapien
aaagaggtctgtgttggccgggcac

SEQ ID NO: 652823 - DNA, 25 bp, Homo sapien
aagaggtctgtgttggccgggcacg

SEQ ID NO: 652824 - DNA, 25 bp, Homo sapien
gccatgtatgacaaatcaatgactt

SEQ ID NO: 652825 - DNA, 25 bp, Homo sapien
gtatgacaaatcaatgacttatatc

SEQ ID NO: 652826 - DNA, 25 bp, Homo sapien
gacttatatcatactaaacaggaaa

SEQ ID NO: 652827 - DNA, 25 bp, Homo sapien
aagagcagagcactttttatctgag

SEQ ID NO: 652828 - DNA, 25 bp, Homo sapien
agcagagcactttttatctgagatc

SEQ ID NO: 652829 - DNA, 25 bp, Homo sapien
gagatctcagacaaggatgtattca

SEQ ID NO: 652830 - DNA, 25 bp, Homo sapien
atctcagacaaggatgtattcattt

SEQ ID NO: 652831 - DNA, 25 bp, Homo sapien
attcaactgtgtacactgtaagact

SEQ ID NO: 652832 - DNA, 25 bp, Homo sapien
aactgtgtacactgtaagactgtgg

SEQ ID NO: 652833 - DNA, 25 bp, Homo sapien
gtgtacactgtaagactgtggagca

SEQ ID NO: 652834 - DNA, 25 bp, Homo sapien
actgtaagactgtggagcaaggccg

SEQ ID NO: 652835 - DNA, 25 bp, Homo sapien
tgtagcatcttctctcccttgaagg

SEQ ID NO: 652836 - DNA, 25 bp, Homo sapien
cttcagtcctcatttgctcatcaac

SEQ ID NO: 652837 - DNA, 25 bp, Homo sapien
tgctcatcaacctcagagacactgc

SEQ ID NO: 652838 - DNA, 25 bp, Homo sapien
tcagagacactgctttccaacttac

SEQ ID NO: 652839 - DNA, 25 bp, Homo sapien
ttccaacttacctcgagtcccaggg

SEQ ID NO: 652840 - DNA, 25 bp, Homo sapien
aaaaagcagacgcttcctcaagctg

SEQ ID NO: 652841 - DNA, 25 bp, Homo sapien
ctgatgttctctgggacattttcgg

SEQ ID NO: 652842 - DNA, 25 bp, Homo sapien
gaaatttgacctcccacttgtcatg

SEQ ID NO: 652843 - DNA, 25 bp, Homo sapien
acttgtcatgcgctacttttgaatt

SEQ ID NO: 652844 - DNA, 25 bp, Homo sapien
catgacactcatgacttgtgatgaa

SEQ ID NO: 652845 - DNA, 25 bp, Homo sapien
gatgaagtcatggatatgtctatca

SEQ ID NO: 652846 - DNA, 25 bp, Homo sapien
atctataacgctttctgcacatctg

SEQ ID NO: 652847 - DNA, 25 bp, Homo sapien
tataacgctttctgcacatctgtaa

SEQ ID NO: 652848 - DNA, 25 bp, Homo sapien
gcacatctgtaaaaggtatgactta

SEQ ID NO: 652849 - DNA, 25 bp, Homo sapien
atgacttagtgtttggtctgtgaaa

SEQ ID NO: 652850 - DNA, 25 bp, Homo sapien
ctttttacattctagctaatgttga

SEQ ID NO: 652851 - DNA, 25 bp, Homo sapien
ttagcacataattcagatacattag

SEQ ID NO: 652852 - DNA, 25 bp, Homo sapien
agttttgaatcttctctgcttcttg

SEQ ID NO: 652853 - DNA, 25 bp, Homo sapien
aatcttctctgcttcttgagggctc

SEQ ID NO: 652854 - DNA, 25 bp, Homo sapien
acatgatctgtggaacaccagccaa

SEQ ID NO: 652855 - DNA, 25 bp, Homo sapien
tctgtggaacaccagccaagtcctg

SEQ ID NO: 652856 - DNA, 25 bp, Homo sapien
ctccccgttgtccaaatattactga

SEQ ID NO: 652857 - DNA, 25 bp, Homo sapien
gtgacagagtcgtggccagtaatgt

SEQ ID NO: 652858 - DNA, 25 bp, Homo sapien
agtcgtggccagtaatgttaaagta

SEQ ID NO: 652859 - DNA, 25 bp, Homo sapien
aatgggcgtgcctgtgaaatgaatg

SEQ ID NO: 652860 - DNA, 25 bp, Homo sapien
atgtgcggaggatttacgaatgctt

SEQ ID NO: 652861 - DNA, 25 bp, Homo sapien
tacgaatgcttgatgcctcgggaga

SEQ ID NO: 652862 - DNA, 25 bp, Homo sapien
atgcttgatgcctcgggagagaaaa

SEQ ID NO: 652863 - DNA, 25 bp, Homo sapien
aaaatgaatggctcccacagggacc

SEQ ID NO: 652864 - DNA, 25 bp, Homo sapien
cacagggaccaaggcagctcggctt

SEQ ID NO: 652865 - DNA, 25 bp, Homo sapien
gaccaaggcagctcggctttgtcgg

SEQ ID NO: 652866 - DNA, 25 bp, Homo sapien
gtgtgatatctgtgggatcatttgc

SEQ ID NO: 652867 - DNA, 25 bp, Homo sapien
ccaatgtgctcatggttcacaaaag

SEQ ID NO: 652868 - DNA, 25 bp, Homo sapien
ctccaggtaacctctggtttgaatt

SEQ ID NO: 652869 - DNA, 25 bp, Homo sapien
tccaggtaacctctggtttgaattt

SEQ ID NO: 652870 - DNA, 25 bp, Homo sapien
ggtaacctctggtttgaattttatg

SEQ ID NO: 652871 - DNA, 25 bp, Homo sapien
gtaacctctggtttgaattttatgt

SEQ ID NO: 652872 - DNA, 25 bp, Homo sapien
taacctctggtttgaattttatgtg

SEQ ID NO: 652873 - DNA, 25 bp, Homo sapien
aacctctggtttgaattttatgtgc

SEQ ID NO: 652874 - DNA, 25 bp, Homo sapien
acctctggtttgaattttatgtgcc

SEQ ID NO: 652875 - DNA, 25 bp, Homo sapien
tttgaattttatgtgccaggcgtgg

SEQ ID NO: 652876 - DNA, 25 bp, Homo sapien
ttgaattttatgtgccaggcgtggt

SEQ ID NO: 652877 - DNA, 25 bp, Homo sapien
tgaattttatgtgccaggcgtggtg

SEQ ID NO: 652878 - DNA, 25 bp, Homo sapien
tgaggcgggataatggcatggaccc

SEQ ID NO: 652879 - DNA, 25 bp, Homo sapien
ttaattaccgattggaaagagggag

SEQ ID NO: 652880 - DNA, 25 bp, Homo sapien
ttctgagcagaaaccaagttgggat

SEQ ID NO: 652881 - DNA, 25 bp, Homo sapien
accaagttgggattgcagaacagag

SEQ ID NO: 652882 - DNA, 25 bp, Homo sapien
gaacagagaagattcacagtgcttt

SEQ ID NO: 652883 - DNA, 25 bp, Homo sapien
aagattcacagtgctttaccgttgt

SEQ ID NO: 652884 - DNA, 25 bp, Homo sapien
agtgctttaccgttgtgagttgttt

SEQ ID NO: 652885 - DNA, 25 bp, Homo sapien
tgagttgtttgggtaatcgtgcctg

SEQ ID NO: 652886 - DNA, 25 bp, Homo sapien
tgtttgggtaatcgtgcctggtttt

SEQ ID NO: 652887 - DNA, 25 bp, Homo sapien
gattggaaaagacattggtccccta

SEQ ID NO: 652888 - DNA, 25 bp, Homo sapien
cccctattttaagccatgtgaagct

SEQ ID NO: 652889 - DNA, 25 bp, Homo sapien
aagccatgtgaagctgttttaggta

SEQ ID NO: 652890 - DNA, 25 bp, Homo sapien
ccattcataagggcagagctctcag

SEQ ID NO: 652891 - DNA, 25 bp, Homo sapien
ttaaaggcccacatgacctttggga

SEQ ID NO: 652892 - DNA, 25 bp, Homo sapien
atgacctttgggagacacgctgaga

SEQ ID NO: 652893 - DNA, 25 bp, Homo sapien
agacacgctgagaccctggcggtgc

SEQ ID NO: 652894 - DNA, 25 bp, Homo sapien
agggcactgtggttgtttctcacac

SEQ ID NO: 652895 - DNA, 25 bp, Homo sapien
ggttgtttctcacacatatgccaga

SEQ ID NO: 652896 - DNA, 25 bp, Homo sapien
atatgccagatactgcgcctcgcag

SEQ ID NO: 652897 - DNA, 25 bp, Homo sapien
tccccattgcctcagtttgaggcca

SEQ ID NO: 652898 - DNA, 25 bp, Homo sapien
gtttgaggccaaaagtgacacatca

SEQ ID NO: 652899 - DNA, 25 bp, Homo sapien
aaagtgacacatcaggccacagcca

SEQ ID NO: 652900 - DNA, 25 bp, Homo sapien
ctcagcctccgtgacctgaagggaa

SEQ ID NO: 652901 - DNA, 25 bp, Homo sapien
gaatcaagacctccagaaaactgtg

SEQ ID NO: 652902 - DNA, 25 bp, Homo sapien
gtccacagttaatcaggcattcctt

SEQ ID NO: 652903 - DNA, 25 bp, Homo sapien
ggcattccttatcatttggatctac

SEQ ID NO: 652904 - DNA, 25 bp, Homo sapien
gaataaacacaacatccctagacct

SEQ ID NO: 652905 - DNA, 25 bp, Homo sapien
caacatccctagacctttgagggtt

SEQ ID NO: 652906 - DNA, 25 bp, Homo sapien
ctgttgattttcttaggtactgacc

SEQ ID NO: 652907 - DNA, 25 bp, Homo sapien
ggtactgaccagattactatgaata

SEQ ID NO: 652908 - DNA, 25 bp, Homo sapien
gacaagaaacaaacaggacaagcct

SEQ ID NO: 652909 - DNA, 25 bp, Homo sapien
ggacaagcctaaaatagaggttctg

SEQ ID NO: 652910 - DNA, 25 bp, Homo sapien
gaggttctggtaaacattcagggaa

SEQ ID NO: 652911 - DNA, 25 bp, Homo sapien
tattactgacatgtgagagctcggt

SEQ ID NO: 652912 - DNA, 25 bp, Homo sapien
aaacattctcaaaagggcacaggcc

SEQ ID NO: 652913 - DNA, 25 bp, Homo sapien
gcccacacgtctttgttgtttttat

SEQ ID NO: 652914 - DNA, 25 bp, Homo sapien
gattctgtcaagtagtcacacggaa

SEQ ID NO: 652915 - DNA, 25 bp, Homo sapien
aactaattgaactactggtcgtcta

SEQ ID NO: 652916 - DNA, 25 bp, Homo sapien
gaactactggtcgtctattgtgtca

SEQ ID NO: 652917 - DNA, 25 bp, Homo sapien
gtctattgtgtcagaaagcagtact

SEQ ID NO: 652918 - DNA, 25 bp, Homo sapien
gtactgagtgtcattctttttatct

SEQ ID NO: 652919 - DNA, 25 bp, Homo sapien
actttgttgttttcacagatcctct

SEQ ID NO: 652920 - DNA, 25 bp, Homo sapien
cacagatcctcttgtttctaagatg

SEQ ID NO: 652921 - DNA, 25 bp, Homo sapien
gatgtatgtttcacagccgactaat

SEQ ID NO: 652922 - DNA, 25 bp, Homo sapien
taaccctggttgtaatttcataaca

SEQ ID NO: 652923 - DNA, 25 bp, Homo sapien
ttcatgtgatgagattctgggcaac

SEQ ID NO: 652924 - DNA, 25 bp, Homo sapien
gaatttatatgtcacttccttgaag

SEQ ID NO: 652925 - DNA, 25 bp, Homo sapien
tatgtcacttccttgaagacacctg

SEQ ID NO: 652926 - DNA, 25 bp, Homo sapien
tccagcagcgctgaggagtgcgaca

SEQ ID NO: 652927 - DNA, 25 bp, Homo sapien
gagtgcgacattcaggaaatggcaa

SEQ ID NO: 652928 - DNA, 25 bp, Homo sapien
gcaatgcggcagtaaggaaggaatc

SEQ ID NO: 652929 - DNA, 25 bp, Homo sapien
gaatctgtgccctttaatgacctag

SEQ ID NO: 652930 - DNA, 25 bp, Homo sapien
tagaggagtagatccacttcgccac

SEQ ID NO: 652931 - DNA, 25 bp, Homo sapien
tggaccggccagactaatgtgagaa

SEQ ID NO: 652932 - DNA, 25 bp, Homo sapien
acacttctatctatgtaagccagta

SEQ ID NO: 652933 - DNA, 25 bp, Homo sapien
gtaatagcatctcaacctctatcca

SEQ ID NO: 652934 - DNA, 25 bp, Homo sapien
attaggtgtctccatcacagcttta

SEQ ID NO: 652935 - DNA, 25 bp, Homo sapien
ggaacagttaatgtgagctcgcttt

SEQ ID NO: 652936 - DNA, 25 bp, Homo sapien
aatgtgagctcgctttcaagtcaga

SEQ ID NO: 652937 - DNA, 25 bp, Homo sapien
gaatctaaaagtccaggtgcatctt

SEQ ID NO: 652938 - DNA, 25 bp, Homo sapien
gtgcatcttaactctgaacctttga

SEQ ID NO: 652939 - DNA, 25 bp, Homo sapien
gaacctttgaagtttactcatcctc

SEQ ID NO: 652940 - DNA, 25 bp, Homo sapien
gtttactcatcctcatttaatgtga

SEQ ID NO: 652941 - DNA, 25 bp, Homo sapien
aaggaaagatgaactgctctcaggg

SEQ ID NO: 652942 - DNA, 25 bp, Homo sapien
ggtgaaatctatctcacacgtgcat

SEQ ID NO: 652943 - DNA, 25 bp, Homo sapien
atctcacacgtgcatttatcttggg

SEQ ID NO: 652944 - DNA, 25 bp, Homo sapien
acaggcagttctgtgacattaacct

SEQ ID NO: 652945 - DNA, 25 bp, Homo sapien
gagcccggactttcatctggagatg

SEQ ID NO: 652946 - DNA, 25 bp, Homo sapien
agggaaataccacattcctgcgctg

SEQ ID NO: 652947 - DNA, 25 bp, Homo sapien
attcctgcgctgaccttttctcttt

SEQ ID NO: 652948 - DNA, 25 bp, Homo sapien
ggtacagaataaccctgacccagaa

SEQ ID NO: 652949 - DNA, 25 bp, Homo sapien
aagacaacagggttccatccggctt

SEQ ID NO: 652950 - DNA, 25 bp, Homo sapien
ccagctctattctaccgtcttatgg

SEQ ID NO: 652951 - DNA, 25 bp, Homo sapien
tattctaccgtcttatggcctctgg

SEQ ID NO: 652952 - DNA, 25 bp, Homo sapien
tctggcgcctttgctaattacacac

SEQ ID NO: 652953 - DNA, 25 bp, Homo sapien
ctttgctaattacacactcctactg

SEQ ID NO: 652954 - DNA, 25 bp, Homo sapien
actcctactgaaaattagccctcca

SEQ ID NO: 652955 - DNA, 25 bp, Homo sapien
aaggtaatgcgtattgtagtctaaa

SEQ ID NO: 652956 - DNA, 25 bp, Homo sapien
tggacaggatactccaagcgggcct

SEQ ID NO: 652957 - DNA, 25 bp, Homo sapien
aggatactccaagcgggcctggacg

SEQ ID NO: 652958 - DNA, 25 bp, Homo sapien
tggagcgtctctccctcaggaattt

SEQ ID NO: 652959 - DNA, 25 bp, Homo sapien
atttccattccaagcgaggcatgtg

SEQ ID NO: 652960 - DNA, 25 bp, Homo sapien
gcatgtggagccgtcgccagatgaa

SEQ ID NO: 652961 - DNA, 25 bp, Homo sapien
gtcgccagatgaagacgctgtagcc

SEQ ID NO: 652962 - DNA, 25 bp, Homo sapien
gctctggactagcagtggctcccca

SEQ ID NO: 652963 - DNA, 25 bp, Homo sapien
cagggccctgctactgttcagggat

SEQ ID NO: 652964 - DNA, 25 bp, Homo sapien
tggaccccaagaggcctcgaagctg

SEQ ID NO: 652965 - DNA, 25 bp, Homo sapien
aagaggcctcgaagctgacggccca

SEQ ID NO: 652966 - DNA, 25 bp, Homo sapien
agctgtcccctcacagaggcaggtt

SEQ ID NO: 652967 - DNA, 25 bp, Homo sapien
cctcatatcaaatctccttctaatt

SEQ ID NO: 652968 - DNA, 25 bp, Homo sapien
atcaaatctccttctaatttcctca

SEQ ID NO: 652969 - DNA, 25 bp, Homo sapien
caaatctccttctaatttcctcaaa

SEQ ID NO: 652970 - DNA, 25 bp, Homo sapien
tttcctcaaacttgtgcctcatctg

SEQ ID NO: 652971 - DNA, 25 bp, Homo sapien
tcaaacttgtgcctcatctgtctgc

SEQ ID NO: 652972 - DNA, 25 bp, Homo sapien
aaacttgtgcctcatctgtctgccc

SEQ ID NO: 652973 - DNA, 25 bp, Homo sapien
atctgtctgcccctttctcaaggga

SEQ ID NO: 652974 - DNA, 25 bp, Homo sapien
gtctgcccctttctcaagggaatga

SEQ ID NO: 652975 - DNA, 25 bp, Homo sapien
gcccctttctcaagggaatgaatgt

SEQ ID NO: 652976 - DNA, 25 bp, Homo sapien
aaatgaactgacttctccacctttt

SEQ ID NO: 652977 - DNA, 25 bp, Homo sapien
caagcagtgtcttctacgtggcaga

SEQ ID NO: 652978 - DNA, 25 bp, Homo sapien
taagcagtcaattaacacatgtttt

SEQ ID NO: 652979 - DNA, 25 bp, Homo sapien
gtattatatactctattggtacaat

SEQ ID NO: 652980 - DNA, 25 bp, Homo sapien
gggcactgttctccaggatataata

SEQ ID NO: 652981 - DNA, 25 bp, Homo sapien
gatataatatagttgatccttgaac

SEQ ID NO: 652982 - DNA, 25 bp, Homo sapien
gggttaatggcactgacccctacac

SEQ ID NO: 652983 - DNA, 25 bp, Homo sapien
ttaatggcactgacccctacacagt

SEQ ID NO: 652984 - DNA, 25 bp, Homo sapien
tgtgaataacttttgactttccaaa

SEQ ID NO: 652985 - DNA, 25 bp, Homo sapien
aaaacttgactattaatgacctact

SEQ ID NO: 652986 - DNA, 25 bp, Homo sapien
attaatgacctactcttgaccagaa

SEQ ID NO: 652987 - DNA, 25 bp, Homo sapien
aatgacctactcttgaccagaaacc

SEQ ID NO: 652988 - DNA, 25 bp, Homo sapien
gacctactcttgaccagaaacctta

SEQ ID NO: 652989 - DNA, 25 bp, Homo sapien
cacagggtccttacaggaattcttt

SEQ ID NO: 652990 - DNA, 25 bp, Homo sapien
ttctgaagagctgcacacagtcatt

SEQ ID NO: 652991 - DNA, 25 bp, Homo sapien
aggagggcatcctagtgcccctcat

SEQ ID NO: 652992 - DNA, 25 bp, Homo sapien
agggcatcctagtgcccctcatgct

SEQ ID NO: 652993 - DNA, 25 bp, Homo sapien
gggcctgatgcctggtcatcatttg

SEQ ID NO: 652994 - DNA, 25 bp, Homo sapien
atgcctggtcatcatttgagtcctc

SEQ ID NO: 652995 - DNA, 25 bp, Homo sapien
ctggtcatcatttgagtcctctggg

SEQ ID NO: 652996 - DNA, 25 bp, Homo sapien
ggtcatcatttgagtcctctgggac

SEQ ID NO: 652997 - DNA, 25 bp, Homo sapien
tcatcatttgagtcctctgggacac

SEQ ID NO: 652998 - DNA, 25 bp, Homo sapien
cattagcagtcactgcatattcccc

SEQ ID NO: 652999 - DNA, 25 bp, Homo sapien
ctgggcaactatctactttctgtct

SEQ ID NO: 653000 - DNA, 25 bp, Homo sapien
aaagacctgtccattggacctgctc

SEQ ID NO: 653001 - DNA, 25 bp, Homo sapien
ttggacctgctcatggaggaaatac

SEQ ID NO: 653002 - DNA, 25 bp, Homo sapien
aatacgaagggagcctggtgccgat

SEQ ID NO: 653003 - DNA, 25 bp, Homo sapien
aagggagcctggtgccgatgctttc

SEQ ID NO: 653004 - DNA, 25 bp, Homo sapien
cgatgctttcttccgggcagtgacc

SEQ ID NO: 653005 - DNA, 25 bp, Homo sapien
atgccactttagaaacaatcctgag

SEQ ID NO: 653006 - DNA, 25 bp, Homo sapien
caatcctgaggcataaccagttgat

SEQ ID NO: 653007 - DNA, 25 bp, Homo sapien
aaccagttgatcttggaggccatcc

SEQ ID NO: 653008 - DNA, 25 bp, Homo sapien
gaggccatccaacagaagattgagt

SEQ ID NO: 653009 - DNA, 25 bp, Homo sapien
attctgagcattccctctgagacag

SEQ ID NO: 653010 - DNA, 25 bp, Homo sapien
tctgagacagccagccctgaagctt

SEQ ID NO: 653011 - DNA, 25 bp, Homo sapien
gaaacatagagattaagactgggcc

SEQ ID NO: 653012 - DNA, 25 bp, Homo sapien
aaacatagagattaagactgggcca

SEQ ID NO: 653013 - DNA, 25 bp, Homo sapien
aacatagagattaagactgggccag

SEQ ID NO: 653014 - DNA, 25 bp, Homo sapien
acatagagattaagactgggccagg

SEQ ID NO: 653015 - DNA, 25 bp, Homo sapien
catagagattaagactgggccaggt

SEQ ID NO: 653016 - DNA, 25 bp, Homo sapien
atagagattaagactgggccaggtg

SEQ ID NO: 653017 - DNA, 25 bp, Homo sapien
tagagattaagactgggccaggtgt

SEQ ID NO: 653018 - DNA, 25 bp, Homo sapien
agagattaagactgggccaggtgtg

SEQ ID NO: 653019 - DNA, 25 bp, Homo sapien
gtaaggagatcgagagcagtctgac

SEQ ID NO: 653020 - DNA, 25 bp, Homo sapien
taaggagatcgagagcagtctgacc

SEQ ID NO: 653021 - DNA, 25 bp, Homo sapien
aaggagatcgagagcagtctgacca

SEQ ID NO: 653022 - DNA, 25 bp, Homo sapien
aggaacacttctgccctgatctgct

SEQ ID NO: 653023 - DNA, 25 bp, Homo sapien
ttctgccctgatctgctgtttgcag

SEQ ID NO: 653024 - DNA, 25 bp, Homo sapien
gaggacgagggctgtcatcctgctc

SEQ ID NO: 653025 - DNA, 25 bp, Homo sapien
cacacagtgctcactggaagctttg

SEQ ID NO: 653026 - DNA, 25 bp, Homo sapien
ggaagctttggtgctttgctgaccc

SEQ ID NO: 653027 - DNA, 25 bp, Homo sapien
gtgctttgctgaccctgtgacctga

SEQ ID NO: 653028 - DNA, 25 bp, Homo sapien
ccagcatcctcgtctgtaaagtggg

SEQ ID NO: 653029 - DNA, 25 bp, Homo sapien
gtgacagtagctgcctgacatgact

SEQ ID NO: 653030 - DNA, 25 bp, Homo sapien
gacatgactgacagactcgtttgtt

SEQ ID NO: 653031 - DNA, 25 bp, Homo sapien
gactcgtttgttaagcactgtcacg

SEQ ID NO: 653032 - DNA, 25 bp, Homo sapien
cactgtcacgtgtgggaggcgactt

SEQ ID NO: 653033 - DNA, 25 bp, Homo sapien
tggcgagggaaaggcgtacgcgctc

SEQ ID NO: 653034 - DNA, 25 bp, Homo sapien
gggaaaggcgtacgcgctcagcaga

SEQ ID NO: 653035 - DNA, 25 bp, Homo sapien
tcttctgcgggcaaaaccccaggaa

SEQ ID NO: 653036 - DNA, 25 bp, Homo sapien
tctgcgggcaaaaccccaggaaccg

SEQ ID NO: 653037 - DNA, 25 bp, Homo sapien
ggaaccggcagcagaaactccggaa

SEQ ID NO: 653038 - DNA, 25 bp, Homo sapien
gcagaaactccggaagcggcgttgc

SEQ ID NO: 653039 - DNA, 25 bp, Homo sapien
cagaaactccggaagcggcgttgcg

SEQ ID NO: 653040 - DNA, 25 bp, Homo sapien
tggtggagggagctactggaaagaa

SEQ ID NO: 653041 - DNA, 25 bp, Homo sapien
aggatgtctgcagtctgagctcatc

SEQ ID NO: 653042 - DNA, 25 bp, Homo sapien
atgtctgcagtctgagctcatccag

SEQ ID NO: 653043 - DNA, 25 bp, Homo sapien
tgtctgcagtctgagctcatccagt

SEQ ID NO: 653044 - DNA, 25 bp, Homo sapien
tttccagaaataagcttgctgaatc

SEQ ID NO: 653045 - DNA, 25 bp, Homo sapien
ttgctgaatcaccacaggcttaatt

SEQ ID NO: 653046 - DNA, 25 bp, Homo sapien
gctgaatcaccacaggcttaattta

SEQ ID NO: 653047 - DNA, 25 bp, Homo sapien
tgaatcaccacaggcttaatttatt

SEQ ID NO: 653048 - DNA, 25 bp, Homo sapien
aatcaccacaggcttaatttattta

SEQ ID NO: 653049 - DNA, 25 bp, Homo sapien
tcaccacaggcttaatttatttatt

SEQ ID NO: 653050 - DNA, 25 bp, Homo sapien
tttaactaccagtttcctgaatgtt

SEQ ID NO: 653051 - DNA, 25 bp, Homo sapien
cctatctgcagttgcccttggtcca

SEQ ID NO: 653052 - DNA, 25 bp, Homo sapien
agttgcccttggtccacccttgagc

SEQ ID NO: 653053 - DNA, 25 bp, Homo sapien
ccttgagcccactctttaagcctgt

SEQ ID NO: 653054 - DNA, 25 bp, Homo sapien
agtacaagtacttcctgctgagaat

SEQ ID NO: 653055 - DNA, 25 bp, Homo sapien
tttctgcatttttagctcccactca

SEQ ID NO: 653056 - DNA, 25 bp, Homo sapien
acatcctctggtcataatcactgct

SEQ ID NO: 653057 - DNA, 25 bp, Homo sapien
aatcactgctctaatgtctcatttg

SEQ ID NO: 653058 - DNA, 25 bp, Homo sapien
tgtctcatttgctgaattatatcgc

SEQ ID NO: 653059 - DNA, 25 bp, Homo sapien
tatatcgcagcggttcagttggagt

SEQ ID NO: 653060 - DNA, 25 bp, Homo sapien
tgcacaccacttcggctgatgatgg

SEQ ID NO: 653061 - DNA, 25 bp, Homo sapien
tcggctgatgatggccataaagcaa

SEQ ID NO: 653062 - DNA, 25 bp, Homo sapien
aaagcaagttgccatctctgtacca

SEQ ID NO: 653063 - DNA, 25 bp, Homo sapien
aagttgccatctctgtaccacttta

SEQ ID NO: 653064 - DNA, 25 bp, Homo sapien
tctgtaccactttacacagaggcca

SEQ ID NO: 653065 - DNA, 25 bp, Homo sapien
acacagaggccatcagacagtcacg

SEQ ID NO: 653066 - DNA, 25 bp, Homo sapien
agaaaaccacaccaatatgcatcat

SEQ ID NO: 653067 - DNA, 25 bp, Homo sapien
aaaccacaccaatatgcatcatagt

SEQ ID NO: 653068 - DNA, 25 bp, Homo sapien
tgcatcatagtcaaagtgctaaaag

SEQ ID NO: 653069 - DNA, 25 bp, Homo sapien
aaaagtcacactttatactcaagtg

SEQ ID NO: 653070 - DNA, 25 bp, Homo sapien
gtcacactttatactcaagtgaaca

SEQ ID NO: 653071 - DNA, 25 bp, Homo sapien
gaagtaagactattcatcagaaaca

SEQ ID NO: 653072 - DNA, 25 bp, Homo sapien
gactattcatcagaaacagtggaga

SEQ ID NO: 653073 - DNA, 25 bp, Homo sapien
tcatcagaaacagtggagaacagaa

SEQ ID NO: 653074 - DNA, 25 bp, Homo sapien
gaaaaaactgtcaacctagatacta

SEQ ID NO: 653075 - DNA, 25 bp, Homo sapien
actgtcaacctagatactaaatcca

SEQ ID NO: 653076 - DNA, 25 bp, Homo sapien
agaaattgtcagacgacgaaggctg

SEQ ID NO: 653077 - DNA, 25 bp, Homo sapien
cacaccacctatttttctgtatcag

SEQ ID NO: 653078 - DNA, 25 bp, Homo sapien
gtatagtgcttaagttgtacataat

SEQ ID NO: 653079 - DNA, 25 bp, Homo sapien
gttaactcactttcaatacaggcca

SEQ ID NO: 653080 - DNA, 25 bp, Homo sapien
ctcactttcaatacaggccaatcat

SEQ ID NO: 653081 - DNA, 25 bp, Homo sapien
gccaatcatgattgactatcagtag

SEQ ID NO: 653082 - DNA, 25 bp, Homo sapien
cagtagcttttgtgacaaacttagt

SEQ ID NO: 653083 - DNA, 25 bp, Homo sapien
ttgaacctttcagagttccccttct

SEQ ID NO: 653084 - DNA, 25 bp, Homo sapien
agagttccccttctcatgtcatatg

SEQ ID NO: 653085 - DNA, 25 bp, Homo sapien
ccccttctcatgtcatatgctattt

SEQ ID NO: 653086 - DNA, 25 bp, Homo sapien
ctcatgtcatatgctatttctgttt

SEQ ID NO: 653087 - DNA, 25 bp, Homo sapien
aatgaaactttatccatcaaaatga

SEQ ID NO: 653088 - DNA, 25 bp, Homo sapien
gtgctgtgctcagagtcagaggttc

SEQ ID NO: 653089 - DNA, 25 bp, Homo sapien
gagtcagaggttccttgatgcccag

SEQ ID NO: 653090 - DNA, 25 bp, Homo sapien
tgatgcccagcacgtgggtcaccag

SEQ ID NO: 653091 - DNA, 25 bp, Homo sapien
gctttgccaggtgtacttttgaaaa

SEQ ID NO: 653092 - DNA, 25 bp, Homo sapien
aggcttccatgaggttgttctgact

SEQ ID NO: 653093 - DNA, 25 bp, Homo sapien
tctgactctctgttgttagaatggc

SEQ ID NO: 653094 - DNA, 25 bp, Homo sapien
ttagaatggcaaccctaaatgagcc

SEQ ID NO: 653095 - DNA, 25 bp, Homo sapien
atgagccgcagagctgcatgtttat

SEQ ID NO: 653096 - DNA, 25 bp, Homo sapien
agatttgcacagatcaccacgccag

SEQ ID NO: 653097 - DNA, 25 bp, Homo sapien
gatcaccacgccagtgaagactaat

SEQ ID NO: 653098 - DNA, 25 bp, Homo sapien
gactaatcaccatgaaaagccaccc

SEQ ID NO: 653099 - DNA, 25 bp, Homo sapien
cacagtgggctataccacttagtat

SEQ ID NO: 653100 - DNA, 25 bp, Homo sapien
ataccacttagtatagttcgctact

SEQ ID NO: 653101 - DNA, 25 bp, Homo sapien
agttcgctactattttgtggcctac

SEQ ID NO: 653102 - DNA, 25 bp, Homo sapien
gctactattttgtggcctacatgac

SEQ ID NO: 653103 - DNA, 25 bp, Homo sapien
ttgtggcctacatgacaggtgtcaa

SEQ ID NO: 653104 - DNA, 25 bp, Homo sapien
aacatgccattgtgtttcaggctcg

SEQ ID NO: 653105 - DNA, 25 bp, Homo sapien
cattgtgtttcaggctcgcgggatt

SEQ ID NO: 653106 - DNA, 25 bp, Homo sapien
catacgtttttctactgtgatttgt

SEQ ID NO: 653107 - DNA, 25 bp, Homo sapien
gtttttctactgtgatttgtatgaa

SEQ ID NO: 653108 - DNA, 25 bp, Homo sapien
gaaaggtaacatcaaatcaaggaat

SEQ ID NO: 653109 - DNA, 25 bp, Homo sapien
ggaatagattcagtaaagtcagtag

SEQ ID NO: 653110 - DNA, 25 bp, Homo sapien
ataagtgctttcttcgtaaatgtgg

SEQ ID NO: 653111 - DNA, 25 bp, Homo sapien
gtgctttcttcgtaaatgtggtatt

SEQ ID NO: 653112 - DNA, 25 bp, Homo sapien
aaaaaatatcctgccctccagatgg

SEQ ID NO: 653113 - DNA, 25 bp, Homo sapien
tgccctccagatgggttcttttaaa

SEQ ID NO: 653114 - DNA, 25 bp, Homo sapien
ctccagatgggttcttttaaacaat

SEQ ID NO: 653115 - DNA, 25 bp, Homo sapien
gttttctctgttttaatgtgtcatg

SEQ ID NO: 653116 - DNA, 25 bp, Homo sapien
aatcttaatgacatggatctgttac

SEQ ID NO: 653117 - DNA, 25 bp, Homo sapien
gatctgttactaatttaagccattg

SEQ ID NO: 653118 - DNA, 25 bp, Homo sapien
aagccattgctagatctcatccttt

SEQ ID NO: 653119 - DNA, 25 bp, Homo sapien
ttgctagatctcatccttttaggaa

SEQ ID NO: 653120 - DNA, 25 bp, Homo sapien
gtacgagaaaaccttccaaatagca

SEQ ID NO: 653121 - DNA, 25 bp, Homo sapien
ttttcctgttcttggctgggcgtca

SEQ ID NO: 653122 - DNA, 25 bp, Homo sapien
tttcctgttcttggctgggcgtcat

SEQ ID NO: 653123 - DNA, 25 bp, Homo sapien
ttcctgttcttggctgggcgtcatg

SEQ ID NO: 653124 - DNA, 25 bp, Homo sapien
tcctgttcttggctgggcgtcatgg

SEQ ID NO: 653125 - DNA, 25 bp, Homo sapien
cctgttcttggctgggcgtcatggc

SEQ ID NO: 653126 - DNA, 25 bp, Homo sapien
ctgttcttggctgggcgtcatggct

SEQ ID NO: 653127 - DNA, 25 bp, Homo sapien
tgttcttggctgggcgtcatggctc

SEQ ID NO: 653128 - DNA, 25 bp, Homo sapien
gttcttggctgggcgtcatggctca

SEQ ID NO: 653129 - DNA, 25 bp, Homo sapien
tgggcgtcatggctcacgcttacaa

SEQ ID NO: 653130 - DNA, 25 bp, Homo sapien
gggcgtcatggctcacgcttacaat

SEQ ID NO: 653131 - DNA, 25 bp, Homo sapien
ggcgtcatggctcacgcttacaatc

SEQ ID NO: 653132 - DNA, 25 bp, Homo sapien
cactggtgagcatgccagcctctgc

SEQ ID NO: 653133 - DNA, 25 bp, Homo sapien
tgcctgaaaggtccattaggacatc

SEQ ID NO: 653134 - DNA, 25 bp, Homo sapien
gaaaggtccattaggacatcactca

SEQ ID NO: 653135 - DNA, 25 bp, Homo sapien
aggtccattaggacatcactcatgg

SEQ ID NO: 653136 - DNA, 25 bp, Homo sapien
gtccattaggacatcactcatggga

SEQ ID NO: 653137 - DNA, 25 bp, Homo sapien
cattaggacatcactcatgggattt

SEQ ID NO: 653138 - DNA, 25 bp, Homo sapien
ttaggacatcactcatgggattttt

SEQ ID NO: 653139 - DNA, 25 bp, Homo sapien
aggacatcactcatgggatttttaa

SEQ ID NO: 653140 - DNA, 25 bp, Homo sapien
gacatcactcatgggatttttaaaa

SEQ ID NO: 653141 - DNA, 25 bp, Homo sapien
cctctttccaggaatggaactgatg

SEQ ID NO: 653142 - DNA, 25 bp, Homo sapien
aggctggttttgatgaaagtatgtt

SEQ ID NO: 653143 - DNA, 25 bp, Homo sapien
ggagactcctctggcgacaccgaca

SEQ ID NO: 653144 - DNA, 25 bp, Homo sapien
gacaccgacagcacccaatgctggg

SEQ ID NO: 653145 - DNA, 25 bp, Homo sapien
ggagactctcatccacagctggtgg

SEQ ID NO: 653146 - DNA, 25 bp, Homo sapien
gactctcatccacagctggtggaaa

SEQ ID NO: 653147 - DNA, 25 bp, Homo sapien
gaaatgtgacatgacacagccactt

SEQ ID NO: 653148 - DNA, 25 bp, Homo sapien
aagccagttgggcagtcgctcgcaa

SEQ ID NO: 653149 - DNA, 25 bp, Homo sapien
gtggactcaaaccacacatccccga

SEQ ID NO: 653150 - DNA, 25 bp, Homo sapien
acatccccgaagtgtcacagacatt

SEQ ID NO: 653151 - DNA, 25 bp, Homo sapien
atccccgaagtgtcacagacattga

SEQ ID NO: 653152 - DNA, 25 bp, Homo sapien
aaactgacatccacactgtagaaag

SEQ ID NO: 653153 - DNA, 25 bp, Homo sapien
ctgacatccacactgtagaaagtaa

SEQ ID NO: 653154 - DNA, 25 bp, Homo sapien
ttacatttaaaaacgtcatggctgg

SEQ ID NO: 653155 - DNA, 25 bp, Homo sapien
tacatttaaaaacgtcatggctggg

SEQ ID NO: 653156 - DNA, 25 bp, Homo sapien
acatttaaaaacgtcatggctgggt

SEQ ID NO: 653157 - DNA, 25 bp, Homo sapien
catttaaaaacgtcatggctgggtg

SEQ ID NO: 653158 - DNA, 25 bp, Homo sapien
taaaaacgtcatggctgggtgcagt

SEQ ID NO: 653159 - DNA, 25 bp, Homo sapien
attagctgggagtggcggcaggcat

SEQ ID NO: 653160 - DNA, 25 bp, Homo sapien
ttagctgggagtggcggcaggcatc

SEQ ID NO: 653161 - DNA, 25 bp, Homo sapien
tgggagtggcggcaggcatctgtaa

SEQ ID NO: 653162 - DNA, 25 bp, Homo sapien
gggagtggcggcaggcatctgtaat

SEQ ID NO: 653163 - DNA, 25 bp, Homo sapien
ggagtggcggcaggcatctgtaatc

SEQ ID NO: 653164 - DNA, 25 bp, Homo sapien
agtggcggcaggcatctgtaatccc

SEQ ID NO: 653165 - DNA, 25 bp, Homo sapien
attaaatattcattcttccccattg

SEQ ID NO: 653166 - DNA, 25 bp, Homo sapien
ttaaatattcattcttccccattgt

SEQ ID NO: 653167 - DNA, 25 bp, Homo sapien
taaatattcattcttccccattgtc

SEQ ID NO: 653168 - DNA, 25 bp, Homo sapien
aaatattcattcttccccattgtct

SEQ ID NO: 653169 - DNA, 25 bp, Homo sapien
aatattcattcttccccattgtctc

SEQ ID NO: 653170 - DNA, 25 bp, Homo sapien
atattcattcttccccattgtctct

SEQ ID NO: 653171 - DNA, 25 bp, Homo sapien
attcttccccattgtctctccaaat

SEQ ID NO: 653172 - DNA, 25 bp, Homo sapien
tcttccccattgtctctccaaatgt

SEQ ID NO: 653173 - DNA, 25 bp, Homo sapien
ttccccattgtctctccaaatgtct

SEQ ID NO: 653174 - DNA, 25 bp, Homo sapien
ccattgtctctccaaatgtctcctt

SEQ ID NO: 653175 - DNA, 25 bp, Homo sapien
attgtctctccaaatgtctccttcc

SEQ ID NO: 653176 - DNA, 25 bp, Homo sapien
ttatctaaattgaaaggatggtttt

SEQ ID NO: 653177 - DNA, 25 bp, Homo sapien
tatctaaattgaaaggatggttttg

SEQ ID NO: 653178 - DNA, 25 bp, Homo sapien
atctaaattgaaaggatggttttgc

SEQ ID NO: 653179 - DNA, 25 bp, Homo sapien
tctaaattgaaaggatggttttgcc

SEQ ID NO: 653180 - DNA, 25 bp, Homo sapien
ctaaattgaaaggatggttttgcct

SEQ ID NO: 653181 - DNA, 25 bp, Homo sapien
taaattgaaaggatggttttgcctt

SEQ ID NO: 653182 - DNA, 25 bp, Homo sapien
atggttttgcctttcagcctttaga

SEQ ID NO: 653183 - DNA, 25 bp, Homo sapien
tggttttgcctttcagcctttagaa

SEQ ID NO: 653184 - DNA, 25 bp, Homo sapien
ggttttgcctttcagcctttagaag

SEQ ID NO: 653185 - DNA, 25 bp, Homo sapien
gttttgcctttcagcctttagaaga

SEQ ID NO: 653186 - DNA, 25 bp, Homo sapien
ttttgcctttcagcctttagaagaa

SEQ ID NO: 653187 - DNA, 25 bp, Homo sapien
aaaattcacatgctgcagtccgcac

SEQ ID NO: 653188 - DNA, 25 bp, Homo sapien
gacctcagaatgtgattgtaactgg

SEQ ID NO: 653189 - DNA, 25 bp, Homo sapien
gggtctttatagaggagactggatt

SEQ ID NO: 653190 - DNA, 25 bp, Homo sapien
gaggtcatacaggtagactcttatc

SEQ ID NO: 653191 - DNA, 25 bp, Homo sapien
ggtagactcttatccaatatgactg

SEQ ID NO: 653192 - DNA, 25 bp, Homo sapien
tatgactgctctccttacaaaaaga

SEQ ID NO: 653193 - DNA, 25 bp, Homo sapien
gactgctctccttacaaaaagaggg

SEQ ID NO: 653194 - DNA, 25 bp, Homo sapien
agagggaaaagcacatgcaggcgct

SEQ ID NO: 653195 - DNA, 25 bp, Homo sapien
ccatcagtgaggacaaaggctccag

SEQ ID NO: 653196 - DNA, 25 bp, Homo sapien
aaggctccagaagaaccaatcctgc

SEQ ID NO: 653197 - DNA, 25 bp, Homo sapien
agaagaaccaatcctgcccaacact

SEQ ID NO: 653198 - DNA, 25 bp, Homo sapien
gggccacatagtgtatagttctatt

SEQ ID NO: 653199 - DNA, 25 bp, Homo sapien
aatgtccaggaaagacaaaagcata

SEQ ID NO: 653200 - DNA, 25 bp, Homo sapien
gaggcagaaagcagactagtgctgt

SEQ ID NO: 653201 - DNA, 25 bp, Homo sapien
cagaaagcagactagtgctgtggga

SEQ ID NO: 653202 - DNA, 25 bp, Homo sapien
ttgtgaaggtggatgcccaactctg

SEQ ID NO: 653203 - DNA, 25 bp, Homo sapien
gtgaaggtggatgcccaactctgcg

SEQ ID NO: 653204 - DNA, 25 bp, Homo sapien
aaggtggatgcccaactctgcgaat

SEQ ID NO: 653205 - DNA, 25 bp, Homo sapien
gtggatgcccaactctgcgaataca

SEQ ID NO: 653206 - DNA, 25 bp, Homo sapien
atgcccaactctgcgaatacactaa

SEQ ID NO: 653207 - DNA, 25 bp, Homo sapien
cgaatacactaaaaggcatcgaatt

SEQ ID NO: 653208 - DNA, 25 bp, Homo sapien
aaaaggcatcgaattgtatacttta

SEQ ID NO: 653209 - DNA, 25 bp, Homo sapien
agaagttaagaagacatcctttact

SEQ ID NO: 653210 - DNA, 25 bp, Homo sapien
tcctttactttttaagacactctgt

SEQ ID NO: 653211 - DNA, 25 bp, Homo sapien
gacactctgtcattttattcattga

SEQ ID NO: 653212 - DNA, 25 bp, Homo sapien
cattgatttttagtggtgttctaga

SEQ ID NO: 653213 - DNA, 25 bp, Homo sapien
gcagattttccaagcgtaaagcaca

SEQ ID NO: 653214 - DNA, 25 bp, Homo sapien
aaatggcagagctgatgacagttca

SEQ ID NO: 653215 - DNA, 25 bp, Homo sapien
gatgacagttcagatgctattagat

SEQ ID NO: 653216 - DNA, 25 bp, Homo sapien
atgggtgtgcagatctaggtttaga

SEQ ID NO: 653217 - DNA, 25 bp, Homo sapien
ggatggagtagtgtctcttggtctc

SEQ ID NO: 653218 - DNA, 25 bp, Homo sapien
gtgtctcttggtctccactgtggag

SEQ ID NO: 653219 - DNA, 25 bp, Homo sapien
ggacccatggtctctgcttggtctg

SEQ ID NO: 653220 - DNA, 25 bp, Homo sapien
gaatcgaacccaggaggcaaaggct

SEQ ID NO: 653221 - DNA, 25 bp, Homo sapien
aatcgaacccaggaggcaaaggctg

SEQ ID NO: 653222 - DNA, 25 bp, Homo sapien
atcgaacccaggaggcaaaggctgc

SEQ ID NO: 653223 - DNA, 25 bp, Homo sapien
ttttgcttttaggcgaggcatggtg

SEQ ID NO: 653224 - DNA, 25 bp, Homo sapien
tttgcttttaggcgaggcatggtgg

SEQ ID NO: 653225 - DNA, 25 bp, Homo sapien
ttgcttttaggcgaggcatggtggc

SEQ ID NO: 653226 - DNA, 25 bp, Homo sapien
tgcttttaggcgaggcatggtggct

SEQ ID NO: 653227 - DNA, 25 bp, Homo sapien
gcttttaggcgaggcatggtggctc

SEQ ID NO: 653228 - DNA, 25 bp, Homo sapien
cttttaggcgaggcatggtggctca

SEQ ID NO: 653229 - DNA, 25 bp, Homo sapien
atggtgaaacctgaaaccccatctc

SEQ ID NO: 653230 - DNA, 25 bp, Homo sapien
tggtgaaacctgaaaccccatctct

SEQ ID NO: 653231 - DNA, 25 bp, Homo sapien
gtttcttttcctggtaagctaacag

SEQ ID NO: 653232 - DNA, 25 bp, Homo sapien
gtaagctaacagtctcttcaattct

SEQ ID NO: 653233 - DNA, 25 bp, Homo sapien
aacagtctcttcaattctgtcacca

SEQ ID NO: 653234 - DNA, 25 bp, Homo sapien
ttcaattctgtcaccatcctttcca

SEQ ID NO: 653235 - DNA, 25 bp, Homo sapien
aggagtctgtagataaccttgcctc

SEQ ID NO: 653236 - DNA, 25 bp, Homo sapien
gaaatctttctaatgccatcaagct

SEQ ID NO: 653237 - DNA, 25 bp, Homo sapien
tcaagcttggtttcctggattctct

SEQ ID NO: 653238 - DNA, 25 bp, Homo sapien
ggtttcctggattctctatcttaat

SEQ ID NO: 653239 - DNA, 25 bp, Homo sapien
ctatcttaattgttggtaccaccat

SEQ ID NO: 653240 - DNA, 25 bp, Homo sapien
taattgttggtaccaccatccacca

SEQ ID NO: 653241 - DNA, 25 bp, Homo sapien
accatccaccaacccggaaatagag

SEQ ID NO: 653242 - DNA, 25 bp, Homo sapien
catgttctccatgtttggtttcttt

SEQ ID NO: 653243 - DNA, 25 bp, Homo sapien
ggtttctttgtgcaagccattgtca

SEQ ID NO: 653244 - DNA, 25 bp, Homo sapien
aagccattgtcaccggcaagggtcc

SEQ ID NO: 653245 - DNA, 25 bp, Homo sapien
aagggtccacttgagaacctcgctg

SEQ ID NO: 653246 - DNA, 25 bp, Homo sapien
cgaccctgtcaacaacaatgcttgg

SEQ ID NO: 653247 - DNA, 25 bp, Homo sapien
aatgcttgggcattcgccaccaact

SEQ ID NO: 653248 - DNA, 25 bp, Homo sapien
gccaccaactttgttcctgggaagt

SEQ ID NO: 653249 - DNA, 25 bp, Homo sapien
gtaagctgtcttgcagaccatgctt

SEQ ID NO: 653250 - DNA, 25 bp, Homo sapien
cttgcagaccatgcttgcggtgagg

SEQ ID NO: 653251 - DNA, 25 bp, Homo sapien
tcgtcgtgcgcgtgatatgtactat

SEQ ID NO: 653252 - DNA, 25 bp, Homo sapien
gcattacaagatttgcctgccttcc

SEQ ID NO: 653253 - DNA, 25 bp, Homo sapien
tatggcgttggattctgccgcccaa

SEQ ID NO: 653254 - DNA, 25 bp, Homo sapien
gcccaacctacttggcttctaggag

SEQ ID NO: 653255 - DNA, 25 bp, Homo sapien
ggcttctaggagctgccagtcttct

SEQ ID NO: 653256 - DNA, 25 bp, Homo sapien
ttcttgctacagaccaacttgtgga

SEQ ID NO: 653257 - DNA, 25 bp, Homo sapien
aacttgtggatcaggcttctactat

SEQ ID NO: 653258 - DNA, 25 bp, Homo sapien
attgctgattttgttggctaatgcc

SEQ ID NO: 653259 - DNA, 25 bp, Homo sapien
ttggctaatgccttcaatgcctcta

SEQ ID NO: 653260 - DNA, 25 bp, Homo sapien
gcctctactcataacctttattgtc

SEQ ID NO: 653261 - DNA, 25 bp, Homo sapien
caagttctcagtttgtctttgtccc

SEQ ID NO: 653262 - DNA, 25 bp, Homo sapien
tttgtccccaaatactggctggcag

SEQ ID NO: 653263 - DNA, 25 bp, Homo sapien
ctggctggcaggcttcatctgaaaa

SEQ ID NO: 653264 - DNA, 25 bp, Homo sapien
aaaccagcacagatgttctgaactg

SEQ ID NO: 653265 - DNA, 25 bp, Homo sapien
ttctgaactgaatggtgtggcctct

SEQ ID NO: 653266 - DNA, 25 bp, Homo sapien
gaactgaatggtgtggcctcttttt

SEQ ID NO: 653267 - DNA, 25 bp, Homo sapien
aatggtgtggcctctttttgtgtaa

SEQ ID NO: 653268 - DNA, 25 bp, Homo sapien
gtggcctctttttgtgtaaattcct

SEQ ID NO: 653269 - DNA, 25 bp, Homo sapien
gtgtaaattccttttgccgtaatgg

SEQ ID NO: 653270 - DNA, 25 bp, Homo sapien
ttccttttgccgtaatggatgcagt

SEQ ID NO: 653271 - DNA, 25 bp, Homo sapien
gatgcagtggaataacaatgtttac

SEQ ID NO: 653272 - DNA, 25 bp, Homo sapien
aatgtttacaggtaccgatcccgat

SEQ ID NO: 653273 - DNA, 25 bp, Homo sapien
tgtttacaggtaccgatcccgatcc

SEQ ID NO: 653274 - DNA, 25 bp, Homo sapien
ccgatccctgctcaatgtagcattt

SEQ ID NO: 653275 - DNA, 25 bp, Homo sapien
aagcccattttagagatatcacatt

SEQ ID NO: 653276 - DNA, 25 bp, Homo sapien
gcccattttagagatatcacattga

SEQ ID NO: 653277 - DNA, 25 bp, Homo sapien
gtcatcagtatgactgtcttccctg

SEQ ID NO: 653278 - DNA, 25 bp, Homo sapien
tcatcagtatgactgtcttccctga

SEQ ID NO: 653279 - DNA, 25 bp, Homo sapien
tcagtatgactgtcttccctgatat

SEQ ID NO: 653280 - DNA, 25 bp, Homo sapien
agtatgactgtcttccctgatataa

SEQ ID NO: 653281 - DNA, 25 bp, Homo sapien
gtatgactgtcttccctgatataaa

SEQ ID NO: 653282 - DNA, 25 bp, Homo sapien
tatgactgtcttccctgatataaac

SEQ ID NO: 653283 - DNA, 25 bp, Homo sapien
gactgtcttccctgatataaacatg

SEQ ID NO: 653284 - DNA, 25 bp, Homo sapien
ctgtcttccctgatataaacatgat

SEQ ID NO: 653285 - DNA, 25 bp, Homo sapien
gtcttccctgatataaacatgattt

SEQ ID NO: 653286 - DNA, 25 bp, Homo sapien
ggaaaaattttctcagaaagattct

SEQ ID NO: 653287 - DNA, 25 bp, Homo sapien
tctcagaaagattcttatcaaccaa

SEQ ID NO: 653288 - DNA, 25 bp, Homo sapien
ctcagaaagattcttatcaaccaat

SEQ ID NO: 653289 - DNA, 25 bp, Homo sapien
cagaaagattcttatcaaccaatca

SEQ ID NO: 653290 - DNA, 25 bp, Homo sapien
agaaagattcttatcaaccaatcaa

SEQ ID NO: 653291 - DNA, 25 bp, Homo sapien
gaaagattcttatcaaccaatcaaa

SEQ ID NO: 653292 - DNA, 25 bp, Homo sapien
aaagattcttatcaaccaatcaaat

SEQ ID NO: 653293 - DNA, 25 bp, Homo sapien
ataatcagtcatattagttttctta

SEQ ID NO: 653294 - DNA, 25 bp, Homo sapien
attagttttcttactattgttcata

SEQ ID NO: 653295 - DNA, 25 bp, Homo sapien
tagttttcttactattgttcatatt

SEQ ID NO: 653296 - DNA, 25 bp, Homo sapien
atacttcttaattagatatgcttaa

SEQ ID NO: 653297 - DNA, 25 bp, Homo sapien
gcctgtacataatccagttttccca

SEQ ID NO: 653298 - DNA, 25 bp, Homo sapien
aagactgtcctttactcattgagta

SEQ ID NO: 653299 - DNA, 25 bp, Homo sapien
gagtagtcttggcaaccttgtaaaa

SEQ ID NO: 653300 - DNA, 25 bp, Homo sapien
ttccatacattgtttctgggccctc

SEQ ID NO: 653301 - DNA, 25 bp, Homo sapien
tgggccctctattctgttcccttgg

SEQ ID NO: 653302 - DNA, 25 bp, Homo sapien
gttcccttggtctgtatctttatgt

SEQ ID NO: 653303 - DNA, 25 bp, Homo sapien
tgtgagtaacacactattttgatta

SEQ ID NO: 653304 - DNA, 25 bp, Homo sapien
gagtacaccagcgtttttcttcttt

SEQ ID NO: 653305 - DNA, 25 bp, Homo sapien
ttattttggctgttcagggtccctt

SEQ ID NO: 653306 - DNA, 25 bp, Homo sapien
cagggtcccttgagatttcatgtta

SEQ ID NO: 653307 - DNA, 25 bp, Homo sapien
gatttcatgttagttttaggacgtg

SEQ ID NO: 653308 - DNA, 25 bp, Homo sapien
atgtccgtctccacagagatcagct

SEQ ID NO: 653309 - DNA, 25 bp, Homo sapien
gagatcagcttcttcttgtcaaact

SEQ ID NO: 653310 - DNA, 25 bp, Homo sapien
agcttcttcttgtcaaactcacgaa

SEQ ID NO: 653311 - DNA, 25 bp, Homo sapien
aaactcacgaaggtgcagcagggtg

SEQ ID NO: 653312 - DNA, 25 bp, Homo sapien
gggtgagctcatcaaactgctcaaa

SEQ ID NO: 653313 - DNA, 25 bp, Homo sapien
ggcctccagccaccacagaagaaag

SEQ ID NO: 653314 - DNA, 25 bp, Homo sapien
ggttcctaggcctgcatgacagtta

SEQ ID NO: 653315 - DNA, 25 bp, Homo sapien
taggcctgcatgacagttactacga

SEQ ID NO: 653316 - DNA, 25 bp, Homo sapien
cagttactacgacacctgggtctaa

SEQ ID NO: 653317 - DNA, 25 bp, Homo sapien
tacgacacctgggtctaaggaaggc

SEQ ID NO: 653318 - DNA, 25 bp, Homo sapien
gaaggctctgactgccttcaaggca

SEQ ID NO: 653319 - DNA, 25 bp, Homo sapien
taatgtgtattttctacagacaagt

SEQ ID NO: 653320 - DNA, 25 bp, Homo sapien
cacaatacaatcatttataccagga

SEQ ID NO: 653321 - DNA, 25 bp, Homo sapien
gaaattaacactgatgccatcccca

SEQ ID NO: 653322 - DNA, 25 bp, Homo sapien
gaccccattcaggtttttcctattg

SEQ ID NO: 653323 - DNA, 25 bp, Homo sapien
tcctattgcaccatgaagtccttta

SEQ ID NO: 653324 - DNA, 25 bp, Homo sapien
gcaccatgaagtcctttatagcaaa

SEQ ID NO: 653325 - DNA, 25 bp, Homo sapien
gcaaaagtttccagttcaaaatcac

SEQ ID NO: 653326 - DNA, 25 bp, Homo sapien
gttcaaaatcacactttgcatttaa

SEQ ID NO: 653327 - DNA, 25 bp, Homo sapien
taaagtttcatctccttcaatatgg

SEQ ID NO: 653328 - DNA, 25 bp, Homo sapien
tatggaacagttccttagtccttaa

SEQ ID NO: 653329 - DNA, 25 bp, Homo sapien
tagtccttaaaccttaacaacattg

SEQ ID NO: 653330 - DNA, 25 bp, Homo sapien
aaaagccgggcgctgtggttcacac

SEQ ID NO: 653331 - DNA, 25 bp, Homo sapien
aaagccgggcgctgtggttcacacc

SEQ ID NO: 653332 - DNA, 25 bp, Homo sapien
agccgggcgctgtggttcacaccta

SEQ ID NO: 653333 - DNA, 25 bp, Homo sapien
ggcgctgtggttcacacctataatt

SEQ ID NO: 653334 - DNA, 25 bp, Homo sapien
gcgctgtggttcacacctataattc

SEQ ID NO: 653335 - DNA, 25 bp, Homo sapien
gctgtggttcacacctataattccc

SEQ ID NO: 653336 - DNA, 25 bp, Homo sapien
tataattcccagctttggggaagcc

SEQ ID NO: 653337 - DNA, 25 bp, Homo sapien
ataattcccagctttggggaagccg

SEQ ID NO: 653338 - DNA, 25 bp, Homo sapien
taattcccagctttggggaagccga

SEQ ID NO: 653339 - DNA, 25 bp, Homo sapien
aattcccagctttggggaagccgag

SEQ ID NO: 653340 - DNA, 25 bp, Homo sapien
attcccagctttggggaagccgagg

SEQ ID NO: 653341 - DNA, 25 bp, Homo sapien
tgaagaaggcgcatctggcaaagct

SEQ ID NO: 653342 - DNA, 25 bp, Homo sapien
aggcgcatctggcaaagctgagaaa

SEQ ID NO: 653343 - DNA, 25 bp, Homo sapien
agacgtctggagaaactaagaatca

SEQ ID NO: 653344 - DNA, 25 bp, Homo sapien
gaatcaagtcaatggaacacgggca

SEQ ID NO: 653345 - DNA, 25 bp, Homo sapien
agtcaatggaacacgggcaaacaaa

SEQ ID NO: 653346 - DNA, 25 bp, Homo sapien
ggcaaacaaaagtgacaaccctcgt

SEQ ID NO: 653347 - DNA, 25 bp, Homo sapien
gaagtcatcaggagaacagcaacag

SEQ ID NO: 653348 - DNA, 25 bp, Homo sapien
gagaacagcaacagaatggtgactt

SEQ ID NO: 653349 - DNA, 25 bp, Homo sapien
gaatggtgacttcaaagatggtaaa

SEQ ID NO: 653350 - DNA, 25 bp, Homo sapien
gacagacaagaaggatcactctaac

SEQ ID NO: 653351 - DNA, 25 bp, Homo sapien
gaaggatcactctaacatcggaaat

SEQ ID NO: 653352 - DNA, 25 bp, Homo sapien
taagctgccaggacagtgagagtct

SEQ ID NO: 653353 - DNA, 25 bp, Homo sapien
gctgccaggacagtgagagtctgct

SEQ ID NO: 653354 - DNA, 25 bp, Homo sapien
tgccaggacagtgagagtctgcttt

SEQ ID NO: 653355 - DNA, 25 bp, Homo sapien
gccaggacagtgagagtctgctttg

SEQ ID NO: 653356 - DNA, 25 bp, Homo sapien
aattcatgatagatgctcacaccgc

SEQ ID NO: 653357 - DNA, 25 bp, Homo sapien
ttcatgatagatgctcacaccgcta

SEQ ID NO: 653358 - DNA, 25 bp, Homo sapien
tcatgatagatgctcacaccgctaa

SEQ ID NO: 653359 - DNA, 25 bp, Homo sapien
atgatagatgctcacaccgctaatc

SEQ ID NO: 653360 - DNA, 25 bp, Homo sapien
tgatagatgctcacaccgctaatcc

SEQ ID NO: 653361 - DNA, 25 bp, Homo sapien
atagatgctcacaccgctaatccta

SEQ ID NO: 653362 - DNA, 25 bp, Homo sapien
tagatgctcacaccgctaatcctag

SEQ ID NO: 653363 - DNA, 25 bp, Homo sapien
aaaatgaagtctgcccagagctgct

SEQ ID NO: 653364 - DNA, 25 bp, Homo sapien
tgctgcccatggagtcctctgagga

SEQ ID NO: 653365 - DNA, 25 bp, Homo sapien
gcccatggagtcctctgaggacgac

SEQ ID NO: 653366 - DNA, 25 bp, Homo sapien
tgaggacgactccagagtccctcaa

SEQ ID NO: 653367 - DNA, 25 bp, Homo sapien
gagtccctcaactccttggaggaga

SEQ ID NO: 653368 - DNA, 25 bp, Homo sapien
actccttggaggagataagcagcca

SEQ ID NO: 653369 - DNA, 25 bp, Homo sapien
gagataagcagccaacacagtgttg

SEQ ID NO: 653370 - DNA, 25 bp, Homo sapien
acacagtgttgttcagcagatgcca

SEQ ID NO: 653371 - DNA, 25 bp, Homo sapien
agtgttgttcagcagatgccaccgt

SEQ ID NO: 653372 - DNA, 25 bp, Homo sapien
caccgtctgccatgccctggaattt

SEQ ID NO: 653373 - DNA, 25 bp, Homo sapien
aggcctgctgctaacgtttctgaga

SEQ ID NO: 653374 - DNA, 25 bp, Homo sapien
tcaagcctgagaatccttccggaaa

SEQ ID NO: 653375 - DNA, 25 bp, Homo sapien
catggcctcggtgtgggagcaacat

SEQ ID NO: 653376 - DNA, 25 bp, Homo sapien
tgagtggccatgaccatcgacctgg

SEQ ID NO: 653377 - DNA, 25 bp, Homo sapien
atcgacctggagcaatcagctcagg

SEQ ID NO: 653378 - DNA, 25 bp, Homo sapien
aggtgggagcagcaatcatccagct

SEQ ID NO: 653379 - DNA, 25 bp, Homo sapien
gcagcaatcatccagctccttcaag

SEQ ID NO: 653380 - DNA, 25 bp, Homo sapien
gggtctcttcattccattatggata

SEQ ID NO: 653381 - DNA, 25 bp, Homo sapien
attccattatggatatagcctaaga

SEQ ID NO: 653382 - DNA, 25 bp, Homo sapien
tatagcctaagaaatggtgacagta

SEQ ID NO: 653383 - DNA, 25 bp, Homo sapien
tggtgacagtaaagggtctcataca

SEQ ID NO: 653384 - DNA, 25 bp, Homo sapien
tctcatacaacacgtcccattttta

SEQ ID NO: 653385 - DNA, 25 bp, Homo sapien
gtgtatatattccatccatcagatg

SEQ ID NO: 653386 - DNA, 25 bp, Homo sapien
gttacagtcaacatctgataatttc

SEQ ID NO: 653387 - DNA, 25 bp, Homo sapien
taatttcagtatcttatgtccttga

SEQ ID NO: 653388 - DNA, 25 bp, Homo sapien
tgtccttgaacatctaaattttgct

SEQ ID NO: 653389 - DNA, 25 bp, Homo sapien
aaattttgctagtctctaactgaag

SEQ ID NO: 653390 - DNA, 25 bp, Homo sapien
gctagtctctaactgaagtggcgac

SEQ ID NO: 653391 - DNA, 25 bp, Homo sapien
aagtggcgacaagtgcacttgcctc

SEQ ID NO: 653392 - DNA, 25 bp, Homo sapien
gacaagtgcacttgcctctagtgga

SEQ ID NO: 653393 - DNA, 25 bp, Homo sapien
acttgcctctagtggagttccttct

SEQ ID NO: 653394 - DNA, 25 bp, Homo sapien
ctgttgaattttcttgctgctcact

SEQ ID NO: 653395 - DNA, 25 bp, Homo sapien
gctgctcactgctctagctctaggt

SEQ ID NO: 653396 - DNA, 25 bp, Homo sapien
ttcatggattgctttgcgctcctcc

SEQ ID NO: 653397 - DNA, 25 bp, Homo sapien
aagacagtgagtctccacaggccca

SEQ ID NO: 653398 - DNA, 25 bp, Homo sapien
tctccacaggcccatgaatgtcata

SEQ ID NO: 653399 - DNA, 25 bp, Homo sapien
agcttgaagaagcacctatcctgtg

SEQ ID NO: 653400 - DNA, 25 bp, Homo sapien
agaagcacctatcctgtgctcagga

SEQ ID NO: 653401 - DNA, 25 bp, Homo sapien
gtgctcaggacaaaatatctgtggt

SEQ ID NO: 653402 - DNA, 25 bp, Homo sapien
tgtggtccagagcagagctcccaac

SEQ ID NO: 653403 - DNA, 25 bp, Homo sapien
aacccagctactatgaaccacgcta

SEQ ID NO: 653404 - DNA, 25 bp, Homo sapien
tgaaccacgctaggccccagaaaag

SEQ ID NO: 653405 - DNA, 25 bp, Homo sapien
aacagaagagacattggattggatc

SEQ ID NO: 653406 - DNA, 25 bp, Homo sapien
ggattggatcttccagaaggtcttt

SEQ ID NO: 653407 - DNA, 25 bp, Homo sapien
cactgggaaggagtccatatgtctc

SEQ ID NO: 653408 - DNA, 25 bp, Homo sapien
ccatatgtctcagatttgcccttga

SEQ ID NO: 653409 - DNA, 25 bp, Homo sapien
aagaaatgtgtcctcatttgtacag

SEQ ID NO: 653410 - DNA, 25 bp, Homo sapien
cctcatttgtacagatgtacggaga

SEQ ID NO: 653411 - DNA, 25 bp, Homo sapien
tgtacggagaagaaagctcatcatt

SEQ ID NO: 653412 - DNA, 25 bp, Homo sapien
gaagaaagctcatcattttcaaaaa

SEQ ID NO: 653413 - DNA, 25 bp, Homo sapien
cttctctgtactgaacattatgtgt

SEQ ID NO: 653414 - DNA, 25 bp, Homo sapien
acattatgtgtgtggattacagagt

SEQ ID NO: 653415 - DNA, 25 bp, Homo sapien
ataagagggatgcaacctggcctta

SEQ ID NO: 653416 - DNA, 25 bp, Homo sapien
atgcaacctggccttaataagggag

SEQ ID NO: 653417 - DNA, 25 bp, Homo sapien
gagaggtgttcatggcacacgtata

SEQ ID NO: 653418 - DNA, 25 bp, Homo sapien
agaccgacagcgtgcgggctgccgg

SEQ ID NO: 653419 - DNA, 25 bp, Homo sapien
tgcctgcaagcacctagccgagaag

SEQ ID NO: 653420 - DNA, 25 bp, Homo sapien
ctgcaagcacctagccgagaagaag

SEQ ID NO: 653421 - DNA, 25 bp, Homo sapien
gaagaagacgatgaccaaccccacg

SEQ ID NO: 653422 - DNA, 25 bp, Homo sapien
agaagacgatgaccaaccccacgac

SEQ ID NO: 653423 - DNA, 25 bp, Homo sapien
cgaccgtcatcgaggtctacccgga

SEQ ID NO: 653424 - DNA, 25 bp, Homo sapien
gtcatcgaggtctacccggacacca

SEQ ID NO: 653425 - DNA, 25 bp, Homo sapien
ggtctacccggacaccaccgaggtg

SEQ ID NO: 653426 - DNA, 25 bp, Homo sapien
cggacaccaccgaggtgcgagacaa

SEQ ID NO: 653427 - DNA, 25 bp, Homo sapien
gacaccaccgaggtgcgagacaaga

SEQ ID NO: 653428 - DNA, 25 bp, Homo sapien
catcaccagttctgccctggcagcc

SEQ ID NO: 653429 - DNA, 25 bp, Homo sapien
aaagtataagtgtctaggccgggcg

SEQ ID NO: 653430 - DNA, 25 bp, Homo sapien
aagtataagtgtctaggccgggcgc

SEQ ID NO: 653431 - DNA, 25 bp, Homo sapien
cactttgggacaccgaggcggatag

SEQ ID NO: 653432 - DNA, 25 bp, Homo sapien
actttgggacaccgaggcggataga

SEQ ID NO: 653433 - DNA, 25 bp, Homo sapien
ctttgggacaccgaggcggatagat

SEQ ID NO: 653434 - DNA, 25 bp, Homo sapien
gggacaccgaggcggatagatcacc

SEQ ID NO: 653435 - DNA, 25 bp, Homo sapien
ggacaccgaggcggatagatcacct

SEQ ID NO: 653436 - DNA, 25 bp, Homo sapien
gacaccgaggcggatagatcacctg

SEQ ID NO: 653437 - DNA, 25 bp, Homo sapien
gcttcaaatgttaccaacattggcg

SEQ ID NO: 653438 - DNA, 25 bp, Homo sapien
accaacattggcgaatgcaaccaga

SEQ ID NO: 653439 - DNA, 25 bp, Homo sapien
gcaaccagaggagacataacacata

SEQ ID NO: 653440 - DNA, 25 bp, Homo sapien
agaggagacataacacataaaacat

SEQ ID NO: 653441 - DNA, 25 bp, Homo sapien
gggtttatccacaaggagaattcac

SEQ ID NO: 653442 - DNA, 25 bp, Homo sapien
ggagaattcactatcttgctggtgt

SEQ ID NO: 653443 - DNA, 25 bp, Homo sapien
attcactatcttgctggtgttagga

SEQ ID NO: 653444 - DNA, 25 bp, Homo sapien
atcttgctggtgttaggatctgtcc

SEQ ID NO: 653445 - DNA, 25 bp, Homo sapien
tggtgttaggatctgtccttccagg

SEQ ID NO: 653446 - DNA, 25 bp, Homo sapien
ttaggatctgtccttccagggagga

SEQ ID NO: 653447 - DNA, 25 bp, Homo sapien
ggatctgtccttccagggaggatac

SEQ ID NO: 653448 - DNA, 25 bp, Homo sapien
cctagcacagtttccagcaacattg

SEQ ID NO: 653449 - DNA, 25 bp, Homo sapien
gtttccagcaacattgagtagtcag

SEQ ID NO: 653450 - DNA, 25 bp, Homo sapien
taaactttggtgacacatccattta

SEQ ID NO: 653451 - DNA, 25 bp, Homo sapien
aaaaaccatcttggcttagcacatg

SEQ ID NO: 653452 - DNA, 25 bp, Homo sapien
tcttggcttagcacatgactgaaaa

SEQ ID NO: 653453 - DNA, 25 bp, Homo sapien
aaggcaaccacaacatgtcatgctt

SEQ ID NO: 653454 - DNA, 25 bp, Homo sapien
ggtttactgtttatgacttttctgc

SEQ ID NO: 653455 - DNA, 25 bp, Homo sapien
ttatgacttttctgctagactgtag

SEQ ID NO: 653456 - DNA, 25 bp, Homo sapien
tagactgtagtctccatgaaagcag

SEQ ID NO: 653457 - DNA, 25 bp, Homo sapien
gtttttcttattcaccatggtatcc

SEQ ID NO: 653458 - DNA, 25 bp, Homo sapien
atggtatccccacctagcacagttt

SEQ ID NO: 653459 - DNA, 25 bp, Homo sapien
ttttttggcaactcttaatctgaac

SEQ ID NO: 653460 - DNA, 25 bp, Homo sapien
ttttggcaactcttaatctgaacaa

SEQ ID NO: 653461 - DNA, 25 bp, Homo sapien
taaggctttaagaaggcttgtcatt

SEQ ID NO: 653462 - DNA, 25 bp, Homo sapien
aggctttaagaaggcttgtcatttt

SEQ ID NO: 653463 - DNA, 25 bp, Homo sapien
aggcttgtcattttagggctaaatt

SEQ ID NO: 653464 - DNA, 25 bp, Homo sapien
gcttgtcattttagggctaaatttt

SEQ ID NO: 653465 - DNA, 25 bp, Homo sapien
atagaatgtgagtctgaactcttac

SEQ ID NO: 653466 - DNA, 25 bp, Homo sapien
gaatgtgagtctgaactcttacatt

SEQ ID NO: 653467 - DNA, 25 bp, Homo sapien
gtgagtctgaactcttacatttaga

SEQ ID NO: 653468 - DNA, 25 bp, Homo sapien
ctgctaattgatctagaagctcatt

SEQ ID NO: 653469 - DNA, 25 bp, Homo sapien
gatctagaagctcatttctttctca

SEQ ID NO: 653470 - DNA, 25 bp, Homo sapien
aaattaaattatcctgcaacctcaa

SEQ ID NO: 653471 - DNA, 25 bp, Homo sapien
taaattatcctgcaacctcaatctc

SEQ ID NO: 653472 - DNA, 25 bp, Homo sapien
attatcctgcaacctcaatctcttt

SEQ ID NO: 653473 - DNA, 25 bp, Homo sapien
caatcttaactagtttgtaaactgg

SEQ ID NO: 653474 - DNA, 25 bp, Homo sapien
actggtatctaaaatcttttacatg

SEQ ID NO: 653475 - DNA, 25 bp, Homo sapien
tttacatgtgaaaagcgagcaattt

SEQ ID NO: 653476 - DNA, 25 bp, Homo sapien
tgaatcgctaaggataggcacatct

SEQ ID NO: 653477 - DNA, 25 bp, Homo sapien
atcgctaaggataggcacatctgaa

SEQ ID NO: 653478 - DNA, 25 bp, Homo sapien
aggataggcacatctgaacaggtaa

SEQ ID NO: 653479 - DNA, 25 bp, Homo sapien
tctgaacaggtaaaagtgactacac

SEQ ID NO: 653480 - DNA, 25 bp, Homo sapien
ctacacagatgggatgtcataagat

SEQ ID NO: 653481 - DNA, 25 bp, Homo sapien
gtagcatccactgggaagccctggg

SEQ ID NO: 653482 - DNA, 25 bp, Homo sapien
ggcctcggaggacatggaccatctt

SEQ ID NO: 653483 - DNA, 25 bp, Homo sapien
atggaccatcttcccgggtttggct

SEQ ID NO: 653484 - DNA, 25 bp, Homo sapien
ggtttggctgtgtatcccagtggca

SEQ ID NO: 653485 - DNA, 25 bp, Homo sapien
tgtgtatcccagtggcaccatggag

SEQ ID NO: 653486 - DNA, 25 bp, Homo sapien
gcaccatggagtagccagggccctt

SEQ ID NO: 653487 - DNA, 25 bp, Homo sapien
ttggccaggccactaaactacaccg

SEQ ID NO: 653488 - DNA, 25 bp, Homo sapien
ccccttgtcatctgttgcatgcagg

SEQ ID NO: 653489 - DNA, 25 bp, Homo sapien
gcatgcaggcatcagaatttacctt

SEQ ID NO: 653490 - DNA, 25 bp, Homo sapien
gagtcacttagttttcatggcatat

SEQ ID NO: 653491 - DNA, 25 bp, Homo sapien
atgtgcgattattaaaagtttcctt

SEQ ID NO: 653492 - DNA, 25 bp, Homo sapien
tgctacatccactctgttgccacat

SEQ ID NO: 653493 - DNA, 25 bp, Homo sapien
ttgccacatctcctgaattcttctg

SEQ ID NO: 653494 - DNA, 25 bp, Homo sapien
acatctcctgaattcttctgtctga

SEQ ID NO: 653495 - DNA, 25 bp, Homo sapien
ctcctgaattcttctgtctgatttc

SEQ ID NO: 653496 - DNA, 25 bp, Homo sapien
aattcttctgtctgatttcttctca

SEQ ID NO: 653497 - DNA, 25 bp, Homo sapien
ggccgcatgtcaggacaccggatga

SEQ ID NO: 653498 - DNA, 25 bp, Homo sapien
gacaccggatgacactgtttggaca

SEQ ID NO: 653499 - DNA, 25 bp, Homo sapien
gacacctggaaggatcgggtaaaag

SEQ ID NO: 653500 - DNA, 25 bp, Homo sapien
ggctgtggattaggcaccaggtaaa

SEQ ID NO: 653501 - DNA, 25 bp, Homo sapien
taggcaccaggtaaagctaattggg

SEQ ID NO: 653502 - DNA, 25 bp, Homo sapien
ctattgcatctattttatggtaata

SEQ ID NO: 653503 - DNA, 25 bp, Homo sapien
gcctgcccgtgggtgggtggtgcac

SEQ ID NO: 653504 - DNA, 25 bp, Homo sapien
ggcagcctggacaccaggtttggtc

SEQ ID NO: 653505 - DNA, 25 bp, Homo sapien
tggacaccaggtttggtctacctcg

SEQ ID NO: 653506 - DNA, 25 bp, Homo sapien
gacaccaggtttggtctacctcgtc

SEQ ID NO: 653507 - DNA, 25 bp, Homo sapien
caggtttggtctacctcgtccacac

SEQ ID NO: 653508 - DNA, 25 bp, Homo sapien
tgtcccgccttaagcggatccgtga

SEQ ID NO: 653509 - DNA, 25 bp, Homo sapien
ttaagcggatccgtgatgtcccgtc

SEQ ID NO: 653510 - DNA, 25 bp, Homo sapien
aagcggatccgtgatgtcccgtcgt

SEQ ID NO: 653511 - DNA, 25 bp, Homo sapien
ggatccgtgatgtcccgtcgttaga

SEQ ID NO: 653512 - DNA, 25 bp, Homo sapien
tgatgtcccgtcgttagaccttcaa

SEQ ID NO: 653513 - DNA, 25 bp, Homo sapien
tgtcccgtcgttagaccttcaattt

SEQ ID NO: 653514 - DNA, 25 bp, Homo sapien
atgtaagagttcagactcacattct

SEQ ID NO: 653515 - DNA, 25 bp, Homo sapien
gtaagagttcagactcacattctat

SEQ ID NO: 653516 - DNA, 25 bp, Homo sapien
taagagttcagactcacattctatt

SEQ ID NO: 653517 - DNA, 25 bp, Homo sapien
aagagttcagactcacattctatta

SEQ ID NO: 653518 - DNA, 25 bp, Homo sapien
agagttcagactcacattctattaa

SEQ ID NO: 653519 - DNA, 25 bp, Homo sapien
gagttcagactcacattctattaaa

SEQ ID NO: 653520 - DNA, 25 bp, Homo sapien
aatttagccctaaaatgacaagcct

SEQ ID NO: 653521 - DNA, 25 bp, Homo sapien
atttagccctaaaatgacaagcctt

SEQ ID NO: 653522 - DNA, 25 bp, Homo sapien
tttagccctaaaatgacaagccttc

SEQ ID NO: 653523 - DNA, 25 bp, Homo sapien
ttagccctaaaatgacaagccttct

SEQ ID NO: 653524 - DNA, 25 bp, Homo sapien
tagccctaaaatgacaagccttctt

SEQ ID NO: 653525 - DNA, 25 bp, Homo sapien
ctgtatcttttgtttccgcttctgg

SEQ ID NO: 653526 - DNA, 25 bp, Homo sapien
tatcttttgtttccgcttctggaga

SEQ ID NO: 653527 - DNA, 25 bp, Homo sapien
ttgtttccgcttctggagacccttt

SEQ ID NO: 653528 - DNA, 25 bp, Homo sapien
ctggagacccttttgtcccttgctt

SEQ ID NO: 653529 - DNA, 25 bp, Homo sapien
tttgtcccttgctttttgggcctga

SEQ ID NO: 653530 - DNA, 25 bp, Homo sapien
tgctttttgggcctgatcccattgt

SEQ ID NO: 653531 - DNA, 25 bp, Homo sapien
ttttgggcctgatcccattgtcctt

SEQ ID NO: 653532 - DNA, 25 bp, Homo sapien
tgatcccattgtccttcgcagaagt

SEQ ID NO: 653533 - DNA, 25 bp, Homo sapien
tcccattgtccttcgcagaagtgag

SEQ ID NO: 653534 - DNA, 25 bp, Homo sapien
gtccttcgcagaagtgagacacctc

SEQ ID NO: 653535 - DNA, 25 bp, Homo sapien
gagacacctcagcaaaaaaaacgga

SEQ ID NO: 653536 - DNA, 25 bp, Homo sapien
ttatgtaatcttcttcactttttcc

SEQ ID NO: 653537 - DNA, 25 bp, Homo sapien
tatgtaatcttcttcactttttcct

SEQ ID NO: 653538 - DNA, 25 bp, Homo sapien
atgtaatcttcttcactttttcctt

SEQ ID NO: 653539 - DNA, 25 bp, Homo sapien
tgtaatcttcttcactttttccttt

SEQ ID NO: 653540 - DNA, 25 bp, Homo sapien
ttaaaaacctttgtcaggctgggcg

SEQ ID NO: 653541 - DNA, 25 bp, Homo sapien
taaaaacctttgtcaggctgggcgc

SEQ ID NO: 653542 - DNA, 25 bp, Homo sapien
aaaaacctttgtcaggctgggcgcg

SEQ ID NO: 653543 - DNA, 25 bp, Homo sapien
aaaacctttgtcaggctgggcgcgg

SEQ ID NO: 653544 - DNA, 25 bp, Homo sapien
aaacctttgtcaggctgggcgcggt

SEQ ID NO: 653545 - DNA, 25 bp, Homo sapien
agactgagggagagaattgcttcaa

SEQ ID NO: 653546 - DNA, 25 bp, Homo sapien
gactgagggagagaattgcttcaac

SEQ ID NO: 653547 - DNA, 25 bp, Homo sapien
aacaaaagtatgagaaagaccacac

SEQ ID NO: 653548 - DNA, 25 bp, Homo sapien
acaaaagtatgagaaagaccacact

SEQ ID NO: 653549 - DNA, 25 bp, Homo sapien
caaaagtatgagaaagaccacactc

SEQ ID NO: 653550 - DNA, 25 bp, Homo sapien
aaagtatgagaaagaccacactcag

SEQ ID NO: 653551 - DNA, 25 bp, Homo sapien
aagtatgagaaagaccacactcagg

SEQ ID NO: 653552 - DNA, 25 bp, Homo sapien
agtatgagaaagaccacactcaggc

SEQ ID NO: 653553 - DNA, 25 bp, Homo sapien
tcaggccaagcactgtggttcccgc

SEQ ID NO: 653554 - DNA, 25 bp, Homo sapien
caagcactgtggttcccgcctgaaa

SEQ ID NO: 653555 - DNA, 25 bp, Homo sapien
aagcactgtggttcccgcctgaaat

SEQ ID NO: 653556 - DNA, 25 bp, Homo sapien
agcactgtggttcccgcctgaaatc

SEQ ID NO: 653557 - DNA, 25 bp, Homo sapien
gcactgtggttcccgcctgaaatcc

SEQ ID NO: 653558 - DNA, 25 bp, Homo sapien
aaaagcataacaacataaagccttg

SEQ ID NO: 653559 - DNA, 25 bp, Homo sapien
ttgagtctgtgtctggcatagcatc

SEQ ID NO: 653560 - DNA, 25 bp, Homo sapien
gtctgtgtctggcatagcatccata

SEQ ID NO: 653561 - DNA, 25 bp, Homo sapien
gtgtctggcatagcatccatatcta

SEQ ID NO: 653562 - DNA, 25 bp, Homo sapien
ggcatagcatccatatctaactctt

SEQ ID NO: 653563 - DNA, 25 bp, Homo sapien
gcatccatatctaactcttatgaag

SEQ ID NO: 653564 - DNA, 25 bp, Homo sapien
tcttatgaaggatttagagcccggc

SEQ ID NO: 653565 - DNA, 25 bp, Homo sapien
tctctgtaaccatttgttttttgat

SEQ ID NO: 653566 - DNA, 25 bp, Homo sapien
gaattattgcatttgagctccgctc

SEQ ID NO: 653567 - DNA, 25 bp, Homo sapien
gaattttggaaagtcaagccttctc

SEQ ID NO: 653568 - DNA, 25 bp, Homo sapien
ttggaaagtcaagccttctcttggc

SEQ ID NO: 653569 - DNA, 25 bp, Homo sapien
gaaggtttcctgtgactttctttgt

SEQ ID NO: 653570 - DNA, 25 bp, Homo sapien
gtgactttctttgtccaacggaaca

SEQ ID NO: 653571 - DNA, 25 bp, Homo sapien
taacgtagcaccagttaccaccttg

SEQ ID NO: 653572 - DNA, 25 bp, Homo sapien
accttggtcctcaagaggccttcca

SEQ ID NO: 653573 - DNA, 25 bp, Homo sapien
tttagctctcttggaatccttcctt

SEQ ID NO: 653574 - DNA, 25 bp, Homo sapien
ggaacaagtctgcactaaccaatga

SEQ ID NO: 653575 - DNA, 25 bp, Homo sapien
gaggagagccaaggcaccccagtaa

SEQ ID NO: 653576 - DNA, 25 bp, Homo sapien
ggcaccccagtaactgcagaagcag

SEQ ID NO: 653577 - DNA, 25 bp, Homo sapien
gaagcagagctgttgacagatgcat

SEQ ID NO: 653578 - DNA, 25 bp, Homo sapien
agccaagaccagaattgccatgctg

SEQ ID NO: 653579 - DNA, 25 bp, Homo sapien
attgccatgctgagtgcagtctaaa

SEQ ID NO: 653580 - DNA, 25 bp, Homo sapien
atcccaactctaagagaggttgaga

SEQ ID NO: 653581 - DNA, 25 bp, Homo sapien
agaggttgagaacttaatttctggc

SEQ ID NO: 653582 - DNA, 25 bp, Homo sapien
ggcttctaccttgggaaggatcagg

SEQ ID NO: 653583 - DNA, 25 bp, Homo sapien
gaaggatcaggcttataagctggaa

SEQ ID NO: 653584 - DNA, 25 bp, Homo sapien
aaattagccaacatacacaggatat

SEQ ID NO: 653585 - DNA, 25 bp, Homo sapien
cacaggatattcaaagcttctaggc

SEQ ID NO: 653586 - DNA, 25 bp, Homo sapien
gatattcaaagcttctaggcagtca

SEQ ID NO: 653587 - DNA, 25 bp, Homo sapien
aaagcttctaggcagtcaaaatact

SEQ ID NO: 653588 - DNA, 25 bp, Homo sapien
gtaaaacactgtatgtggctttcca

SEQ ID NO: 653589 - DNA, 25 bp, Homo sapien
aacactgtatgtggctttccataaa

SEQ ID NO: 653590 - DNA, 25 bp, Homo sapien
agagtcttgggagacagaacatctc

SEQ ID NO: 653591 - DNA, 25 bp, Homo sapien
gaagttacaagagtttgcagtgcag

SEQ ID NO: 653592 - DNA, 25 bp, Homo sapien
agttacaagagtttgcagtgcaggc

SEQ ID NO: 653593 - DNA, 25 bp, Homo sapien
ttacaagagtttgcagtgcaggcac

SEQ ID NO: 653594 - DNA, 25 bp, Homo sapien
tacaagagtttgcagtgcaggcact

SEQ ID NO: 653595 - DNA, 25 bp, Homo sapien
acaagagtttgcagtgcaggcactg

SEQ ID NO: 653596 - DNA, 25 bp, Homo sapien
aagagtttgcagtgcaggcactgat

SEQ ID NO: 653597 - DNA, 25 bp, Homo sapien
cagtgcaggcactgatgaacttgga

SEQ ID NO: 653598 - DNA, 25 bp, Homo sapien
agtgcaggcactgatgaacttggaa

SEQ ID NO: 653599 - DNA, 25 bp, Homo sapien
tggaagacaagtaaagcaatggatg

SEQ ID NO: 653600 - DNA, 25 bp, Homo sapien
aatatccttgggcccagcaaaagat

SEQ ID NO: 653601 - DNA, 25 bp, Homo sapien
ccagcaaaagataatgaagggaatt

SEQ ID NO: 653602 - DNA, 25 bp, Homo sapien
gggaatttcaatgtagtatcagtgg

SEQ ID NO: 653603 - DNA, 25 bp, Homo sapien
ggcagttggaactgaggcaaagaac

SEQ ID NO: 653604 - DNA, 25 bp, Homo sapien
ggcaaagaactgaggtgtctgtatt

SEQ ID NO: 653605 - DNA, 25 bp, Homo sapien
aagaactgaggtgtctgtattagaa

SEQ ID NO: 653606 - DNA, 25 bp, Homo sapien
gtaaggagggtaacattagcaattt

SEQ ID NO: 653607 - DNA, 25 bp, Homo sapien
ggtttactaattagactgtgggcct

SEQ ID NO: 653608 - DNA, 25 bp, Homo sapien
gactgtgggcctaatgtgaaggtct

SEQ ID NO: 653609 - DNA, 25 bp, Homo sapien
gggcctaatgtgaaggtctgcttat

SEQ ID NO: 653610 - DNA, 25 bp, Homo sapien
gaaggtctgcttatcagttttaatg

SEQ ID NO: 653611 - DNA, 25 bp, Homo sapien
atttccaaccaaccgtcttatgaat

SEQ ID NO: 653612 - DNA, 25 bp, Homo sapien
caaccaaccgtcttatgaataaagt

SEQ ID NO: 653613 - DNA, 25 bp, Homo sapien
agctgataagagaccctttcggcca

SEQ ID NO: 653614 - DNA, 25 bp, Homo sapien
tttcggccaccatgtggctcgaaat

SEQ ID NO: 653615 - DNA, 25 bp, Homo sapien
accatgtggctcgaaatgtggcctt

SEQ ID NO: 653616 - DNA, 25 bp, Homo sapien
tcgaaatgtggccttgactaccttc

SEQ ID NO: 653617 - DNA, 25 bp, Homo sapien
ttgactaccttcctaaagcggcgag

SEQ ID NO: 653618 - DNA, 25 bp, Homo sapien
taccttcctaaagcggcgagaggct

SEQ ID NO: 653619 - DNA, 25 bp, Homo sapien
gaggcgggcattgaactccatactt

SEQ ID NO: 653620 - DNA, 25 bp, Homo sapien
attgaactccatacttgaagactga

SEQ ID NO: 653621 - DNA, 25 bp, Homo sapien
agactgaggctttggatctgggact

SEQ ID NO: 653622 - DNA, 25 bp, Homo sapien
ttcctggtttaaattggagtcagaa

SEQ ID NO: 653623 - DNA, 25 bp, Homo sapien
tggagtcagaagtcttagtggtaaa

SEQ ID NO: 653624 - DNA, 25 bp, Homo sapien
gcggaggctacaacgagccgaaatt

SEQ ID NO: 653625 - DNA, 25 bp, Homo sapien
ggaggctacaacgagccgaaattgc

SEQ ID NO: 653626 - DNA, 25 bp, Homo sapien
aggctacaacgagccgaaattgcac

SEQ ID NO: 653627 - DNA, 25 bp, Homo sapien
cagcgtatgataaaaacggcatttc

SEQ ID NO: 653628 - DNA, 25 bp, Homo sapien
gcgtatgataaaaacggcatttcag

SEQ ID NO: 653629 - DNA, 25 bp, Homo sapien
gtatgataaaaacggcatttcaggc

SEQ ID NO: 653630 - DNA, 25 bp, Homo sapien
gataaaaacggcatttcaggccagg

SEQ ID NO: 653631 - DNA, 25 bp, Homo sapien
ataaaaacggcatttcaggccaggc

SEQ ID NO: 653632 - DNA, 25 bp, Homo sapien
taaaaacggcatttcaggccaggcg

SEQ ID NO: 653633 - DNA, 25 bp, Homo sapien
aaaaacggcatttcaggccaggcgt

SEQ ID NO: 653634 - DNA, 25 bp, Homo sapien
aaaacggcatttcaggccaggcgtg

SEQ ID NO: 653635 - DNA, 25 bp, Homo sapien
tccattttcattttcgagccatcag

SEQ ID NO: 653636 - DNA, 25 bp, Homo sapien
tttcgagccatcagtttatgttcag

SEQ ID NO: 653637 - DNA, 25 bp, Homo sapien
tcagtttatgttcagatgccatctc

SEQ ID NO: 653638 - DNA, 25 bp, Homo sapien
gatgccatctctgtaatcgcacatt

SEQ ID NO: 653639 - DNA, 25 bp, Homo sapien
gccatctctgtaatcgcacatttaa

SEQ ID NO: 653640 - DNA, 25 bp, Homo sapien
aacataactgtagcctcactaatgg

SEQ ID NO: 653641 - DNA, 25 bp, Homo sapien
ctgtagcctcactaatggaaaagta

SEQ ID NO: 653642 - DNA, 25 bp, Homo sapien
gatgaacaatcattcccaatggtgt

SEQ ID NO: 653643 - DNA, 25 bp, Homo sapien
acaatcattcccaatggtgtacaat

SEQ ID NO: 653644 - DNA, 25 bp, Homo sapien
tacaatgtaagggttttagggagca

SEQ ID NO: 653645 - DNA, 25 bp, Homo sapien
ttttagggagcaacagtatttaact

SEQ ID NO: 653646 - DNA, 25 bp, Homo sapien
gatatcacactttagttttccgttt

SEQ ID NO: 653647 - DNA, 25 bp, Homo sapien
taggaagtcgaatgcctcctactcc

SEQ ID NO: 653648 - DNA, 25 bp, Homo sapien
gacaaagccgagctgccttggtccc

SEQ ID NO: 653649 - DNA, 25 bp, Homo sapien
ctgtgggagccattcattttctctc

SEQ ID NO: 653650 - DNA, 25 bp, Homo sapien
attttctctcccgaggcatcaagca

SEQ ID NO: 653651 - DNA, 25 bp, Homo sapien
gcatcaagcattcgtaaatcctccg

SEQ ID NO: 653652 - DNA, 25 bp, Homo sapien
attctcttcatcactctgagtctct

SEQ ID NO: 653653 - DNA, 25 bp, Homo sapien
gagtctctactttaacattactggc

SEQ ID NO: 653654 - DNA, 25 bp, Homo sapien
tttaacattactggccacgactctg

SEQ ID NO: 653655 - DNA, 25 bp, Homo sapien
gactctgtcactcttggagctttgc

SEQ ID NO: 653656 - DNA, 25 bp, Homo sapien
tggcccgatgcaaatgatcccacag

SEQ ID NO: 653657 - DNA, 25 bp, Homo sapien
tactttgtaaaccaccaggaagact

SEQ ID NO: 653658 - DNA, 25 bp, Homo sapien
tttgtaaaccaccaggaagactcca

SEQ ID NO: 653659 - DNA, 25 bp, Homo sapien
ttgtaaaccaccaggaagactccag

SEQ ID NO: 653660 - DNA, 25 bp, Homo sapien
gtaaaccaccaggaagactccagtg

SEQ ID NO: 653661 - DNA, 25 bp, Homo sapien
aaaccaccaggaagactccagtgtt

SEQ ID NO: 653662 - DNA, 25 bp, Homo sapien
accaccaggaagactccagtgtttc

SEQ ID NO: 653663 - DNA, 25 bp, Homo sapien
ttagatgtttgttaattgctcttgg

SEQ ID NO: 653664 - DNA, 25 bp, Homo sapien
tcattaatcccctgtgggtcatcca

SEQ ID NO: 653665 - DNA, 25 bp, Homo sapien
attaatcccctgtgggtcatccagg

SEQ ID NO: 653666 - DNA, 25 bp, Homo sapien
ttaatcccctgtgggtcatccagga

SEQ ID NO: 653667 - DNA, 25 bp, Homo sapien
aatcccctgtgggtcatccaggaaa

SEQ ID NO: 653668 - DNA, 25 bp, Homo sapien
tcaaaattccttttctcggttgcac

SEQ ID NO: 653669 - DNA, 25 bp, Homo sapien
aaattccttttctcggttgcaccag

SEQ ID NO: 653670 - DNA, 25 bp, Homo sapien
ggttgcaccagccacgtctcaaaca

SEQ ID NO: 653671 - DNA, 25 bp, Homo sapien
agccacgtctcaaacactgaacagc

SEQ ID NO: 653672 - DNA, 25 bp, Homo sapien
gtggccactggctactgtattgaac

SEQ ID NO: 653673 - DNA, 25 bp, Homo sapien
aacagcagatgcgtaggcattccca

SEQ ID NO: 653674 - DNA, 25 bp, Homo sapien
atgcgtaggcattcccagcactgtg

SEQ ID NO: 653675 - DNA, 25 bp, Homo sapien
ttcccagcactgtggagcgctttat

SEQ ID NO: 653676 - DNA, 25 bp, Homo sapien
tggagcgctttatagcccacatgta

SEQ ID NO: 653677 - DNA, 25 bp, Homo sapien
tttatagcccacatgtacccgttct

SEQ ID NO: 653678 - DNA, 25 bp, Homo sapien
atgtacccgttcttagatgcttggc

SEQ ID NO: 653679 - DNA, 25 bp, Homo sapien
aacacaattccctctcttttactct

SEQ ID NO: 653680 - DNA, 25 bp, Homo sapien
aattccctctcttttactctgagtt

SEQ ID NO: 653681 - DNA, 25 bp, Homo sapien
ctctcttttactctgagttgccctc

SEQ ID NO: 653682 - DNA, 25 bp, Homo sapien
tgagttgccctctgatttaaccctg

SEQ ID NO: 653683 - DNA, 25 bp, Homo sapien
tgccctctgatttaaccctgaatag

SEQ ID NO: 653684 - DNA, 25 bp, Homo sapien
tgatttaaccctgaatagtcccctc

SEQ ID NO: 653685 - DNA, 25 bp, Homo sapien
aaccctgaatagtcccctcattaga

SEQ ID NO: 653686 - DNA, 25 bp, Homo sapien
tgagccatgctctttgtcttttgtc

SEQ ID NO: 653687 - DNA, 25 bp, Homo sapien
tcttttgtcaaacaatctctcccac

SEQ ID NO: 653688 - DNA, 25 bp, Homo sapien
tctctcccactcacagtagtatgta

SEQ ID NO: 653689 - DNA, 25 bp, Homo sapien
tcccactcacagtagtatgtattgc

SEQ ID NO: 653690 - DNA, 25 bp, Homo sapien
ggtgcctgctcctctgtctgtgcag

SEQ ID NO: 653691 - DNA, 25 bp, Homo sapien
ctgtctgtgcagtgcgcctgagtgg

SEQ ID NO: 653692 - DNA, 25 bp, Homo sapien
ttgggctcagcatggaacccggtca

SEQ ID NO: 653693 - DNA, 25 bp, Homo sapien
catggaacccggtcagcctgtgtta

SEQ ID NO: 653694 - DNA, 25 bp, Homo sapien
tggaacccggtcagcctgtgttagg

SEQ ID NO: 653695 - DNA, 25 bp, Homo sapien
atgaatgccggtggaggctccagga

SEQ ID NO: 653696 - DNA, 25 bp, Homo sapien
tggcgtgcctgtgccattgcaagga

SEQ ID NO: 653697 - DNA, 25 bp, Homo sapien
cgtgcctgtgccattgcaaggatgg

SEQ ID NO: 653698 - DNA, 25 bp, Homo sapien
gctggcccttgggtccggaggataa

SEQ ID NO: 653699 - DNA, 25 bp, Homo sapien
tgggtccggaggataagaaacacgt

SEQ ID NO: 653700 - DNA, 25 bp, Homo sapien
accagtcctgtgcccagctaagctg

SEQ ID NO: 653701 - DNA, 25 bp, Homo sapien
ctacagtatttcatgtgagcacaaa

SEQ ID NO: 653702 - DNA, 25 bp, Homo sapien
gcacaaagaacaagccaagactcat

SEQ ID NO: 653703 - DNA, 25 bp, Homo sapien
atgtcttttgaatgcctgtcataac

SEQ ID NO: 653704 - DNA, 25 bp, Homo sapien
tgtcataaccaggaacagagccagg

SEQ ID NO: 653705 - DNA, 25 bp, Homo sapien
acagagccaggtacgtgatgaacaa

SEQ ID NO: 653706 - DNA, 25 bp, Homo sapien
gtgatgaacaaataggctggtccct

SEQ ID NO: 653707 - DNA, 25 bp, Homo sapien
aaataggctggtccctgccctgatg

SEQ ID NO: 653708 - DNA, 25 bp, Homo sapien
aaagttataggctagtgtggtcaca

SEQ ID NO: 653709 - DNA, 25 bp, Homo sapien
tgtggtcacagactatgaacgaata

SEQ ID NO: 653710 - DNA, 25 bp, Homo sapien
atatagacaagtcatcatccctcat

SEQ ID NO: 653711 - DNA, 25 bp, Homo sapien
catcatccctcatcaattattttga

SEQ ID NO: 653712 - DNA, 25 bp, Homo sapien
aaataatggtagggctgggcacggt

SEQ ID NO: 653713 - DNA, 25 bp, Homo sapien
aataatggtagggctgggcacggtg

SEQ ID NO: 653714 - DNA, 25 bp, Homo sapien
ataatggtagggctgggcacggtgg

SEQ ID NO: 653715 - DNA, 25 bp, Homo sapien
gagggtgaggcagaaggatcacctg

SEQ ID NO: 653716 - DNA, 25 bp, Homo sapien
agggtgaggcagaaggatcacctga

SEQ ID NO: 653717 - DNA, 25 bp, Homo sapien
gcaggagaatcacctgaacctgcga

SEQ ID NO: 653718 - DNA, 25 bp, Homo sapien
caggagaatcacctgaacctgcgag

SEQ ID NO: 653719 - DNA, 25 bp, Homo sapien
aggagaatcacctgaacctgcgagg

SEQ ID NO: 653720 - DNA, 25 bp, Homo sapien
actgcactccagtctcaccactgca

SEQ ID NO: 653721 - DNA, 25 bp, Homo sapien
ctgcactccagtctcaccactgcac

SEQ ID NO: 653722 - DNA, 25 bp, Homo sapien
tgcactccagtctcaccactgcact

SEQ ID NO: 653723 - DNA, 25 bp, Homo sapien
ggacctcagggcaaacttcagctaa

SEQ ID NO: 653724 - DNA, 25 bp, Homo sapien
ctaatagtaagaagctgggaccctt

SEQ ID NO: 653725 - DNA, 25 bp, Homo sapien
ccttagtactacagccatcgggaaa

SEQ ID NO: 653726 - DNA, 25 bp, Homo sapien
gaaatgcattgtgccaccatctgaa

SEQ ID NO: 653727 - DNA, 25 bp, Homo sapien
tgtgccaccatctgaatggactaag

SEQ ID NO: 653728 - DNA, 25 bp, Homo sapien
gagggatcttctctagttaagacca

SEQ ID NO: 653729 - DNA, 25 bp, Homo sapien
aagaccagatggacacggcttggct

SEQ ID NO: 653730 - DNA, 25 bp, Homo sapien
ggcttggctggcaacctgatttcag

SEQ ID NO: 653731 - DNA, 25 bp, Homo sapien
ctgagcagagttcccagcttggccc

SEQ ID NO: 653732 - DNA, 25 bp, Homo sapien
ctccttaacttcagaaccacgcaaa

SEQ ID NO: 653733 - DNA, 25 bp, Homo sapien
gtgtttttcaacctgctaagtttgc

SEQ ID NO: 653734 - DNA, 25 bp, Homo sapien
aaggctggcgtttgaagcctctgcc

SEQ ID NO: 653735 - DNA, 25 bp, Homo sapien
tctgcctgagttcaagccccttgct

SEQ ID NO: 653736 - DNA, 25 bp, Homo sapien
ttgcttccggtgttcctgtccaagc

SEQ ID NO: 653737 - DNA, 25 bp, Homo sapien
aagcccgcggactggaatctcccaa

SEQ ID NO: 653738 - DNA, 25 bp, Homo sapien
ggaatctcccaaggaagttacgaat

SEQ ID NO: 653739 - DNA, 25 bp, Homo sapien
gcagccttcacctggctaacagaag

SEQ ID NO: 653740 - DNA, 25 bp, Homo sapien
aacagaagaggactcaggacgccca

SEQ ID NO: 653741 - DNA, 25 bp, Homo sapien
accctggataggacccaacagcgct

SEQ ID NO: 653742 - DNA, 25 bp, Homo sapien
gacccaacagcgctccctggaggtg

SEQ ID NO: 653743 - DNA, 25 bp, Homo sapien
aaagttttgtctagcttggcctcca

SEQ ID NO: 653744 - DNA, 25 bp, Homo sapien
aggccctccaggcaatgcactggga

SEQ ID NO: 653745 - DNA, 25 bp, Homo sapien
gaggaaggtcctgcccagcagagat

SEQ ID NO: 653746 - DNA, 25 bp, Homo sapien
ccagcagagattgctttcctactga

SEQ ID NO: 653747 - DNA, 25 bp, Homo sapien
cttgaaatactggttggactggctg

SEQ ID NO: 653748 - DNA, 25 bp, Homo sapien
ggactggctgtatcactgagacctt

SEQ ID NO: 653749 - DNA, 25 bp, Homo sapien
accttcagactgaatttctctcacc

SEQ ID NO: 653750 - DNA, 25 bp, Homo sapien
acccctggacactgagattggctct

SEQ ID NO: 653751 - DNA, 25 bp, Homo sapien
ttgtctatccagcagtagcctacac

SEQ ID NO: 653752 - DNA, 25 bp, Homo sapien
ttgagctcagctgaatatgacggtg

SEQ ID NO: 653753 - DNA, 25 bp, Homo sapien
atatgacggtgaactgagatccctg

SEQ ID NO: 653754 - DNA, 25 bp, Homo sapien
cagcttgtcagcatgtgatgggaga

SEQ ID NO: 653755 - DNA, 25 bp, Homo sapien
acagggtatgcatgccatcctaaaa

SEQ ID NO: 653756 - DNA, 25 bp, Homo sapien
ggagaaatacacttgaggaaggaga

SEQ ID NO: 653757 - DNA, 25 bp, Homo sapien
gagaaatacacttgaggaaggagag

SEQ ID NO: 653758 - DNA, 25 bp, Homo sapien
agaaatacacttgaggaaggagagt

SEQ ID NO: 653759 - DNA, 25 bp, Homo sapien
gaaatacacttgaggaaggagagtg

SEQ ID NO: 653760 - DNA, 25 bp, Homo sapien
gaaaggaggatctcagggaagtcta

SEQ ID NO: 653761 - DNA, 25 bp, Homo sapien
aaaggaggatctcagggaagtctag

SEQ ID NO: 653762 - DNA, 25 bp, Homo sapien
aaggaggatctcagggaagtctagg

SEQ ID NO: 653763 - DNA, 25 bp, Homo sapien
aggaggatctcagggaagtctagga

SEQ ID NO: 653764 - DNA, 25 bp, Homo sapien
gaggatctcagggaagtctaggagg

SEQ ID NO: 653765 - DNA, 25 bp, Homo sapien
aggatctcagggaagtctaggagga

SEQ ID NO: 653766 - DNA, 25 bp, Homo sapien
ggatctcagggaagtctaggaggaa

SEQ ID NO: 653767 - DNA, 25 bp, Homo sapien
acgaggtgggccataccggagtcac

SEQ ID NO: 653768 - DNA, 25 bp, Homo sapien
gaaacagatgactaggcggtttagt

SEQ ID NO: 653769 - DNA, 25 bp, Homo sapien
gatgactaggcggtttagtgctgat

SEQ ID NO: 653770 - DNA, 25 bp, Homo sapien
ctaggcggtttagtgctgatgaaca

SEQ ID NO: 653771 - DNA, 25 bp, Homo sapien
aggcggtttagtgctgatgaacagt

SEQ ID NO: 653772 - DNA, 25 bp, Homo sapien
gtttagtgctgatgaacagttcttt

SEQ ID NO: 653773 - DNA, 25 bp, Homo sapien
caggccgcgtccagcagtgcgcatt

SEQ ID NO: 653774 - DNA, 25 bp, Homo sapien
agtgcgcattcctccaagtctgcga

SEQ ID NO: 653775 - DNA, 25 bp, Homo sapien
gcgcattcctccaagtctgcgaggt

SEQ ID NO: 653776 - DNA, 25 bp, Homo sapien
attcctccaagtctgcgaggtccag

SEQ ID NO: 653777 - DNA, 25 bp, Homo sapien
cggcagggccagtggctgcgcagga

SEQ ID NO: 653778 - DNA, 25 bp, Homo sapien
aaggaatatccattctggttgattc

SEQ ID NO: 653779 - DNA, 25 bp, Homo sapien
atccattctggttgattctattcaa

SEQ ID NO: 653780 - DNA, 25 bp, Homo sapien
tcaacattatactggaggctctagc

SEQ ID NO: 653781 - DNA, 25 bp, Homo sapien
gaaaaatgccaatctaggatctatt

SEQ ID NO: 653782 - DNA, 25 bp, Homo sapien
atctaggatctattgtcccttgaca

SEQ ID NO: 653783 - DNA, 25 bp, Homo sapien
gatctattgtcccttgacattctaa

SEQ ID NO: 653784 - DNA, 25 bp, Homo sapien
gaaattttatcacttttgctgctat

SEQ ID NO: 653785 - DNA, 25 bp, Homo sapien
tttgctgctatagaagaatggctgc

SEQ ID NO: 653786 - DNA, 25 bp, Homo sapien
tagaagaatggctgcattttcaagt

SEQ ID NO: 653787 - DNA, 25 bp, Homo sapien
ctgcattttcaagttcacaaaggaa

SEQ ID NO: 653788 - DNA, 25 bp, Homo sapien
ttcacaaaggaacactgctagtaat

SEQ ID NO: 653789 - DNA, 25 bp, Homo sapien
ctgcattgctgcgtgaccttgacag

SEQ ID NO: 653790 - DNA, 25 bp, Homo sapien
tgcgtgaccttgacagctactcctt

SEQ ID NO: 653791 - DNA, 25 bp, Homo sapien
acacctgaacgtcctcatctggaaa

SEQ ID NO: 653792 - DNA, 25 bp, Homo sapien
atctggaaactggacttgcctccta

SEQ ID NO: 653793 - DNA, 25 bp, Homo sapien
gcctcctagggttcctgcaaatata

SEQ ID NO: 653794 - DNA, 25 bp, Homo sapien
aaatgagctaatgcctttgaggtgt

SEQ ID NO: 653795 - DNA, 25 bp, Homo sapien
gaggtgtttgctattgtcctggcac

SEQ ID NO: 653796 - DNA, 25 bp, Homo sapien
cctggcacttggcaaacacatgata

SEQ ID NO: 653797 - DNA, 25 bp, Homo sapien
ctctccagggctgagcagcagtgaa

SEQ ID NO: 653798 - DNA, 25 bp, Homo sapien
cagtgaagagctttctgcataagag

SEQ ID NO: 653799 - DNA, 25 bp, Homo sapien
ataaataaacccacatcttcctctg

SEQ ID NO: 653800 - DNA, 25 bp, Homo sapien
gcttaagcatgattatcagaaagta

SEQ ID NO: 653801 - DNA, 25 bp, Homo sapien
aaagtatagcagtctgttttcacac

SEQ ID NO: 653802 - DNA, 25 bp, Homo sapien
atcatggcagaagggcaggtccgac

SEQ ID NO: 653803 - DNA, 25 bp, Homo sapien
ggcagaagggcaggtccgacttaca

SEQ ID NO: 653804 - DNA, 25 bp, Homo sapien
aagggcaggtccgacttacatggtg

SEQ ID NO: 653805 - DNA, 25 bp, Homo sapien
aggtccgacttacatggtggccgca

SEQ ID NO: 653806 - DNA, 25 bp, Homo sapien
tccgacttacatggtggccgcacag

SEQ ID NO: 653807 - DNA, 25 bp, Homo sapien
gacttacatggtggccgcacagaga

SEQ ID NO: 653808 - DNA, 25 bp, Homo sapien
ccgcacagagagtgggaacatgtga

SEQ ID NO: 653809 - DNA, 25 bp, Homo sapien
gaacatgtgaaggagcaactgtcaa

SEQ ID NO: 653810 - DNA, 25 bp, Homo sapien
gaaggagcaactgtcaaacatgtat

SEQ ID NO: 653811 - DNA, 25 bp, Homo sapien
ctctgcctggttgtaaagtatgagc

SEQ ID NO: 653812 - DNA, 25 bp, Homo sapien
gcctggttgtaaagtatgagcacct

SEQ ID NO: 653813 - DNA, 25 bp, Homo sapien
gttgtaaagtatgagcacctattgg

SEQ ID NO: 653814 - DNA, 25 bp, Homo sapien
gtaaagtatgagcacctattggtac

SEQ ID NO: 653815 - DNA, 25 bp, Homo sapien
aagtatgagcacctattggtacgtt

SEQ ID NO: 653816 - DNA, 25 bp, Homo sapien
gtatgagcacctattggtacgttta

SEQ ID NO: 653817 - DNA, 25 bp, Homo sapien
atgagcacctattggtacgtttaca

SEQ ID NO: 653818 - DNA, 25 bp, Homo sapien
gagcacctattggtacgtttacatt

SEQ ID NO: 653819 - DNA, 25 bp, Homo sapien
gcacctattggtacgtttacattcg

SEQ ID NO: 653820 - DNA, 25 bp, Homo sapien
cacctattggtacgtttacattcgt

SEQ ID NO: 653821 - DNA, 25 bp, Homo sapien
tattggtacgtttacattcgtactt

SEQ ID NO: 653822 - DNA, 25 bp, Homo sapien
agttacaagagtttgcagtgcaggc

SEQ ID NO: 653823 - DNA, 25 bp, Homo sapien
agtgcaggcactgatgaacttggaa

SEQ ID NO: 653824 - DNA, 25 bp, Homo sapien
aaagtataagtgtctaggccgggcg

SEQ ID NO: 653825 - DNA, 25 bp, Homo sapien
aagtataagtgtctaggccgggcgc

SEQ ID NO: 653826 - DNA, 25 bp, Homo sapien
agtataagtgtctaggccgggcgcg

SEQ ID NO: 653827 - DNA, 25 bp, Homo sapien
gtataagtgtctaggccgggcgcgg

SEQ ID NO: 653828 - DNA, 25 bp, Homo sapien
ctttgggacaccgaggcggatagat

SEQ ID NO: 653829 - DNA, 25 bp, Homo sapien
tttgggacaccgaggcggatagatc

SEQ ID NO: 653830 - DNA, 25 bp, Homo sapien
ttgggacaccgaggcggatagatca

SEQ ID NO: 653831 - DNA, 25 bp, Homo sapien
gacaccgaggcggatagatcacctg

SEQ ID NO: 653832 - DNA, 25 bp, Homo sapien
cggatagatcacctgagttcgggag

SEQ ID NO: 653833 - DNA, 25 bp, Homo sapien
ctctttctcttactcacattttgga

SEQ ID NO: 653834 - DNA, 25 bp, Homo sapien
ttactcacattttggacctcagcac

SEQ ID NO: 653835 - DNA, 25 bp, Homo sapien
acattttggacctcagcacagactc

SEQ ID NO: 653836 - DNA, 25 bp, Homo sapien
tcttgaagagacttaagggtttcct

SEQ ID NO: 653837 - DNA, 25 bp, Homo sapien
aagatgatcagggacacctagtgat

SEQ ID NO: 653838 - DNA, 25 bp, Homo sapien
ggacacctagtgatataagctgtta

SEQ ID NO: 653839 - DNA, 25 bp, Homo sapien
atataagctgttaaggtgaccttcc

SEQ ID NO: 653840 - DNA, 25 bp, Homo sapien
ttaaggtgaccttcctaagttgcac

SEQ ID NO: 653841 - DNA, 25 bp, Homo sapien
tgaccttcctaagttgcaccagctg

SEQ ID NO: 653842 - DNA, 25 bp, Homo sapien
ccagctgctaatgtccaagggacat

SEQ ID NO: 653843 - DNA, 25 bp, Homo sapien
gtccaagggacatttacattgcata

SEQ ID NO: 653844 - DNA, 25 bp, Homo sapien
taatataacctaggccatgcccctt

SEQ ID NO: 653845 - DNA, 25 bp, Homo sapien
agaggtctcagaatcagccctgctg

SEQ ID NO: 653846 - DNA, 25 bp, Homo sapien
tgtgctcctcctacagacttctagg

SEQ ID NO: 653847 - DNA, 25 bp, Homo sapien
cagacttctaggtaccataacccct

SEQ ID NO: 653848 - DNA, 25 bp, Homo sapien
cataacccctcctattccattttgt

SEQ ID NO: 653849 - DNA, 25 bp, Homo sapien
tcctattccattttgttaccccagc

SEQ ID NO: 653850 - DNA, 25 bp, Homo sapien
aggtgtggtcaccacttcctgccat

SEQ ID NO: 653851 - DNA, 25 bp, Homo sapien
gccatttttggctaccttagcgtcc

SEQ ID NO: 653852 - DNA, 25 bp, Homo sapien
gctaccttagcgtcccacttttgca

SEQ ID NO: 653853 - DNA, 25 bp, Homo sapien
actgacagcctttcatcactgtgta

SEQ ID NO: 653854 - DNA, 25 bp, Homo sapien
ttcatcactgtgtaatggattccct

SEQ ID NO: 653855 - DNA, 25 bp, Homo sapien
aacaaggcttcccagaacaggacca

SEQ ID NO: 653856 - DNA, 25 bp, Homo sapien
gaacaggaccagagcactgcagagc

SEQ ID NO: 653857 - DNA, 25 bp, Homo sapien
aggaccagagcactgcagagccaca

SEQ ID NO: 653858 - DNA, 25 bp, Homo sapien
gccacagctcaccagaatgcaagga

SEQ ID NO: 653859 - DNA, 25 bp, Homo sapien
cagctcaccagaatgcaaggaggag

SEQ ID NO: 653860 - DNA, 25 bp, Homo sapien
tctcccctgagctagaatacattcc

SEQ ID NO: 653861 - DNA, 25 bp, Homo sapien
ggcaagaaccccatgaaagccgtgg

SEQ ID NO: 653862 - DNA, 25 bp, Homo sapien
tcccctgtggtatcctcttcttcgt

SEQ ID NO: 653863 - DNA, 25 bp, Homo sapien
aggaccgattgaagcagatgaaagc

SEQ ID NO: 653864 - DNA, 25 bp, Homo sapien
ccgattgaagcagatgaaagctcgt

SEQ ID NO: 653865 - DNA, 25 bp, Homo sapien
ggatcctctctggagccacagctaa

SEQ ID NO: 653866 - DNA, 25 bp, Homo sapien
gtgatacatcttccatcttcttgct

SEQ ID NO: 653867 - DNA, 25 bp, Homo sapien
ccatcttcttgctgacttcttgctg

SEQ ID NO: 653868 - DNA, 25 bp, Homo sapien
gatgctgttggacaagtcacccagg

SEQ ID NO: 653869 - DNA, 25 bp, Homo sapien
aagtcacccaggactcaggtgctga

SEQ ID NO: 653870 - DNA, 25 bp, Homo sapien
actcaggtgctgaactgatactcat

SEQ ID NO: 653871 - DNA, 25 bp, Homo sapien
gatactcatctacagacaaaggaag

SEQ ID NO: 653872 - DNA, 25 bp, Homo sapien
ggtcatacttgaattttaacagtga

SEQ ID NO: 653873 - DNA, 25 bp, Homo sapien
gaaaaagtagtttgcctcccatggt

SEQ ID NO: 653874 - DNA, 25 bp, Homo sapien
tagtttgcctcccatggttgctctg

SEQ ID NO: 653875 - DNA, 25 bp, Homo sapien
ggttgctctgctcatgtattattag

SEQ ID NO: 653876 - DNA, 25 bp, Homo sapien
tgctcatgtattattagcttctaca

SEQ ID NO: 653877 - DNA, 25 bp, Homo sapien
gtgtcacagaaactagaacccctct

SEQ ID NO: 653878 - DNA, 25 bp, Homo sapien
gaagccgtgaaacctagaaaggtca

SEQ ID NO: 653879 - DNA, 25 bp, Homo sapien
cctagaaaggtcactctctgccttc

SEQ ID NO: 653880 - DNA, 25 bp, Homo sapien
ccctgccccatattcaggagggtta

SEQ ID NO: 653881 - DNA, 25 bp, Homo sapien
ttcaggagggttacacaaagaggtt

SEQ ID NO: 653882 - DNA, 25 bp, Homo sapien
aggccttgctgggttccctgctcag

SEQ ID NO: 653883 - DNA, 25 bp, Homo sapien
tccctgctcagtctatcagcattag

SEQ ID NO: 653884 - DNA, 25 bp, Homo sapien
tcagcattagatcacaccctttagt

SEQ ID NO: 653885 - DNA, 25 bp, Homo sapien
ttagatcacaccctttagtccatca

SEQ ID NO: 653886 - DNA, 25 bp, Homo sapien
tttagtccatcacatttctacaccg

SEQ ID NO: 653887 - DNA, 25 bp, Homo sapien
tcctctttcccaaggtgtgtcacag

SEQ ID NO: 653888 - DNA, 25 bp, Homo sapien
agcctggacctatctttcagagcca

SEQ ID NO: 653889 - DNA, 25 bp, Homo sapien
ggacctatctttcagagccataatg

SEQ ID NO: 653890 - DNA, 25 bp, Homo sapien
atctttcagagccataatgctgaga

SEQ ID NO: 653891 - DNA, 25 bp, Homo sapien
aatgctgagacagtccctgagtctt

SEQ ID NO: 653892 - DNA, 25 bp, Homo sapien
gacagtccctgagtcttggatgaac

SEQ ID NO: 653893 - DNA, 25 bp, Homo sapien
gtccctgagtcttggatgaacacag

SEQ ID NO: 653894 - DNA, 25 bp, Homo sapien
gtcttggatgaacacaggactcaca

SEQ ID NO: 653895 - DNA, 25 bp, Homo sapien
acaggactcacagtgtctacaccgg

SEQ ID NO: 653896 - DNA, 25 bp, Homo sapien
tcacagtgtctacaccggacagttt

SEQ ID NO: 653897 - DNA, 25 bp, Homo sapien
gtgtctacaccggacagtttctgtt

SEQ ID NO: 653898 - DNA, 25 bp, Homo sapien
tctacaccggacagtttctgtttgc

SEQ ID NO: 653899 - DNA, 25 bp, Homo sapien
ttctacttaaccacaatacttttgt

SEQ ID NO: 653900 - DNA, 25 bp, Homo sapien
accacaatacttttgtcatacttaa

SEQ ID NO: 653901 - DNA, 25 bp, Homo sapien
gattaacgatatttccctagtgtct

SEQ ID NO: 653902 - DNA, 25 bp, Homo sapien
aacgatatttccctagtgtctaatt

SEQ ID NO: 653903 - DNA, 25 bp, Homo sapien
tatttccctagtgtctaattcccag

SEQ ID NO: 653904 - DNA, 25 bp, Homo sapien
cctagtgtctaattcccaggctaaa

SEQ ID NO: 653905 - DNA, 25 bp, Homo sapien
taattcccaggctaaattcacgttt

SEQ ID NO: 653906 - DNA, 25 bp, Homo sapien
aagtgggacccagttgtgaaccaca

SEQ ID NO: 653907 - DNA, 25 bp, Homo sapien
gggacccagttgtgaaccacatgtt

SEQ ID NO: 653908 - DNA, 25 bp, Homo sapien
atgacccataattctctcaatctag

SEQ ID NO: 653909 - DNA, 25 bp, Homo sapien
aattctctcaatctaggtcagtctc

SEQ ID NO: 653910 - DNA, 25 bp, Homo sapien
atatttcattactctcagctaaagt

SEQ ID NO: 653911 - DNA, 25 bp, Homo sapien
cattactctcagctaaagttctgaa

SEQ ID NO: 653912 - DNA, 25 bp, Homo sapien
ctgaaaagcagaatcatcatgaaat

SEQ ID NO: 653913 - DNA, 25 bp, Homo sapien
tttttagaactgtgagggagtgcga

SEQ ID NO: 653914 - DNA, 25 bp, Homo sapien
aacagtggaagttaaaatgccaggc

SEQ ID NO: 653915 - DNA, 25 bp, Homo sapien
gaaattgagcagcatcacgtcacca

SEQ ID NO: 653916 - DNA, 25 bp, Homo sapien
agcatcacgtcaccacgacttgtgg

SEQ ID NO: 653917 - DNA, 25 bp, Homo sapien
acgacttgtggtccagctgtttatt

SEQ ID NO: 653918 - DNA, 25 bp, Homo sapien
gtggtccagctgtttattgcaaaga

SEQ ID NO: 653919 - DNA, 25 bp, Homo sapien
ctgtttattgcaaagactccatcct

SEQ ID NO: 653920 - DNA, 25 bp, Homo sapien
gcgttactcatcagaaaatagttaa

SEQ ID NO: 653921 - DNA, 25 bp, Homo sapien
cttctatcagcttgatttcagaatt

SEQ ID NO: 653922 - DNA, 25 bp, Homo sapien
tgatttcagaattcctgcctccaga

SEQ ID NO: 653923 - DNA, 25 bp, Homo sapien
actgcgagacaaaaaagctctgttg

SEQ ID NO: 653924 - DNA, 25 bp, Homo sapien
ttatggcagcccttggaaattaaca

SEQ ID NO: 653925 - DNA, 25 bp, Homo sapien
taatagcaacagcatctcatttact

SEQ ID NO: 653926 - DNA, 25 bp, Homo sapien
agcatctcatttactgttttctatg

SEQ ID NO: 653927 - DNA, 25 bp, Homo sapien
tcatttactgttttctatgtgttaa

SEQ ID NO: 653928 - DNA, 25 bp, Homo sapien
acaattccaagtgctttacacatat

SEQ ID NO: 653929 - DNA, 25 bp, Homo sapien
aagtgctttacacatattatgggct

SEQ ID NO: 653930 - DNA, 25 bp, Homo sapien
catattatgggctttagggtctcat

SEQ ID NO: 653931 - DNA, 25 bp, Homo sapien
gggctttagggtctcattttacaga

SEQ ID NO: 653932 - DNA, 25 bp, Homo sapien
ataattgttactttacacgtgtttg

SEQ ID NO: 653933 - DNA, 25 bp, Homo sapien
ctttacacgtgtttgaaatcagaat

SEQ ID NO: 653934 - DNA, 25 bp, Homo sapien
aagttagacatgttgttcttgcata

SEQ ID NO: 653935 - DNA, 25 bp, Homo sapien
gacatgttgttcttgcataaacaag

SEQ ID NO: 653936 - DNA, 25 bp, Homo sapien
taagagcatgtactgagcacctgct

SEQ ID NO: 653937 - DNA, 25 bp, Homo sapien
ctgtgtgctagacatgttgtagata

SEQ ID NO: 653938 - DNA, 25 bp, Homo sapien
aatgcggatatcaacatggcaggca

SEQ ID NO: 653939 - DNA, 25 bp, Homo sapien
ataacctgccctcaagaatttccat

SEQ ID NO: 653940 - DNA, 25 bp, Homo sapien
gaatttccattctagagcgagtaga

SEQ ID NO: 653941 - DNA, 25 bp, Homo sapien
gagcgagtagacagatgatatctca

SEQ ID NO: 653942 - DNA, 25 bp, Homo sapien
gatatctcagatagtgccagggcct

SEQ ID NO: 653943 - DNA, 25 bp, Homo sapien
gcggaggctacaacgagccgaaatt

SEQ ID NO: 653944 - DNA, 25 bp, Homo sapien
ggaggctacaacgagccgaaattgc

SEQ ID NO: 653945 - DNA, 25 bp, Homo sapien
gaggctacaacgagccgaaattgca

SEQ ID NO: 653946 - DNA, 25 bp, Homo sapien
aggctacaacgagccgaaattgcac

SEQ ID NO: 653947 - DNA, 25 bp, Homo sapien
cagcgtatgataaaaacggcatttc

SEQ ID NO: 653948 - DNA, 25 bp, Homo sapien
gcgtatgataaaaacggcatttcag

SEQ ID NO: 653949 - DNA, 25 bp, Homo sapien
gtatgataaaaacggcatttcaggc

SEQ ID NO: 653950 - DNA, 25 bp, Homo sapien
gataaaaacggcatttcaggccagg

SEQ ID NO: 653951 - DNA, 25 bp, Homo sapien
ataaaaacggcatttcaggccaggc

SEQ ID NO: 653952 - DNA, 25 bp, Homo sapien
taaaaacggcatttcaggccaggcg

SEQ ID NO: 653953 - DNA, 25 bp, Homo sapien
aaaaacggcatttcaggccaggcgt

SEQ ID NO: 653954 - DNA, 25 bp, Homo sapien
gaatccagatcacttgttgctgtct

SEQ ID NO: 653955 - DNA, 25 bp, Homo sapien
atccagatcacttgttgctgtctta

SEQ ID NO: 653956 - DNA, 25 bp, Homo sapien
ccagatcacttgttgctgtcttaat

SEQ ID NO: 653957 - DNA, 25 bp, Homo sapien
gatcacttgttgctgtcttaatgga

SEQ ID NO: 653958 - DNA, 25 bp, Homo sapien
tcacttgttgctgtcttaatggaat

SEQ ID NO: 653959 - DNA, 25 bp, Homo sapien
cttgttgctgtcttaatggaatggt

SEQ ID NO: 653960 - DNA, 25 bp, Homo sapien
ctgtcttaatggaatggttttctac

SEQ ID NO: 653961 - DNA, 25 bp, Homo sapien
aatggaatggttttctacaggagct

SEQ ID NO: 653962 - DNA, 25 bp, Homo sapien
ggaatggttttctacaggagctgta

SEQ ID NO: 653963 - DNA, 25 bp, Homo sapien
ggttttctacaggagctgtaacata

SEQ ID NO: 653964 - DNA, 25 bp, Homo sapien
tttctacaggagctgtaacatactt

SEQ ID NO: 653965 - DNA, 25 bp, Homo sapien
agtttcaaggttcaagttacgtatg

SEQ ID NO: 653966 - DNA, 25 bp, Homo sapien
gttacgtatgtaaggatggccaagc

SEQ ID NO: 653967 - DNA, 25 bp, Homo sapien
gatggccaagctagttatgataaat

SEQ ID NO: 653968 - DNA, 25 bp, Homo sapien
gataaatgaatcacggcacatgcaa

SEQ ID NO: 653969 - DNA, 25 bp, Homo sapien
tcttgctcacccttatggctctttt

SEQ ID NO: 653970 - DNA, 25 bp, Homo sapien
gaaaataccacgattacctagttgt

SEQ ID NO: 653971 - DNA, 25 bp, Homo sapien
accattgctgtctgacctgttcaat

SEQ ID NO: 653972 - DNA, 25 bp, Homo sapien
tgacctgttcaatcaccacagccag

SEQ ID NO: 653973 - DNA, 25 bp, Homo sapien
agccagtcaacacccaagtgctttt

SEQ ID NO: 653974 - DNA, 25 bp, Homo sapien
gcttttcaacagtcacttaatgctt

SEQ ID NO: 653975 - DNA, 25 bp, Homo sapien
atcagacttagagagttcatcattt

SEQ ID NO: 653976 - DNA, 25 bp, Homo sapien
agtggcacggtggtctcagcagtac

SEQ ID NO: 653977 - DNA, 25 bp, Homo sapien
gtctcagcagtaccgatgtggatac

SEQ ID NO: 653978 - DNA, 25 bp, Homo sapien
tactcaagaacgtgaggctaccgtg

SEQ ID NO: 653979 - DNA, 25 bp, Homo sapien
ggctaccgtggaaatgctttgctta

SEQ ID NO: 653980 - DNA, 25 bp, Homo sapien
aatgctttgcttaaaccacacgttg

SEQ ID NO: 653981 - DNA, 25 bp, Homo sapien
aaccacacgttgagtttccaaggag

SEQ ID NO: 653982 - DNA, 25 bp, Homo sapien
agatccccagggaaagcatctagga

SEQ ID NO: 653983 - DNA, 25 bp, Homo sapien
aagcatctaggaccctgccatgttg

SEQ ID NO: 653984 - DNA, 25 bp, Homo sapien
ccagctctgggaagtcaatcgacgt

SEQ ID NO: 653985 - DNA, 25 bp, Homo sapien
aatcgacgtggaccccttactgtgt

SEQ ID NO: 653986 - DNA, 25 bp, Homo sapien
taactgctaatcagccttctgtaaa

SEQ ID NO: 653987 - DNA, 25 bp, Homo sapien
aatattgaattccagagttagtgcg

SEQ ID NO: 653988 - DNA, 25 bp, Homo sapien
aattccagagttagtgcggaagcaa

SEQ ID NO: 653989 - DNA, 25 bp, Homo sapien
gcggaagcaaagaatgtgtgctttc

SEQ ID NO: 653990 - DNA, 25 bp, Homo sapien
gtgtgctttctgtgagtgattccta

SEQ ID NO: 653991 - DNA, 25 bp, Homo sapien
gctttctgtgagtgattcctaaata

SEQ ID NO: 653992 - DNA, 25 bp, Homo sapien
ttttatattatcctctcccctatca

SEQ ID NO: 653993 - DNA, 25 bp, Homo sapien
cctctcccctatcaacaaattgtta

SEQ ID NO: 653994 - DNA, 25 bp, Homo sapien
aacaaattgttagggacaccatgtc

SEQ ID NO: 653995 - DNA, 25 bp, Homo sapien
gggacaccatgtccgtgttttaaat

SEQ ID NO: 653996 - DNA, 25 bp, Homo sapien
tttaatcctcagtcatgtgtgtcaa

SEQ ID NO: 653997 - DNA, 25 bp, Homo sapien
aatcctcagtcatgtgtgtcaactt

SEQ ID NO: 653998 - DNA, 25 bp, Homo sapien
aaattttgtaggaagctggtagaga

SEQ ID NO: 653999 - DNA, 25 bp, Homo sapien
aattttgtaggaagctggtagagaa

SEQ ID NO: 654000 - DNA, 25 bp, Homo sapien
attttgtaggaagctggtagagaat

SEQ ID NO: 654001 - DNA, 25 bp, Homo sapien
tttgtaggaagctggtagagaattt

SEQ ID NO: 654002 - DNA, 25 bp, Homo sapien
taggaagctggtagagaatttggtt

SEQ ID NO: 654003 - DNA, 25 bp, Homo sapien
ggaagctggtagagaatttggtttt

SEQ ID NO: 654004 - DNA, 25 bp, Homo sapien
gaagctggtagagaatttggtttta

SEQ ID NO: 654005 - DNA, 25 bp, Homo sapien
gaatttggttttaaagaggtctgtg

SEQ ID NO: 654006 - DNA, 25 bp, Homo sapien
taaagaggtctgtgttggccgggca

SEQ ID NO: 654007 - DNA, 25 bp, Homo sapien
aaagaggtctgtgttggccgggcac

SEQ ID NO: 654008 - DNA, 25 bp, Homo sapien
aagaggtctgtgttggccgggcacg

SEQ ID NO: 654009 - DNA, 25 bp, Homo sapien
aagagaggctcgacctgctgtggct

SEQ ID NO: 654010 - DNA, 25 bp, Homo sapien
ctgtggctacctttgaaaatggagg

SEQ ID NO: 654011 - DNA, 25 bp, Homo sapien
tgcctcttcattggagtactgccag

SEQ ID NO: 654012 - DNA, 25 bp, Homo sapien
agaaaacagcccagcaattgcaagg

SEQ ID NO: 654013 - DNA, 25 bp, Homo sapien
acagcccagcaattgcaaggaaatt

SEQ ID NO: 654014 - DNA, 25 bp, Homo sapien
aattttcccaacagtctgaatgagc

SEQ ID NO: 654015 - DNA, 25 bp, Homo sapien
aagaaaatggactctcccctgccac

SEQ ID NO: 654016 - DNA, 25 bp, Homo sapien
acgccctgagttcagccttgtgaga

SEQ ID NO: 654017 - DNA, 25 bp, Homo sapien
cagccttgtgagactctaagcagat

SEQ ID NO: 654018 - DNA, 25 bp, Homo sapien
agactctaagcagatacccactcaa

SEQ ID NO: 654019 - DNA, 25 bp, Homo sapien
ggacgtccaacccataacaattgta

SEQ ID NO: 654020 - DNA, 25 bp, Homo sapien
agaggctcagaacttgtgcccagca

SEQ ID NO: 654021 - DNA, 25 bp, Homo sapien
aggctcagaacttgtgcccagcaaa

SEQ ID NO: 654022 - DNA, 25 bp, Homo sapien
gaacttgtgcccagcaaacatcctg

SEQ ID NO: 654023 - DNA, 25 bp, Homo sapien
aaacatcctgcttccatgcatggac

SEQ ID NO: 654024 - DNA, 25 bp, Homo sapien
atcctgcttccatgcatggactttt

SEQ ID NO: 654025 - DNA, 25 bp, Homo sapien
ttccatgcatggacttttcctccct

SEQ ID NO: 654026 - DNA, 25 bp, Homo sapien
aagactgagttgcttctacatagta

SEQ ID NO: 654027 - DNA, 25 bp, Homo sapien
ttgcttctacatagtacgcactgcc

SEQ ID NO: 654028 - DNA, 25 bp, Homo sapien
ttctacatagtacgcactgcctcgt

SEQ ID NO: 654029 - DNA, 25 bp, Homo sapien
catagtacgcactgcctcgttgctg

SEQ ID NO: 654030 - DNA, 25 bp, Homo sapien
tgacggagccccagcttagtggagg

SEQ ID NO: 654031 - DNA, 25 bp, Homo sapien
ataaatccatgagccagactgagag

SEQ ID NO: 654032 - DNA, 25 bp, Homo sapien
aaatccatgagccagactgagagct

SEQ ID NO: 654033 - DNA, 25 bp, Homo sapien
atgagccagactgagagctcccatt

SEQ ID NO: 654034 - DNA, 25 bp, Homo sapien
gagccagactgagagctcccattct

SEQ ID NO: 654035 - DNA, 25 bp, Homo sapien
agactgagagctcccattctcgtct

SEQ ID NO: 654036 - DNA, 25 bp, Homo sapien
actgagagctcccattctcgtctgg

SEQ ID NO: 654037 - DNA, 25 bp, Homo sapien
tgagagctcccattctcgtctggca

SEQ ID NO: 654038 - DNA, 25 bp, Homo sapien
gagagctcccattctcgtctggcac

SEQ ID NO: 654039 - DNA, 25 bp, Homo sapien
cgtctggcaccctctctcctgattg

SEQ ID NO: 654040 - DNA, 25 bp, Homo sapien
tacatacctacccttccgcgattgg

SEQ ID NO: 654041 - DNA, 25 bp, Homo sapien
acatacctacccttccgcgattggt

SEQ ID NO: 654042 - DNA, 25 bp, Homo sapien
atagattggtagtgcagaagagtgt

SEQ ID NO: 654043 - DNA, 25 bp, Homo sapien
gagtgtaagttcttcataggagctt

SEQ ID NO: 654044 - DNA, 25 bp, Homo sapien
gtaagttcttcataggagctttaga

SEQ ID NO: 654045 - DNA, 25 bp, Homo sapien
gaaatatgtgctaattcagtttttt

SEQ ID NO: 654046 - DNA, 25 bp, Homo sapien
atacttggtaattatgagcttgatt

SEQ ID NO: 654047 - DNA, 25 bp, Homo sapien
ggtaatttgctacttaaagcactaa

SEQ ID NO: 654048 - DNA, 25 bp, Homo sapien
aaagcactaagtctctgatacctga

SEQ ID NO: 654049 - DNA, 25 bp, Homo sapien
gcactaagtctctgatacctgaaaa

SEQ ID NO: 654050 - DNA, 25 bp, Homo sapien
gtctctgatacctgaaaagtacatg

SEQ ID NO: 654051 - DNA, 25 bp, Homo sapien
gatggtgaaataatactgcagttaa

SEQ ID NO: 654052 - DNA, 25 bp, Homo sapien
actggtgatttttgtatgctggatt

SEQ ID NO: 654053 - DNA, 25 bp, Homo sapien
gaaggtccaagctaattaggaggca

SEQ ID NO: 654054 - DNA, 25 bp, Homo sapien
gtccaagctaattaggaggcagcat

SEQ ID NO: 654055 - DNA, 25 bp, Homo sapien
agctaattaggaggcagcatccggg

SEQ ID NO: 654056 - DNA, 25 bp, Homo sapien
cattagagcgcaggctgctgtcact

SEQ ID NO: 654057 - DNA, 25 bp, Homo sapien
tagagcgcaggctgctgtcactcag

SEQ ID NO: 654058 - DNA, 25 bp, Homo sapien
ggctgctgtcactcagccgggctga

SEQ ID NO: 654059 - DNA, 25 bp, Homo sapien
actcagccgggctgagttcccggga

SEQ ID NO: 654060 - DNA, 25 bp, Homo sapien
tgagttcccgggagaagaggctgga

SEQ ID NO: 654061 - DNA, 25 bp, Homo sapien
ggcaggcggcccctcgacgaggacg

SEQ ID NO: 654062 - DNA, 25 bp, Homo sapien
cctcgacgaggacgccgctgggagc

SEQ ID NO: 654063 - DNA, 25 bp, Homo sapien
ggcaaacattcactcatcctgggct

SEQ ID NO: 654064 - DNA, 25 bp, Homo sapien
gaccccactacttttctctgtttct

SEQ ID NO: 654065 - DNA, 25 bp, Homo sapien
tactttgttgccttttgcctttact

SEQ ID NO: 654066 - DNA, 25 bp, Homo sapien
tgccttttgcctttacttactctaa

SEQ ID NO: 654067 - DNA, 25 bp, Homo sapien
gaaatcttatataatcccacccagc

SEQ ID NO: 654068 - DNA, 25 bp, Homo sapien
agcccagatgttttctctttcatga

SEQ ID NO: 654069 - DNA, 25 bp, Homo sapien
tagtatgtcattttctaatctctgg

SEQ ID NO: 654070 - DNA, 25 bp, Homo sapien
aactactgtgtttgtctttgaaggc

SEQ ID NO: 654071 - DNA, 25 bp, Homo sapien
gtctttgaaggcaaggacaactgtc

SEQ ID NO: 654072 - DNA, 25 bp, Homo sapien
gcaaggacaactgtctttgaatcca

SEQ ID NO: 654073 - DNA, 25 bp, Homo sapien
gtctttgaatccatgtaacatctct

SEQ ID NO: 654074 - DNA, 25 bp, Homo sapien
tgtaacatctctacaatcccttata

SEQ ID NO: 654075 - DNA, 25 bp, Homo sapien
ggtctggagattgttcatgggcaca

SEQ ID NO: 654076 - DNA, 25 bp, Homo sapien
gcacagagtaacaggaatgtcccac

SEQ ID NO: 654077 - DNA, 25 bp, Homo sapien
aggaatgtcccacactcaggtgcag

SEQ ID NO: 654078 - DNA, 25 bp, Homo sapien
tgtcccacactcaggtgcagggtga

SEQ ID NO: 654079 - DNA, 25 bp, Homo sapien
tgttgagcgggctggactcactgac

SEQ ID NO: 654080 - DNA, 25 bp, Homo sapien
tggactcactgactggcacactatc

SEQ ID NO: 654081 - DNA, 25 bp, Homo sapien
ctggcacactatccagaaaaggctt

SEQ ID NO: 654082 - DNA, 25 bp, Homo sapien
gtgcttctcctacacatgagctgtg

SEQ ID NO: 654083 - DNA, 25 bp, Homo sapien
atccccactcctagtccttggatgg

SEQ ID NO: 654084 - DNA, 25 bp, Homo sapien
gggcagatgccattactttccagtc

SEQ ID NO: 654085 - DNA, 25 bp, Homo sapien
tccagtcattaaacgttaggactct

SEQ ID NO: 654086 - DNA, 25 bp, Homo sapien
cttgctgaatcaccacaggcttaat

SEQ ID NO: 654087 - DNA, 25 bp, Homo sapien
ttgctgaatcaccacaggcttaatt

SEQ ID NO: 654088 - DNA, 25 bp, Homo sapien
tgctgaatcaccacaggcttaattt

SEQ ID NO: 654089 - DNA, 25 bp, Homo sapien
gctgaatcaccacaggcttaattta

SEQ ID NO: 654090 - DNA, 25 bp, Homo sapien
tgaatcaccacaggcttaatttatt

SEQ ID NO: 654091 - DNA, 25 bp, Homo sapien
aatcaccacaggcttaatttattta

SEQ ID NO: 654092 - DNA, 25 bp, Homo sapien
tcaccacaggcttaatttatttatt

SEQ ID NO: 654093 - DNA, 25 bp, Homo sapien
gcctatctgcagttgcccttggtcc

SEQ ID NO: 654094 - DNA, 25 bp, Homo sapien
cctatctgcagttgcccttggtcca

SEQ ID NO: 654095 - DNA, 25 bp, Homo sapien
tgcagttgcccttggtccacccttg

SEQ ID NO: 654096 - DNA, 25 bp, Homo sapien
agttgcccttggtccacccttgagc

SEQ ID NO: 654097 - DNA, 25 bp, Homo sapien
cagaacaggaccagagcactgcaga

SEQ ID NO: 654098 - DNA, 25 bp, Homo sapien
acaggaccagagcactgcagagcca

SEQ ID NO: 654099 - DNA, 25 bp, Homo sapien
aggaccagagcactgcagagccaca

SEQ ID NO: 654100 - DNA, 25 bp, Homo sapien
gccacagctcaccagaatgcaagga

SEQ ID NO: 654101 - DNA, 25 bp, Homo sapien
cagctcaccagaatgcaaggaggag

SEQ ID NO: 654102 - DNA, 25 bp, Homo sapien
ctctcccctgagctagaatacattc

SEQ ID NO: 654103 - DNA, 25 bp, Homo sapien
tctcccctgagctagaatacattcc

SEQ ID NO: 654104 - DNA, 25 bp, Homo sapien
tcccctgtggtatcctcttcttcgt

SEQ ID NO: 654105 - DNA, 25 bp, Homo sapien
aggaccgattgaagcagatgaaagc

SEQ ID NO: 654106 - DNA, 25 bp, Homo sapien
ccgattgaagcagatgaaagctcgt

SEQ ID NO: 654107 - DNA, 25 bp, Homo sapien
ctccgggggatcctctctggagcca

SEQ ID NO: 654108 - DNA, 25 bp, Homo sapien
gaaatatcccactatgcaatcctat

SEQ ID NO: 654109 - DNA, 25 bp, Homo sapien
actatgcaatcctattttgagatga

SEQ ID NO: 654110 - DNA, 25 bp, Homo sapien
gaacatgcattagttacctaccagc

SEQ ID NO: 654111 - DNA, 25 bp, Homo sapien
gttacctaccagcttgacaggaatg

SEQ ID NO: 654112 - DNA, 25 bp, Homo sapien
gatttccaaatctgacacaccatag

SEQ ID NO: 654113 - DNA, 25 bp, Homo sapien
tgacacaccatagcctgaattctca

SEQ ID NO: 654114 - DNA, 25 bp, Homo sapien
aattctcaccagtttgctcctggaa

SEQ ID NO: 654115 - DNA, 25 bp, Homo sapien
tttgctcctggaaaggcccgctcat

SEQ ID NO: 654116 - DNA, 25 bp, Homo sapien
gtgggatggcagtaatctctgctaa

SEQ ID NO: 654117 - DNA, 25 bp, Homo sapien
gataaacgggagcttctgtggataa

SEQ ID NO: 654118 - DNA, 25 bp, Homo sapien
taaacgcagtgaagtgtgtgtggct

SEQ ID NO: 654119 - DNA, 25 bp, Homo sapien
tagctcagagattgggcactttcct

SEQ ID NO: 654120 - DNA, 25 bp, Homo sapien
gtaatgggcatctctgcgtctcact

SEQ ID NO: 654121 - DNA, 25 bp, Homo sapien
tgcgtctcactcatcagaggcttga

SEQ ID NO: 654122 - DNA, 25 bp, Homo sapien
atcagaggcttgactagcacccaac

SEQ ID NO: 654123 - DNA, 25 bp, Homo sapien
ctctgttggcgtgagactgtcatca

SEQ ID NO: 654124 - DNA, 25 bp, Homo sapien
gagtgaacggatgtccagctccaag

SEQ ID NO: 654125 - DNA, 25 bp, Homo sapien
tgaaggtctgtgcagccttatcaca

SEQ ID NO: 654126 - DNA, 25 bp, Homo sapien
acaaacacaaactgtccaccaggct

SEQ ID NO: 654127 - DNA, 25 bp, Homo sapien
agggatccgggtgccagactattaa

SEQ ID NO: 654128 - DNA, 25 bp, Homo sapien
agactattaacctctgttcccagtg

SEQ ID NO: 654129 - DNA, 25 bp, Homo sapien
aacctctgttcccagtgacaaaagt

SEQ ID NO: 654130 - DNA, 25 bp, Homo sapien
cctcatatcaaatctccttctaatt

SEQ ID NO: 654131 - DNA, 25 bp, Homo sapien
atcaaatctccttctaatttcctca

SEQ ID NO: 654132 - DNA, 25 bp, Homo sapien
tcaaatctccttctaatttcctcaa

SEQ ID NO: 654133 - DNA, 25 bp, Homo sapien
caaatctccttctaatttcctcaaa

SEQ ID NO: 654134 - DNA, 25 bp, Homo sapien
tttcctcaaacttgtgcctcatctg

SEQ ID NO: 654135 - DNA, 25 bp, Homo sapien
ttcctcaaacttgtgcctcatctgt

SEQ ID NO: 654136 - DNA, 25 bp, Homo sapien
tcctcaaacttgtgcctcatctgtc

SEQ ID NO: 654137 - DNA, 25 bp, Homo sapien
tcaaacttgtgcctcatctgtctgc

SEQ ID NO: 654138 - DNA, 25 bp, Homo sapien
aaacttgtgcctcatctgtctgccc

SEQ ID NO: 654139 - DNA, 25 bp, Homo sapien
ttgtgcctcatctgtctgccccttt

SEQ ID NO: 654140 - DNA, 25 bp, Homo sapien
atctgtctgcccctttctcaaggga

SEQ ID NO: 654141 - DNA, 25 bp, Homo sapien
atacagatttatatccacttttata

SEQ ID NO: 654142 - DNA, 25 bp, Homo sapien
taatgaaccttatatacctgaaaca

SEQ ID NO: 654143 - DNA, 25 bp, Homo sapien
gaaccttatatacctgaaacatggc

SEQ ID NO: 654144 - DNA, 25 bp, Homo sapien
cttatatacctgaaacatggctaat

SEQ ID NO: 654145 - DNA, 25 bp, Homo sapien
tacctgaaacatggctaataagaat

SEQ ID NO: 654146 - DNA, 25 bp, Homo sapien
gaatgtgaacataccaaaattagca

SEQ ID NO: 654147 - DNA, 25 bp, Homo sapien
tatgtgcagtttaaagtcgtgttat

SEQ ID NO: 654148 - DNA, 25 bp, Homo sapien
gtcgtgttatacttaatctattctg

SEQ ID NO: 654149 - DNA, 25 bp, Homo sapien
atgagagatgtttagaggtctcctt

SEQ ID NO: 654150 - DNA, 25 bp, Homo sapien
agatgtttagaggtctcctttgaga

SEQ ID NO: 654151 - DNA, 25 bp, Homo sapien
tgtttagaggtctcctttgagattt

SEQ ID NO: 654152 - DNA, 25 bp, Homo sapien
tacatgttaccttggtttgctttgg

SEQ ID NO: 654153 - DNA, 25 bp, Homo sapien
tttgctttggtgttcgtttgcctaa

SEQ ID NO: 654154 - DNA, 25 bp, Homo sapien
tgttcgtttgcctaagattttcact

SEQ ID NO: 654155 - DNA, 25 bp, Homo sapien
cacttgatttctaaactgggagatt

SEQ ID NO: 654156 - DNA, 25 bp, Homo sapien
gctagatttaggaccattgtcttcc

SEQ ID NO: 654157 - DNA, 25 bp, Homo sapien
accattgtcttccagttgtctttac

SEQ ID NO: 654158 - DNA, 25 bp, Homo sapien
gttgtctttacactgccacaattat

SEQ ID NO: 654159 - DNA, 25 bp, Homo sapien
aatggcatagccacgcaaacatccg

SEQ ID NO: 654160 - DNA, 25 bp, Homo sapien
aaacatccgcacttatggcacaggc

SEQ ID NO: 654161 - DNA, 25 bp, Homo sapien
tggcacaggctactcaaaaagggtt

SEQ ID NO: 654162 - DNA, 25 bp, Homo sapien
aaaagggttaaaggccagatgcagt

SEQ ID NO: 654163 - DNA, 25 bp, Homo sapien
gggtgagtacagtaccgaccaacaa

SEQ ID NO: 654164 - DNA, 25 bp, Homo sapien
gtaccgaccaacaaactgtttcaag

SEQ ID NO: 654165 - DNA, 25 bp, Homo sapien
ggattaattgagatcgagcacataa

SEQ ID NO: 654166 - DNA, 25 bp, Homo sapien
aaagtatgtaagacacaatgctggc

SEQ ID NO: 654167 - DNA, 25 bp, Homo sapien
atgctggcacataacaagctctcag

SEQ ID NO: 654168 - DNA, 25 bp, Homo sapien
caagctctcagtaagtcggtagtat

SEQ ID NO: 654169 - DNA, 25 bp, Homo sapien
attgctattgttatcatcaccgacg

SEQ ID NO: 654170 - DNA, 25 bp, Homo sapien
atcaccgacgattatgtcactagaa

SEQ ID NO: 654171 - DNA, 25 bp, Homo sapien
aagacctagaggctgaacacataat

SEQ ID NO: 654172 - DNA, 25 bp, Homo sapien
ggctgaacacataattgagagactt

SEQ ID NO: 654173 - DNA, 25 bp, Homo sapien
gaaacctcagcatgtgatctacaat

SEQ ID NO: 654174 - DNA, 25 bp, Homo sapien
aattctcataagatctaatggtttt

SEQ ID NO: 654175 - DNA, 25 bp, Homo sapien
attctcataagatctaatggttttg

SEQ ID NO: 654176 - DNA, 25 bp, Homo sapien
ttctcataagatctaatggttttgt

SEQ ID NO: 654177 - DNA, 25 bp, Homo sapien
tctaatggttttgtaaatggtagtt

SEQ ID NO: 654178 - DNA, 25 bp, Homo sapien
tttgtaaatggtagtttttcctgtg

SEQ ID NO: 654179 - DNA, 25 bp, Homo sapien
ttgtaaatggtagtttttcctgtgc

SEQ ID NO: 654180 - DNA, 25 bp, Homo sapien
tgtaaatggtagtttttcctgtgct

SEQ ID NO: 654181 - DNA, 25 bp, Homo sapien
gtaaatggtagtttttcctgtgctg

SEQ ID NO: 654182 - DNA, 25 bp, Homo sapien
tttttcctgtgctgactcattctct

SEQ ID NO: 654183 - DNA, 25 bp, Homo sapien
ttttcctgtgctgactcattctctc

SEQ ID NO: 654184 - DNA, 25 bp, Homo sapien
tgaagaggtgccttctgtcatgact

SEQ ID NO: 654185 - DNA, 25 bp, Homo sapien
attggatgctgaggtggtaggcacc

SEQ ID NO: 654186 - DNA, 25 bp, Homo sapien
ttctgatttttctgacgtgcaaggt

SEQ ID NO: 654187 - DNA, 25 bp, Homo sapien
gatttttctgacgtgcaaggtgtag

SEQ ID NO: 654188 - DNA, 25 bp, Homo sapien
ttctgacgtgcaaggtgtagattcc

SEQ ID NO: 654189 - DNA, 25 bp, Homo sapien
ggtgtagattccttttgttagtcat

SEQ ID NO: 654190 - DNA, 25 bp, Homo sapien
gtagattccttttgttagtcattca

SEQ ID NO: 654191 - DNA, 25 bp, Homo sapien
ttagtcattcaaaccaacagcagct

SEQ ID NO: 654192 - DNA, 25 bp, Homo sapien
aaccaacagcagctttaagtatgta

SEQ ID NO: 654193 - DNA, 25 bp, Homo sapien
gcagctttaagtatgtaatttgtga

SEQ ID NO: 654194 - DNA, 25 bp, Homo sapien
taatcagtcattcatatccaaggtt

SEQ ID NO: 654195 - DNA, 25 bp, Homo sapien
cagtcattcatatccaaggttataa

SEQ ID NO: 654196 - DNA, 25 bp, Homo sapien
caaattgttcagcataacacttcta

SEQ ID NO: 654197 - DNA, 25 bp, Homo sapien
gttcagcataacacttctaattaag

SEQ ID NO: 654198 - DNA, 25 bp, Homo sapien
taagtttatcaagttgtactgtatt

SEQ ID NO: 654199 - DNA, 25 bp, Homo sapien
ctgtattagataatcagcagtgtat

SEQ ID NO: 654200 - DNA, 25 bp, Homo sapien
cagtgtatctggagtatgtttaaag

SEQ ID NO: 654201 - DNA, 25 bp, Homo sapien
gagaacagttcgcaatacaaaaagt

SEQ ID NO: 654202 - DNA, 25 bp, Homo sapien
aagttacatggagctttacatctta

SEQ ID NO: 654203 - DNA, 25 bp, Homo sapien
ggagctttacatcttaactttcttt

SEQ ID NO: 654204 - DNA, 25 bp, Homo sapien
tttacatcttaactttctttgtcaa

SEQ ID NO: 654205 - DNA, 25 bp, Homo sapien
aggaaatcacctactttcatgcagg

SEQ ID NO: 654206 - DNA, 25 bp, Homo sapien
actttcatgcaggtgtataatcttg

SEQ ID NO: 654207 - DNA, 25 bp, Homo sapien
gagctgacttctggcaggaaacgtg

SEQ ID NO: 654208 - DNA, 25 bp, Homo sapien
aaacgtggaactggcagcgtgtcgt

SEQ ID NO: 654209 - DNA, 25 bp, Homo sapien
agcgtgtcgtgcaagcatctgcaat

SEQ ID NO: 654210 - DNA, 25 bp, Homo sapien
aagcatctgcaatcccagtcctgag

SEQ ID NO: 654211 - DNA, 25 bp, Homo sapien
agtcctgagctggacttctcagaga

SEQ ID NO: 654212 - DNA, 25 bp, Homo sapien
ctcagagaggctgggcattatttat

SEQ ID NO: 654213 - DNA, 25 bp, Homo sapien
gaacttctggccaggaactgccggt

SEQ ID NO: 654214 - DNA, 25 bp, Homo sapien
aggaactgccggtggtgtcacatcc

SEQ ID NO: 654215 - DNA, 25 bp, Homo sapien
ggtgtcacatccttaacctggctga

SEQ ID NO: 654216 - DNA, 25 bp, Homo sapien
ttaacctggctgacatcggaacacc

SEQ ID NO: 654217 - DNA, 25 bp, Homo sapien
tcaggagcccgcatggtgtcttttc

SEQ ID NO: 654218 - DNA, 25 bp, Homo sapien
cttagagcattgacatgtttggcat

SEQ ID NO: 654219 - DNA, 25 bp, Homo sapien
gtttggcatggatttgtttcacagg

SEQ ID NO: 654220 - DNA, 25 bp, Homo sapien
tcacagggtcccacagaaacttctg

SEQ ID NO: 654221 - DNA, 25 bp, Homo sapien
agaaacttctgctctccaggtttgc

SEQ ID NO: 654222 - DNA, 25 bp, Homo sapien
gaagtgtggcatcctaatctgcgat

SEQ ID NO: 654223 - DNA, 25 bp, Homo sapien
atcctaatctgcgatgcatccatct

SEQ ID NO: 654224 - DNA, 25 bp, Homo sapien
tgagcatatgcagggcagagacacc

SEQ ID NO: 654225 - DNA, 25 bp, Homo sapien
agagacacctctgcttctcttgggt

SEQ ID NO: 654226 - DNA, 25 bp, Homo sapien
ttctcttgggtctccggcatcctgt

SEQ ID NO: 654227 - DNA, 25 bp, Homo sapien
gctgtgcccaggaggactgtgccca

SEQ ID NO: 654228 - DNA, 25 bp, Homo sapien
atcctgcagggccttagagcattga

SEQ ID NO: 654229 - DNA, 25 bp, Homo sapien
tagctcctgtaattcccacatgtca

SEQ ID NO: 654230 - DNA, 25 bp, Homo sapien
gaccccatgggaggtaattgactca

SEQ ID NO: 654231 - DNA, 25 bp, Homo sapien
tataaaagggagttccctgcccaag

SEQ ID NO: 654232 - DNA, 25 bp, Homo sapien
taaaagggagttccctgcccaagct

SEQ ID NO: 654233 - DNA, 25 bp, Homo sapien
agggagttccctgcccaagctccct

SEQ ID NO: 654234 - DNA, 25 bp, Homo sapien
tggaagacgtgcctttgctcctttg

SEQ ID NO: 654235 - DNA, 25 bp, Homo sapien
agacgtgcctttgctcctttgcctt

SEQ ID NO: 654236 - DNA, 25 bp, Homo sapien
tccaaaatttgcagggtgggtgata

SEQ ID NO: 654237 - DNA, 25 bp, Homo sapien
ccaaaatttgcagggtgggtgatac

SEQ ID NO: 654238 - DNA, 25 bp, Homo sapien
aatttgcagggtgggtgatacggtt

SEQ ID NO: 654239 - DNA, 25 bp, Homo sapien
gcagggtgggtgatacggtttggct

SEQ ID NO: 654240 - DNA, 25 bp, Homo sapien
gtaaattttggttgatcaacgtcat

SEQ ID NO: 654241 - DNA, 25 bp, Homo sapien
ggttgatcaacgtcatgtttgataa

SEQ ID NO: 654242 - DNA, 25 bp, Homo sapien
taaactagctttgctgttgatctta

SEQ ID NO: 654243 - DNA, 25 bp, Homo sapien
actagctttgctgttgatcttaaat

SEQ ID NO: 654244 - DNA, 25 bp, Homo sapien
tagctttgctgttgatcttaaatat

SEQ ID NO: 654245 - DNA, 25 bp, Homo sapien
gctgttgatcttaaatatatagtta

SEQ ID NO: 654246 - DNA, 25 bp, Homo sapien
cttccttctccttgaagaattccac

SEQ ID NO: 654247 - DNA, 25 bp, Homo sapien
ccttctccttgaagaattccaccaa

SEQ ID NO: 654248 - DNA, 25 bp, Homo sapien
gaattccaccaaactttatatattt

SEQ ID NO: 654249 - DNA, 25 bp, Homo sapien
aaaaacaactttaagagcacatatt

SEQ ID NO: 654250 - DNA, 25 bp, Homo sapien
tctggaagtataattgattgtcaat

SEQ ID NO: 654251 - DNA, 25 bp, Homo sapien
gtccctgaatagctcttcatagctg

SEQ ID NO: 654252 - DNA, 25 bp, Homo sapien
tcttcatagctgacccttcttgtga

SEQ ID NO: 654253 - DNA, 25 bp, Homo sapien
tgaccgcctgactgctggctactat

SEQ ID NO: 654254 - DNA, 25 bp, Homo sapien
tggctactatccatgcacacgctgt

SEQ ID NO: 654255 - DNA, 25 bp, Homo sapien
cacacgctgtctttagcactctaaa

SEQ ID NO: 654256 - DNA, 25 bp, Homo sapien
tggccagccctaagcttgttttaag

SEQ ID NO: 654257 - DNA, 25 bp, Homo sapien
tttaagggttgctcactggtgctgt

SEQ ID NO: 654258 - DNA, 25 bp, Homo sapien
tgctgtgtatgcctctggatgtgtc

SEQ ID NO: 654259 - DNA, 25 bp, Homo sapien
tggatgtgtccagaagctttaccat

SEQ ID NO: 654260 - DNA, 25 bp, Homo sapien
ttgacatgttttcaccttgctgctg

SEQ ID NO: 654261 - DNA, 25 bp, Homo sapien
agagcttgtctcaccatgtatttct

SEQ ID NO: 654262 - DNA, 25 bp, Homo sapien
aatctgattttagcctcttagagag

SEQ ID NO: 654263 - DNA, 25 bp, Homo sapien
gcctcttagagagtgctaactagct

SEQ ID NO: 654264 - DNA, 25 bp, Homo sapien
gctaactagctggtaatgtttactt

SEQ ID NO: 654265 - DNA, 25 bp, Homo sapien
ttaattccttgttaaaatgaggcaa

SEQ ID NO: 654266 - DNA, 25 bp, Homo sapien
aagtgtaaattcttcatatcttttt

SEQ ID NO: 654267 - DNA, 25 bp, Homo sapien
tttctgactacttctgccatgtata

SEQ ID NO: 654268 - DNA, 25 bp, Homo sapien
gactacttctgccatgtataatacc

SEQ ID NO: 654269 - DNA, 25 bp, Homo sapien
ccatttttgtgcatgcttgatgtga

SEQ ID NO: 654270 - DNA, 25 bp, Homo sapien
tgtgcatgcttgatgtgacattcat

SEQ ID NO: 654271 - DNA, 25 bp, Homo sapien
tgacattcataaattgtaccactat

SEQ ID NO: 654272 - DNA, 25 bp, Homo sapien
accactatgactttatccatgtaaa

SEQ ID NO: 654273 - DNA, 25 bp, Homo sapien
gggccataactctgatactactgtt

SEQ ID NO: 654274 - DNA, 25 bp, Homo sapien
gatactactgttaacgaattgtgag

SEQ ID NO: 654275 - DNA, 25 bp, Homo sapien
aacgaattgtgagatttgctgtaaa

SEQ ID NO: 654276 - DNA, 25 bp, Homo sapien
gatttaggaaaagacacgacgggag

SEQ ID NO: 654277 - DNA, 25 bp, Homo sapien
gggagaatctggtgttcttggcctc

SEQ ID NO: 654278 - DNA, 25 bp, Homo sapien
gtgttcttggcctctgtgggtccat

SEQ ID NO: 654279 - DNA, 25 bp, Homo sapien
tctgtgggtccatccctgtatgctt

SEQ ID NO: 654280 - DNA, 25 bp, Homo sapien
caaaaagttgtctgtcctgagtgat

SEQ ID NO: 654281 - DNA, 25 bp, Homo sapien
gtcctgagtgattgagactccgaat

SEQ ID NO: 654282 - DNA, 25 bp, Homo sapien
caccccagtggctgtttgcgaagat

SEQ ID NO: 654283 - DNA, 25 bp, Homo sapien
gcgaagatgcttccaggacatagga

SEQ ID NO: 654284 - DNA, 25 bp, Homo sapien
aatcctccagcacagggttttccaa

SEQ ID NO: 654285 - DNA, 25 bp, Homo sapien
gtaaatcattgactcagactgtaaa

SEQ ID NO: 654286 - DNA, 25 bp, Homo sapien
taagtcagtgtaaacttttccttat

SEQ ID NO: 654287 - DNA, 25 bp, Homo sapien
tggtacggaactgcacgctagggaa

SEQ ID NO: 654288 - DNA, 25 bp, Homo sapien
gctagggaaggcgaatgaccagaac

SEQ ID NO: 654289 - DNA, 25 bp, Homo sapien
aacgcaaaaggttcagcttagtgct

SEQ ID NO: 654290 - DNA, 25 bp, Homo sapien
cagcttagtgctgcggacacagttc

SEQ ID NO: 654291 - DNA, 25 bp, Homo sapien
ggacacagttcccagatgcatcatc

SEQ ID NO: 654292 - DNA, 25 bp, Homo sapien
agatgcatcatcacctcaggctact

SEQ ID NO: 654293 - DNA, 25 bp, Homo sapien
atcacctcaggctactagaaatcat

SEQ ID NO: 654294 - DNA, 25 bp, Homo sapien
gaaatcatcattctgacaccacaat

SEQ ID NO: 654295 - DNA, 25 bp, Homo sapien
ggagaaatacacttgaggaaggaga

SEQ ID NO: 654296 - DNA, 25 bp, Homo sapien
agaaatacacttgaggaaggagagt

SEQ ID NO: 654297 - DNA, 25 bp, Homo sapien
gaaatacacttgaggaaggagagtg

SEQ ID NO: 654298 - DNA, 25 bp, Homo sapien
gaaaggaggatctcagggaagtcta

SEQ ID NO: 654299 - DNA, 25 bp, Homo sapien
aaaggaggatctcagggaagtctag

SEQ ID NO: 654300 - DNA, 25 bp, Homo sapien
aaggaggatctcagggaagtctagg

SEQ ID NO: 654301 - DNA, 25 bp, Homo sapien
aggaggatctcagggaagtctagga

SEQ ID NO: 654302 - DNA, 25 bp, Homo sapien
gaggatctcagggaagtctaggagg

SEQ ID NO: 654303 - DNA, 25 bp, Homo sapien
aggatctcagggaagtctaggagga

SEQ ID NO: 654304 - DNA, 25 bp, Homo sapien
ggatctcagggaagtctaggaggaa

SEQ ID NO: 654305 - DNA, 25 bp, Homo sapien
tcgaagaatttcttttagaatgaat

SEQ ID NO: 654306 - DNA, 25 bp, Homo sapien
catgcatgcctaaaactgattctgt

SEQ ID NO: 654307 - DNA, 25 bp, Homo sapien
gcatgcctaaaactgattctgttcc

SEQ ID NO: 654308 - DNA, 25 bp, Homo sapien
tgcctaaaactgattctgttccagt

SEQ ID NO: 654309 - DNA, 25 bp, Homo sapien
gtatactaattttaagacattgtgt

SEQ ID NO: 654310 - DNA, 25 bp, Homo sapien
ttccttcacttaatttctattttct

SEQ ID NO: 654311 - DNA, 25 bp, Homo sapien
gagtatagtactgggcatcacatgc

SEQ ID NO: 654312 - DNA, 25 bp, Homo sapien
tagtactgggcatcacatgctgctt

SEQ ID NO: 654313 - DNA, 25 bp, Homo sapien
tgggcatcacatgctgcttcccttt

SEQ ID NO: 654314 - DNA, 25 bp, Homo sapien
gctgcttccctttgtggctttgaat

SEQ ID NO: 654315 - DNA, 25 bp, Homo sapien
gcttccctttgtggctttgaataaa

SEQ ID NO: 654316 - DNA, 25 bp, Homo sapien
tttgtggctttgaataaacccttat

SEQ ID NO: 654317 - DNA, 25 bp, Homo sapien
tgacgcctcccctcacttagaaaag

SEQ ID NO: 654318 - DNA, 25 bp, Homo sapien
gacgcctcccctcacttagaaaagg

SEQ ID NO: 654319 - DNA, 25 bp, Homo sapien
gcctcccctcacttagaaaaggcat

SEQ ID NO: 654320 - DNA, 25 bp, Homo sapien
cctcccctcacttagaaaaggcata

SEQ ID NO: 654321 - DNA, 25 bp, Homo sapien
ctcccctcacttagaaaaggcatac

SEQ ID NO: 654322 - DNA, 25 bp, Homo sapien
tcccctcacttagaaaaggcataca

SEQ ID NO: 654323 - DNA, 25 bp, Homo sapien
cctcacttagaaaaggcatacagga

SEQ ID NO: 654324 - DNA, 25 bp, Homo sapien
ctcacttagaaaaggcatacaggag

SEQ ID NO: 654325 - DNA, 25 bp, Homo sapien
ttagaaaaggcatacaggaggccgg

SEQ ID NO: 654326 - DNA, 25 bp, Homo sapien
aaaaggcatacaggaggccgggcat

SEQ ID NO: 654327 - DNA, 25 bp, Homo sapien
aaaggcatacaggaggccgggcatg

SEQ ID NO: 654328 - DNA, 25 bp, Homo sapien
ttctgtattgtgattcttgtcattt

SEQ ID NO: 654329 - DNA, 25 bp, Homo sapien
ttgtgattcttgtcatttaattgta

SEQ ID NO: 654330 - DNA, 25 bp, Homo sapien
catttaattgtattgtgtctttgga

SEQ ID NO: 654331 - DNA, 25 bp, Homo sapien
agaaagcctttcctgtactgaggtc

SEQ ID NO: 654332 - DNA, 25 bp, Homo sapien
aaagcctttcctgtactgaggtcat

SEQ ID NO: 654333 - DNA, 25 bp, Homo sapien
aagcctttcctgtactgaggtcata

SEQ ID NO: 654334 - DNA, 25 bp, Homo sapien
agcctttcctgtactgaggtcataa

SEQ ID NO: 654335 - DNA, 25 bp, Homo sapien
cctttcctgtactgaggtcataagc

SEQ ID NO: 654336 - DNA, 25 bp, Homo sapien
gtatttcttctctaacatttatcat

SEQ ID NO: 654337 - DNA, 25 bp, Homo sapien
ttctctaacatttatcatttacata

SEQ ID NO: 654338 - DNA, 25 bp, Homo sapien
gtgtgtgtatgccttttttaccaca

SEQ ID NO: 654339 - DNA, 25 bp, Homo sapien
tcatgtgagctattggagttttcct

SEQ ID NO: 654340 - DNA, 25 bp, Homo sapien
agttttccttgctatcaggatgcat

SEQ ID NO: 654341 - DNA, 25 bp, Homo sapien
gaggtatgaagagtgttctggtcaa

SEQ ID NO: 654342 - DNA, 25 bp, Homo sapien
tgttctggtcaagattgctgagtga

SEQ ID NO: 654343 - DNA, 25 bp, Homo sapien
gtgagtgtatgaagagaactttcta

SEQ ID NO: 654344 - DNA, 25 bp, Homo sapien
tatagacagctatggacaagggata

SEQ ID NO: 654345 - DNA, 25 bp, Homo sapien
gaaatctaaataatcagcggagact

SEQ ID NO: 654346 - DNA, 25 bp, Homo sapien
tcagcggagactaaagcatgcctta

SEQ ID NO: 654347 - DNA, 25 bp, Homo sapien
aaagcatgccttatccttgtcagga

SEQ ID NO: 654348 - DNA, 25 bp, Homo sapien
gccttatccttgtcaggagattgca

SEQ ID NO: 654349 - DNA, 25 bp, Homo sapien
tggaactcggctctccatctgtgaa

SEQ ID NO: 654350 - DNA, 25 bp, Homo sapien
acagacttcctgagctctggaagga

SEQ ID NO: 654351 - DNA, 25 bp, Homo sapien
tttcctcctgatatactcagaagcc

SEQ ID NO: 654352 - DNA, 25 bp, Homo sapien
ctcagaagccatttctgtcttatta

SEQ ID NO: 654353 - DNA, 25 bp, Homo sapien
gtcttattatcatcatctgacagag

SEQ ID NO: 654354 - DNA, 25 bp, Homo sapien
atctgacagagtttggtctgaagct

SEQ ID NO: 654355 - DNA, 25 bp, Homo sapien
aattgcttcttctgcaggctaggaa

SEQ ID NO: 654356 - DNA, 25 bp, Homo sapien
ggaagcctcacctgcaattgtgaaa

SEQ ID NO: 654357 - DNA, 25 bp, Homo sapien
gaaaattttcttctgcccattgtac

SEQ ID NO: 654358 - DNA, 25 bp, Homo sapien
tcttctgcccattgtacacttctaa

SEQ ID NO: 654359 - DNA, 25 bp, Homo sapien
tttgaaacctctgtacaaggacatt

SEQ ID NO: 654360 - DNA, 25 bp, Homo sapien
ggacatttcaacctcattgtttaca

SEQ ID NO: 654361 - DNA, 25 bp, Homo sapien
ttagctattaataagtctcggctgg

SEQ ID NO: 654362 - DNA, 25 bp, Homo sapien
tagctattaataagtctcggctggg

SEQ ID NO: 654363 - DNA, 25 bp, Homo sapien
agctattaataagtctcggctgggc

SEQ ID NO: 654364 - DNA, 25 bp, Homo sapien
gctattaataagtctcggctgggcg

SEQ ID NO: 654365 - DNA, 25 bp, Homo sapien
ctattaataagtctcggctgggcgc

SEQ ID NO: 654366 - DNA, 25 bp, Homo sapien
tattaataagtctcggctgggcgca

SEQ ID NO: 654367 - DNA, 25 bp, Homo sapien
attaataagtctcggctgggcgcag

SEQ ID NO: 654368 - DNA, 25 bp, Homo sapien
ttaataagtctcggctgggcgcagt

SEQ ID NO: 654369 - DNA, 25 bp, Homo sapien
taataagtctcggctgggcgcagtg

SEQ ID NO: 654370 - DNA, 25 bp, Homo sapien
aataagtctcggctgggcgcagtgg

SEQ ID NO: 654371 - DNA, 25 bp, Homo sapien
taagtctcggctgggcgcagtgggt

SEQ ID NO: 654372 - DNA, 25 bp, Homo sapien
ggctgaaaagcctatactcttaatc

SEQ ID NO: 654373 - DNA, 25 bp, Homo sapien
actcttaatcctatcaatctatctg

SEQ ID NO: 654374 - DNA, 25 bp, Homo sapien
aaaactatatgtgctctctcggaac

SEQ ID NO: 654375 - DNA, 25 bp, Homo sapien
gctctctcggaacacatacaaacat

SEQ ID NO: 654376 - DNA, 25 bp, Homo sapien
gtagatgtatattcctttttagcgt

SEQ ID NO: 654377 - DNA, 25 bp, Homo sapien
tttccagatttctgtccacatctag

SEQ ID NO: 654378 - DNA, 25 bp, Homo sapien
gatttctgtccacatctagatctcc

SEQ ID NO: 654379 - DNA, 25 bp, Homo sapien
tagatctccctttgccccaatatta

SEQ ID NO: 654380 - DNA, 25 bp, Homo sapien
acaaacttggtgttcatactttcaa

SEQ ID NO: 654381 - DNA, 25 bp, Homo sapien
gtgttcatactttcaatgtgcatat

SEQ ID NO: 654382 - DNA, 25 bp, Homo sapien
attttccccaaagctaggagaagag

SEQ ID NO: 654383 - DNA, 25 bp, Homo sapien
ttctagtgtctgtatttgcatggat

SEQ ID NO: 654384 - DNA, 25 bp, Homo sapien
gtctgtatttgcatggatagttgaa

SEQ ID NO: 654385 - DNA, 25 bp, Homo sapien
gaacatgtttgactagtaaaacctt

SEQ ID NO: 654386 - DNA, 25 bp, Homo sapien
taaaacctttactttgccctctatg

SEQ ID NO: 654387 - DNA, 25 bp, Homo sapien
tttactttgccctctatgacctcac

SEQ ID NO: 654388 - DNA, 25 bp, Homo sapien
tatgacctcacccatatgtacagag

SEQ ID NO: 654389 - DNA, 25 bp, Homo sapien
aacatcatccttgtcctcaatagtt

SEQ ID NO: 654390 - DNA, 25 bp, Homo sapien
aatagtttcacttctgtttgcccct

SEQ ID NO: 654391 - DNA, 25 bp, Homo sapien
tctgtttgcccctgatatgcttaat

SEQ ID NO: 654392 - DNA, 25 bp, Homo sapien
gcccctgatatgcttaatatctgct

SEQ ID NO: 654393 - DNA, 25 bp, Homo sapien
aatatctgctctgagacagtcccac

SEQ ID NO: 654394 - DNA, 25 bp, Homo sapien
tattagggcatggtcaaacacgcct

SEQ ID NO: 654395 - DNA, 25 bp, Homo sapien
tagggcatggtcaaacacgcctgta

SEQ ID NO: 654396 - DNA, 25 bp, Homo sapien
aaaaataccattctcacatgactac

SEQ ID NO: 654397 - DNA, 25 bp, Homo sapien
catgactacaaaaccaccacaagca

SEQ ID NO: 654398 - DNA, 25 bp, Homo sapien
tacaaaaccaccacaagcaaaccta

SEQ ID NO: 654399 - DNA, 25 bp, Homo sapien
caccacaagcaaacctaggcctaat

SEQ ID NO: 654400 - DNA, 25 bp, Homo sapien
gcaaacctaggcctaattacccagt

SEQ ID NO: 654401 - DNA, 25 bp, Homo sapien
taggcctaattacccagtgaaccgt

SEQ ID NO: 654402 - DNA, 25 bp, Homo sapien
gcctaattacccagtgaaccgtaat

SEQ ID NO: 654403 - DNA, 25 bp, Homo sapien
ttacccagtgaaccgtaatttctca

SEQ ID NO: 654404 - DNA, 25 bp, Homo sapien
gaaccgtaatttctcaaaagcaggg

SEQ ID NO: 654405 - DNA, 25 bp, Homo sapien
aacccctgctagatgactattttga

SEQ ID NO: 654406 - DNA, 25 bp, Homo sapien
gggaaagaattgctcccctcagccc

SEQ ID NO: 654407 - DNA, 25 bp, Homo sapien
aaatttaggaccatcactggccagc

SEQ ID NO: 654408 - DNA, 25 bp, Homo sapien
cagccttatgtccttgcctgaggag

SEQ ID NO: 654409 - DNA, 25 bp, Homo sapien
tgtccttgcctgaggagttggaact

SEQ ID NO: 654410 - DNA, 25 bp, Homo sapien
gaaagttcacctgacttggaaacgt

SEQ ID NO: 654411 - DNA, 25 bp, Homo sapien
acctgacttggaaacgtgcacacaa

SEQ ID NO: 654412 - DNA, 25 bp, Homo sapien
aacgtgcacacaagcagtctctcaa

SEQ ID NO: 654413 - DNA, 25 bp, Homo sapien
gcagtctctcaacactgtgacgtta

SEQ ID NO: 654414 - DNA, 25 bp, Homo sapien
gaaggaagcatcaccgaagagagtt

SEQ ID NO: 654415 - DNA, 25 bp, Homo sapien
agagttgcgtttcattcggatggcc

SEQ ID NO: 654416 - DNA, 25 bp, Homo sapien
aaaacagcgatgaaaatgcttcaat

SEQ ID NO: 654417 - DNA, 25 bp, Homo sapien
caattacgaacacacttaaacaaag

SEQ ID NO: 654418 - DNA, 25 bp, Homo sapien
tatcaccagcaaatctaccctacag

SEQ ID NO: 654419 - DNA, 25 bp, Homo sapien
gcaaatctaccctacagctaaaaca

SEQ ID NO: 654420 - DNA, 25 bp, Homo sapien
tacagctaaaacagagggcttaagt

SEQ ID NO: 654421 - DNA, 25 bp, Homo sapien
aagttaggcccagaatctcatgaca

SEQ ID NO: 654422 - DNA, 25 bp, Homo sapien
ggcccagaatctcatgacataatat

SEQ ID NO: 654423 - DNA, 25 bp, Homo sapien
aaatcacttattctactaaaaatgg

SEQ ID NO: 654424 - DNA, 25 bp, Homo sapien
aaatggagaggatcacacaatgggt

SEQ ID NO: 654425 - DNA, 25 bp, Homo sapien
aagacaatcagtgcatgccatacaa

SEQ ID NO: 654426 - DNA, 25 bp, Homo sapien
agtgcatgccatacaaattgacaga

SEQ ID NO: 654427 - DNA, 25 bp, Homo sapien
gaagaaaggctacatatggagagac

SEQ ID NO: 654428 - DNA, 25 bp, Homo sapien
acatatggagagacctgagaaaccc

SEQ ID NO: 654429 - DNA, 25 bp, Homo sapien
caggaagtgggattaaaggctaaca

SEQ ID NO: 654430 - DNA, 25 bp, Homo sapien
aaaggctaacactggccacacaaga

SEQ ID NO: 654431 - DNA, 25 bp, Homo sapien
taacactggccacacaagacggacc

SEQ ID NO: 654432 - DNA, 25 bp, Homo sapien
aagacggaccgctgcacaggaattt

SEQ ID NO: 654433 - DNA, 25 bp, Homo sapien
ggaccgctgcacaggaatttacagt

SEQ ID NO: 654434 - DNA, 25 bp, Homo sapien
acaggaatttacagttcacagagca

SEQ ID NO: 654435 - DNA, 25 bp, Homo sapien
agagcactttttcatctccttaaaa

SEQ ID NO: 654436 - DNA, 25 bp, Homo sapien
tttcatctccttaaaatctcataaa

SEQ ID NO: 654437 - DNA, 25 bp, Homo sapien
aatctcataaaatcgcagtgaattg

SEQ ID NO: 654438 - DNA, 25 bp, Homo sapien
aaatgtttcgattgcattcaggaac

SEQ ID NO: 654439 - DNA, 25 bp, Homo sapien
gaagcataacctttgttgactcttg

SEQ ID NO: 654440 - DNA, 25 bp, Homo sapien
acctttgttgactcttgtaatttat

SEQ ID NO: 654441 - DNA, 25 bp, Homo sapien
tgcttcatttaaacccattttgtaa

SEQ ID NO: 654442 - DNA, 25 bp, Homo sapien
aatgtcctatgtatggcatatcctg

SEQ ID NO: 654443 - DNA, 25 bp, Homo sapien
ggcatatcctgtacaccaattgaag

SEQ ID NO: 654444 - DNA, 25 bp, Homo sapien
aggtcagagctttggtatttttgta

SEQ ID NO: 654445 - DNA, 25 bp, Homo sapien
taattctgtcttatctggtgcatca

SEQ ID NO: 654446 - DNA, 25 bp, Homo sapien
gtcttatctggtgcatcagctgtgt

SEQ ID NO: 654447 - DNA, 25 bp, Homo sapien
tcagctgtgtattttacgtcaaggt

SEQ ID NO: 654448 - DNA, 25 bp, Homo sapien
caaggtaaatgagcatcctgtttta

SEQ ID NO: 654449 - DNA, 25 bp, Homo sapien
cagcctagcttgcagaaagtcacca

SEQ ID NO: 654450 - DNA, 25 bp, Homo sapien
gcctagcttgcagaaagtcaccact

SEQ ID NO: 654451 - DNA, 25 bp, Homo sapien
tagcttgcagaaagtcaccactgat

SEQ ID NO: 654452 - DNA, 25 bp, Homo sapien
gcttgcagaaagtcaccactgatat

SEQ ID NO: 654453 - DNA, 25 bp, Homo sapien
gaaagtcaccactgatatagaaatg

SEQ ID NO: 654454 - DNA, 25 bp, Homo sapien
atagaaatggaacctatagccgggt

SEQ ID NO: 654455 - DNA, 25 bp, Homo sapien
aatggaacctatagccgggtgcggt

SEQ ID NO: 654456 - DNA, 25 bp, Homo sapien
ccaacattatgaaacgccgtctcca

SEQ ID NO: 654457 - DNA, 25 bp, Homo sapien
aacattatgaaacgccgtctccact

SEQ ID NO: 654458 - DNA, 25 bp, Homo sapien
ttatgaaacgccgtctccactaaat

SEQ ID NO: 654459 - DNA, 25 bp, Homo sapien
atgaaacgccgtctccactaaatat

SEQ ID NO: 654460 - DNA, 25 bp, Homo sapien
acttctgaatcacatacatcctcgg

SEQ ID NO: 654461 - DNA, 25 bp, Homo sapien
acatcctcggcaagacagctgtcaa

SEQ ID NO: 654462 - DNA, 25 bp, Homo sapien
gaaacatcacccaacatatcagctg

SEQ ID NO: 654463 - DNA, 25 bp, Homo sapien
atcagctgtgctttcggcttgaaga

SEQ ID NO: 654464 - DNA, 25 bp, Homo sapien
cagtggtgagccagcacatgcttgt

SEQ ID NO: 654465 - DNA, 25 bp, Homo sapien
agcacatgcttgtcgccacagtgtg

SEQ ID NO: 654466 - DNA, 25 bp, Homo sapien
tcgccacagtgtgatgtctacgact

SEQ ID NO: 654467 - DNA, 25 bp, Homo sapien
gtctacgactgaaattatctcccca

SEQ ID NO: 654468 - DNA, 25 bp, Homo sapien
ttatctccccaaccagaagtctgga

SEQ ID NO: 654469 - DNA, 25 bp, Homo sapien
tgctgagtcacagacttccacaagt

SEQ ID NO: 654470 - DNA, 25 bp, Homo sapien
ggcccagggttaccttctagagaca

SEQ ID NO: 654471 - DNA, 25 bp, Homo sapien
gggaagagatgctgatttctgcgat

SEQ ID NO: 654472 - DNA, 25 bp, Homo sapien
gaagagatgctgatttctgcgataa

SEQ ID NO: 654473 - DNA, 25 bp, Homo sapien
gagatgctgatttctgcgataaaat

SEQ ID NO: 654474 - DNA, 25 bp, Homo sapien
atttctgcgataaaatcagtaggta

SEQ ID NO: 654475 - DNA, 25 bp, Homo sapien
tgcgataaaatcagtaggtacattt

SEQ ID NO: 654476 - DNA, 25 bp, Homo sapien
taaaatcagtaggtacattttttgg

SEQ ID NO: 654477 - DNA, 25 bp, Homo sapien
ttcgctatgtgccaggctagatttt

SEQ ID NO: 654478 - DNA, 25 bp, Homo sapien
cgctatgtgccaggctagattttac

SEQ ID NO: 654479 - DNA, 25 bp, Homo sapien
tatgtgccaggctagattttacaga

SEQ ID NO: 654480 - DNA, 25 bp, Homo sapien
gtgccaggctagattttacagatga

SEQ ID NO: 654481 - DNA, 25 bp, Homo sapien
tgccaggctagattttacagatgag

SEQ ID NO: 654482 - DNA, 25 bp, Homo sapien
tcagccagtgtgtccccatgggtat

SEQ ID NO: 654483 - DNA, 25 bp, Homo sapien
agtgtgtccccatgggtatccccag

SEQ ID NO: 654484 - DNA, 25 bp, Homo sapien
catccttgctcaatccattacttat

SEQ ID NO: 654485 - DNA, 25 bp, Homo sapien
gctcaatccattacttatatactaa

SEQ ID NO: 654486 - DNA, 25 bp, Homo sapien
tatatactaactacataatgacctg

SEQ ID NO: 654487 - DNA, 25 bp, Homo sapien
ataatgacctgttcaaaccagactc

SEQ ID NO: 654488 - DNA, 25 bp, Homo sapien
accagactctatttaatgaactgtg

SEQ ID NO: 654489 - DNA, 25 bp, Homo sapien
cattttctactgtaaaccaaaagag

SEQ ID NO: 654490 - DNA, 25 bp, Homo sapien
aaaagaaagcttgacagtgttatga

SEQ ID NO: 654491 - DNA, 25 bp, Homo sapien
gttatgaaagccaccagactcagcc

SEQ ID NO: 654492 - DNA, 25 bp, Homo sapien
tgaaagccaccagactcagccagtg

SEQ ID NO: 654493 - DNA, 25 bp, Homo sapien
tcttctaaaaagagggttaggactg

SEQ ID NO: 654494 - DNA, 25 bp, Homo sapien
taggactggcaataagacattatgt

SEQ ID NO: 654495 - DNA, 25 bp, Homo sapien
cattatgttgcttaagtgctataaa

SEQ ID NO: 654496 - DNA, 25 bp, Homo sapien
aagattggaacgattgctgtaggaa

SEQ ID NO: 654497 - DNA, 25 bp, Homo sapien
gaacgattgctgtaggaaaagggaa

SEQ ID NO: 654498 - DNA, 25 bp, Homo sapien
cagcagcatcaagatcttaaacaag

SEQ ID NO: 654499 - DNA, 25 bp, Homo sapien
caagagagtcaatcaaaatgttatt

SEQ ID NO: 654500 - DNA, 25 bp, Homo sapien
ttaagccaggcttacaggataagtg

SEQ ID NO: 654501 - DNA, 25 bp, Homo sapien
agccaggcttacaggataagtgaaa

SEQ ID NO: 654502 - DNA, 25 bp, Homo sapien
aagaagtgaagatgtcaagactgaa

SEQ ID NO: 654503 - DNA, 25 bp, Homo sapien
agatgtcaagactgaatttaaaact

SEQ ID NO: 654504 - DNA, 25 bp, Homo sapien
aaaatgaagtctgcccagagctgct

SEQ ID NO: 654505 - DNA, 25 bp, Homo sapien
gcccatggagtcctctgaggacgac

SEQ ID NO: 654506 - DNA, 25 bp, Homo sapien
tgaggacgactccagagtccctcaa

SEQ ID NO: 654507 - DNA, 25 bp, Homo sapien
gaggacgactccagagtccctcaac

SEQ ID NO: 654508 - DNA, 25 bp, Homo sapien
ctcaactccttggaggagataagca

SEQ ID NO: 654509 - DNA, 25 bp, Homo sapien
ggaggagataagcagccaacacagt

SEQ ID NO: 654510 - DNA, 25 bp, Homo sapien
gagataagcagccaacacagtgttg

SEQ ID NO: 654511 - DNA, 25 bp, Homo sapien
gataagcagccaacacagtgttgtt

SEQ ID NO: 654512 - DNA, 25 bp, Homo sapien
acacagtgttgttcagcagatgcca

SEQ ID NO: 654513 - DNA, 25 bp, Homo sapien
agtgttgttcagcagatgccaccgt

SEQ ID NO: 654514 - DNA, 25 bp, Homo sapien
caccgtctgccatgccctggaattt

SEQ ID NO: 654515 - DNA, 25 bp, Homo sapien
gggccttgctccatcacccgagctg

SEQ ID NO: 654516 - DNA, 25 bp, Homo sapien
ccttgctccatcacccgagctggag

SEQ ID NO: 654517 - DNA, 25 bp, Homo sapien
ccatcacccgagctggagtgtaggt

SEQ ID NO: 654518 - DNA, 25 bp, Homo sapien
acccgagctggagtgtaggtagcat

SEQ ID NO: 654519 - DNA, 25 bp, Homo sapien
agtgtaggtagcatgatcatagctc

SEQ ID NO: 654520 - DNA, 25 bp, Homo sapien
ctcgctgcaaccttgaaatcctggg

SEQ ID NO: 654521 - DNA, 25 bp, Homo sapien
tagtggggactattggtccatgcca

SEQ ID NO: 654522 - DNA, 25 bp, Homo sapien
agtggggactattggtccatgccac

SEQ ID NO: 654523 - DNA, 25 bp, Homo sapien
gtggggactattggtccatgccacc

SEQ ID NO: 654524 - DNA, 25 bp, Homo sapien
tggggactattggtccatgccacca

SEQ ID NO: 654525 - DNA, 25 bp, Homo sapien
gggactattggtccatgccaccatg

SEQ ID NO: 654526 - DNA, 25 bp, Homo sapien
gaatatgtattatgtcctaggcact

SEQ ID NO: 654527 - DNA, 25 bp, Homo sapien
gtcctaggcactgtgtatcagaaat

SEQ ID NO: 654528 - DNA, 25 bp, Homo sapien
actgcatatatgagccttggagggt

SEQ ID NO: 654529 - DNA, 25 bp, Homo sapien
gtgattgtggttgatatgcattgac

SEQ ID NO: 654530 - DNA, 25 bp, Homo sapien
gtatttttcaacacatccagctgcg

SEQ ID NO: 654531 - DNA, 25 bp, Homo sapien
agctgcgtgctttcagcccagcagg

SEQ ID NO: 654532 - DNA, 25 bp, Homo sapien
agcaggtgctcaaaataggtttact

SEQ ID NO: 654533 - DNA, 25 bp, Homo sapien
gaggtgaaaaccaattcttgcctct

SEQ ID NO: 654534 - DNA, 25 bp, Homo sapien
attcttgcctctaaagggtgttcca

SEQ ID NO: 654535 - DNA, 25 bp, Homo sapien
gggtgttccatggtctcacaggaat

SEQ ID NO: 654536 - DNA, 25 bp, Homo sapien
ggagtgaggagcatctttagtaaat

SEQ ID NO: 654537 - DNA, 25 bp, Homo sapien
acaaagcgaaagaggttagacacac

SEQ ID NO: 654538 - DNA, 25 bp, Homo sapien
ttagacacacaggtcacatattgta

SEQ ID NO: 654539 - DNA, 25 bp, Homo sapien
gacacacaggtcacatattgtatga

SEQ ID NO: 654540 - DNA, 25 bp, Homo sapien
agtaggttagcggttgccagctgat

SEQ ID NO: 654541 - DNA, 25 bp, Homo sapien
ttagcggttgccagctgatgggatt

SEQ ID NO: 654542 - DNA, 25 bp, Homo sapien
gagttgctaatggatatggtgtttc

SEQ ID NO: 654543 - DNA, 25 bp, Homo sapien
taatggatatggtgtttcttttggg

SEQ ID NO: 654544 - DNA, 25 bp, Homo sapien
attagatagctgtggtggttgtcaa

SEQ ID NO: 654545 - DNA, 25 bp, Homo sapien
atagctgtggtggttgtcaaagttg

SEQ ID NO: 654546 - DNA, 25 bp, Homo sapien
ataaactttaacatggtgacttttg

SEQ ID NO: 654547 - DNA, 25 bp, Homo sapien
taacatggtgacttttgtgatacgt

SEQ ID NO: 654548 - DNA, 25 bp, Homo sapien
ggaaaaattttctcagaaagattct

SEQ ID NO: 654549 - DNA, 25 bp, Homo sapien
tctcagaaagattcttatcaaccaa

SEQ ID NO: 654550 - DNA, 25 bp, Homo sapien
tcagaaagattcttatcaaccaatc

SEQ ID NO: 654551 - DNA, 25 bp, Homo sapien
agaaagattcttatcaaccaatcaa

SEQ ID NO: 654552 - DNA, 25 bp, Homo sapien
gaaagattcttatcaaccaatcaaa

SEQ ID NO: 654553 - DNA, 25 bp, Homo sapien
aaagattcttatcaaccaatcaaat

SEQ ID NO: 654554 - DNA, 25 bp, Homo sapien
ataatcagtcatattagttttctta

SEQ ID NO: 654555 - DNA, 25 bp, Homo sapien
attagttttcttactattgttcata

SEQ ID NO: 654556 - DNA, 25 bp, Homo sapien
tagttttcttactattgttcatatt

SEQ ID NO: 654557 - DNA, 25 bp, Homo sapien
agttttcttactattgttcatattt

SEQ ID NO: 654558 - DNA, 25 bp, Homo sapien
atacttcttaattagatatgcttaa

SEQ ID NO: 654559 - DNA, 25 bp, Homo sapien
agctggttatactagcctgctcaag

SEQ ID NO: 654560 - DNA, 25 bp, Homo sapien
cgtgggctggagatctgtgtttcca

SEQ ID NO: 654561 - DNA, 25 bp, Homo sapien
gatctgtgtttccaaatcattagac

SEQ ID NO: 654562 - DNA, 25 bp, Homo sapien
gtttccaaatcattagacagtaggt

SEQ ID NO: 654563 - DNA, 25 bp, Homo sapien
gacagtaggtggtatttaaagtcct

SEQ ID NO: 654564 - DNA, 25 bp, Homo sapien
gtcctaagtttggataggatcacca

SEQ ID NO: 654565 - DNA, 25 bp, Homo sapien
tgtaggtgtagatggagaagtccct

SEQ ID NO: 654566 - DNA, 25 bp, Homo sapien
tgtatgcatcaggaagggctaactc

SEQ ID NO: 654567 - DNA, 25 bp, Homo sapien
gggctaactcctccaacaaatgatg

SEQ ID NO: 654568 - DNA, 25 bp, Homo sapien
gatgccaaatgttcagcgacttaga

SEQ ID NO: 654569 - DNA, 25 bp, Homo sapien
tgttcagcgacttagaggttgcagt

SEQ ID NO: 654570 - DNA, 25 bp, Homo sapien
agtaccaaacttggcccaacaatag

SEQ ID NO: 654571 - DNA, 25 bp, Homo sapien
aacttggcccaacaataggaaattg

SEQ ID NO: 654572 - DNA, 25 bp, Homo sapien
gaaattgaatcataaataccccaca

SEQ ID NO: 654573 - DNA, 25 bp, Homo sapien
agtattcacaatacatgattgactt

SEQ ID NO: 654574 - DNA, 25 bp, Homo sapien
gtaagacacaatgtaccgtaatagt

SEQ ID NO: 654575 - DNA, 25 bp, Homo sapien
caatgtaccgtaatagttccttttg

SEQ ID NO: 654576 - DNA, 25 bp, Homo sapien
ggccactgtctcttgaactgttggc

SEQ ID NO: 654577 - DNA, 25 bp, Homo sapien
actgtctcttgaactgttggccttt

SEQ ID NO: 654578 - DNA, 25 bp, Homo sapien
tcttgaactgttggccttttcacac

SEQ ID NO: 654579 - DNA, 25 bp, Homo sapien
tgttggccttttcacacctgaatag

SEQ ID NO: 654580 - DNA, 25 bp, Homo sapien
ggccttttcacacctgaatagtaat

SEQ ID NO: 654581 - DNA, 25 bp, Homo sapien
tcctgtcgttaccatttcatttaca

SEQ ID NO: 654582 - DNA, 25 bp, Homo sapien
gttaccatttcatttacatttcagt

SEQ ID NO: 654583 - DNA, 25 bp, Homo sapien
catttcagtagttgtcttttaagtg

SEQ ID NO: 654584 - DNA, 25 bp, Homo sapien
gtcttttaagtgtttctctcatatg

SEQ ID NO: 654585 - DNA, 25 bp, Homo sapien
aagtgtttctctcatatgaggtatc

SEQ ID NO: 654586 - DNA, 25 bp, Homo sapien
atgaggtatctttctccatcagttt

SEQ ID NO: 654587 - DNA, 25 bp, Homo sapien
aggtatctttctccatcagtttatt

SEQ ID NO: 654588 - DNA, 25 bp, Homo sapien
tttctccatcagtttatttaagact

SEQ ID NO: 654589 - DNA, 25 bp, Homo sapien
aataatgttgagatctgtgccggta

SEQ ID NO: 654590 - DNA, 25 bp, Homo sapien
agatctgtgccggtatgatagccac

SEQ ID NO: 654591 - DNA, 25 bp, Homo sapien
tctgtgccggtatgatagccactag

SEQ ID NO: 654592 - DNA, 25 bp, Homo sapien
ctcatctctttttagaattttcctg

SEQ ID NO: 654593 - DNA, 25 bp, Homo sapien
ttttcctgttcttggctgggcgtca

SEQ ID NO: 654594 - DNA, 25 bp, Homo sapien
tttcctgttcttggctgggcgtcat

SEQ ID NO: 654595 - DNA, 25 bp, Homo sapien
cctgttcttggctgggcgtcatggc

SEQ ID NO: 654596 - DNA, 25 bp, Homo sapien
ctgttcttggctgggcgtcatggct

SEQ ID NO: 654597 - DNA, 25 bp, Homo sapien
tgttcttggctgggcgtcatggctc

SEQ ID NO: 654598 - DNA, 25 bp, Homo sapien
gttcttggctgggcgtcatggctca

SEQ ID NO: 654599 - DNA, 25 bp, Homo sapien
tgggcgtcatggctcacgcttacaa

SEQ ID NO: 654600 - DNA, 25 bp, Homo sapien
gggcgtcatggctcacgcttacaat

SEQ ID NO: 654601 - DNA, 25 bp, Homo sapien
ggcgtcatggctcacgcttacaatc

SEQ ID NO: 654602 - DNA, 25 bp, Homo sapien
gcgtcatggctcacgcttacaatcc

SEQ ID NO: 654603 - DNA, 25 bp, Homo sapien
agtgatatgtttatgatgtcatcaa

SEQ ID NO: 654604 - DNA, 25 bp, Homo sapien
tatattgatgactggacttgggaaa

SEQ ID NO: 654605 - DNA, 25 bp, Homo sapien
acagtaacagtcttgctttcaggga

SEQ ID NO: 654606 - DNA, 25 bp, Homo sapien
acagtcttgctttcagggacttcct

SEQ ID NO: 654607 - DNA, 25 bp, Homo sapien
ctgtttcctctaggagattctcatg

SEQ ID NO: 654608 - DNA, 25 bp, Homo sapien
cacctgctggcaaaacggcatagct

SEQ ID NO: 654609 - DNA, 25 bp, Homo sapien
aaaacggcatagctattctctctgt

SEQ ID NO: 654610 - DNA, 25 bp, Homo sapien
ggcatagctattctctctgttttag

SEQ ID NO: 654611 - DNA, 25 bp, Homo sapien
atagctattctctctgttttagttt

SEQ ID NO: 654612 - DNA, 25 bp, Homo sapien
ggtactgtaacatggtctataaaga

SEQ ID NO: 654613 - DNA, 25 bp, Homo sapien
catggtctataaagaaaatctgctc

SEQ ID NO: 654614 - DNA, 25 bp, Homo sapien
aaatccagccggactactctgcagt

SEQ ID NO: 654615 - DNA, 25 bp, Homo sapien
agccggactactctgcagtccaagt

SEQ ID NO: 654616 - DNA, 25 bp, Homo sapien
gactactctgcagtccaagtcggag

SEQ ID NO: 654617 - DNA, 25 bp, Homo sapien
tactctgcagtccaagtcggagtcc

SEQ ID NO: 654618 - DNA, 25 bp, Homo sapien
ctgcagtccaagtcggagtccgagg

SEQ ID NO: 654619 - DNA, 25 bp, Homo sapien
ggactcctctgaagatggcggcgac

SEQ ID NO: 654620 - DNA, 25 bp, Homo sapien
gactcctctgaagatggcggcgact

SEQ ID NO: 654621 - DNA, 25 bp, Homo sapien
agatggcggcgactcctctgagtcc

SEQ ID NO: 654622 - DNA, 25 bp, Homo sapien
gcggcgactcctctgagtccagcag

SEQ ID NO: 654623 - DNA, 25 bp, Homo sapien
tgaagataatgagtccgagggcagc

SEQ ID NO: 654624 - DNA, 25 bp, Homo sapien
gataatgagtccgagggcagcagct

SEQ ID NO: 654625 - DNA, 25 bp, Homo sapien
cactcaatgcaaaagaggatggttt

SEQ ID NO: 654626 - DNA, 25 bp, Homo sapien
caatgcaaaagaggatggtttttca

SEQ ID NO: 654627 - DNA, 25 bp, Homo sapien
gatggtttttcattttatcaaaaca

SEQ ID NO: 654628 - DNA, 25 bp, Homo sapien
atcaaaacatttctgactgggcaca

SEQ ID NO: 654629 - DNA, 25 bp, Homo sapien
caaaacatttctgactgggcacaat

SEQ ID NO: 654630 - DNA, 25 bp, Homo sapien
aaaacatttctgactgggcacaatg

SEQ ID NO: 654631 - DNA, 25 bp, Homo sapien
aaacatttctgactgggcacaatgg

SEQ ID NO: 654632 - DNA, 25 bp, Homo sapien
acccaggacatggaggctacgatga

SEQ ID NO: 654633 - DNA, 25 bp, Homo sapien
ccaggacatggaggctacgatgagc

SEQ ID NO: 654634 - DNA, 25 bp, Homo sapien
ggacatggaggctacgatgagccaa

SEQ ID NO: 654635 - DNA, 25 bp, Homo sapien
acatggaggctacgatgagccaaga

SEQ ID NO: 654636 - DNA, 25 bp, Homo sapien
gaagtttctgttttgctttatctaa

SEQ ID NO: 654637 - DNA, 25 bp, Homo sapien
tctaaattgaaaggatggttttgcc

SEQ ID NO: 654638 - DNA, 25 bp, Homo sapien
atggttttgcctttcagcctttaga

SEQ ID NO: 654639 - DNA, 25 bp, Homo sapien
tggttttgcctttcagcctttagaa

SEQ ID NO: 654640 - DNA, 25 bp, Homo sapien
ggttttgcctttcagcctttagaag

SEQ ID NO: 654641 - DNA, 25 bp, Homo sapien
gttttgcctttcagcctttagaaga

SEQ ID NO: 654642 - DNA, 25 bp, Homo sapien
ttttgcctttcagcctttagaagaa

SEQ ID NO: 654643 - DNA, 25 bp, Homo sapien
gcctttagaagaagccacactctct

SEQ ID NO: 654644 - DNA, 25 bp, Homo sapien
gaagccacactctctgaattaaaaa

SEQ ID NO: 654645 - DNA, 25 bp, Homo sapien
attggaggctaagactgatccgtca

SEQ ID NO: 654646 - DNA, 25 bp, Homo sapien
gactgatccgtcaatcttgggtgga

SEQ ID NO: 654647 - DNA, 25 bp, Homo sapien
aagaaaggctggcttctgggctggg

SEQ ID NO: 654648 - DNA, 25 bp, Homo sapien
agaaaggctggcttctgggctgggc

SEQ ID NO: 654649 - DNA, 25 bp, Homo sapien
gaaaggctggcttctgggctgggcg

SEQ ID NO: 654650 - DNA, 25 bp, Homo sapien
aaaggctggcttctgggctgggcgt

SEQ ID NO: 654651 - DNA, 25 bp, Homo sapien
aaggctggcttctgggctgggcgtg

SEQ ID NO: 654652 - DNA, 25 bp, Homo sapien
aggctggcttctgggctgggcgtgg

SEQ ID NO: 654653 - DNA, 25 bp, Homo sapien
ggctggcttctgggctgggcgtggt

SEQ ID NO: 654654 - DNA, 25 bp, Homo sapien
gagaatggcttcaacctcggaggcg

SEQ ID NO: 654655 - DNA, 25 bp, Homo sapien
agaatggcttcaacctcggaggcgg

SEQ ID NO: 654656 - DNA, 25 bp, Homo sapien
gaatggcttcaacctcggaggcgga

SEQ ID NO: 654657 - DNA, 25 bp, Homo sapien
atggcttcaacctcggaggcggagg

SEQ ID NO: 654658 - DNA, 25 bp, Homo sapien
gaggttgtgacctgcagtgagccct

SEQ ID NO: 654659 - DNA, 25 bp, Homo sapien
gcctggaagacagactgagactgcc

SEQ ID NO: 654660 - DNA, 25 bp, Homo sapien
agacagactgagactgccacaaaaa

SEQ ID NO: 654661 - DNA, 25 bp, Homo sapien
atgactgcataagagttacaatcta

SEQ ID NO: 654662 - DNA, 25 bp, Homo sapien
tacaatctaagaaaatgagcccata

SEQ ID NO: 654663 - DNA, 25 bp, Homo sapien
aaatgagcccataaaaggacaattt

SEQ ID NO: 654664 - DNA, 25 bp, Homo sapien
atttaaattttctgtcaaggctcta

SEQ ID NO: 654665 - DNA, 25 bp, Homo sapien
tttctgtcaaggctctattgtccaa

SEQ ID NO: 654666 - DNA, 25 bp, Homo sapien
gtcaaggctctattgtccaaatatt

SEQ ID NO: 654667 - DNA, 25 bp, Homo sapien
ggctctattgtccaaatatttttca

SEQ ID NO: 654668 - DNA, 25 bp, Homo sapien
aagaccatcaaaatgcactttggga

SEQ ID NO: 654669 - DNA, 25 bp, Homo sapien
aatcgagtgagtgaagtattgcctg

SEQ ID NO: 654670 - DNA, 25 bp, Homo sapien
tgaagtattgcctggtagagattct

SEQ ID NO: 654671 - DNA, 25 bp, Homo sapien
tgctgctccacgaggttcctggcta

SEQ ID NO: 654672 - DNA, 25 bp, Homo sapien
gctccacgaggttcctggctaaggg

SEQ ID NO: 654673 - DNA, 25 bp, Homo sapien
gaggttcctggctaagggcctgctc

SEQ ID NO: 654674 - DNA, 25 bp, Homo sapien
agggcctgctctggcctttgcttct

SEQ ID NO: 654675 - DNA, 25 bp, Homo sapien
gctttttaattacactgactttgta

SEQ ID NO: 654676 - DNA, 25 bp, Homo sapien
ctttgtatttttacgtgcctgtctg

SEQ ID NO: 654677 - DNA, 25 bp, Homo sapien
atttttacgtgcctgtctgtcctgt

SEQ ID NO: 654678 - DNA, 25 bp, Homo sapien
cctgtctgtcctgtgacatcaaagt

SEQ ID NO: 654679 - DNA, 25 bp, Homo sapien
gtcctgtgacatcaaagtcttgctc

SEQ ID NO: 654680 - DNA, 25 bp, Homo sapien
catcattcccataagtttgcgtgtg

SEQ ID NO: 654681 - DNA, 25 bp, Homo sapien
cattcccataagtttgcgtgtgaac

SEQ ID NO: 654682 - DNA, 25 bp, Homo sapien
ataagtttgcgtgtgaacttggaca

SEQ ID NO: 654683 - DNA, 25 bp, Homo sapien
tgaacttggacatgggcaaagcggt

SEQ ID NO: 654684 - DNA, 25 bp, Homo sapien
agatgagaacatccctggcacggtc

SEQ ID NO: 654685 - DNA, 25 bp, Homo sapien
aacatccctggcacggtcgttcgga

SEQ ID NO: 654686 - DNA, 25 bp, Homo sapien
ggcacggtcgttcggaccagcacta

SEQ ID NO: 654687 - DNA, 25 bp, Homo sapien
gttcggaccagcactatcccagagg

SEQ ID NO: 654688 - DNA, 25 bp, Homo sapien
actatcccagaggaacttgggcgcc

SEQ ID NO: 654689 - DNA, 25 bp, Homo sapien
aacttgggcgcctggtgtatttatt

SEQ ID NO: 654690 - DNA, 25 bp, Homo sapien
tggtgtatttattgacagacaaaac

SEQ ID NO: 654691 - DNA, 25 bp, Homo sapien
attgtcattgacatgtagggtatgt

SEQ ID NO: 654692 - DNA, 25 bp, Homo sapien
ttgtcattgacatgtagggtatgtt

SEQ ID NO: 654693 - DNA, 25 bp, Homo sapien
tgtcattgacatgtagggtatgttt

SEQ ID NO: 654694 - DNA, 25 bp, Homo sapien
gtcattgacatgtagggtatgtttc

SEQ ID NO: 654695 - DNA, 25 bp, Homo sapien
tcattgacatgtagggtatgtttca

SEQ ID NO: 654696 - DNA, 25 bp, Homo sapien
cattgacatgtagggtatgtttcaa

SEQ ID NO: 654697 - DNA, 25 bp, Homo sapien
caagtcataggatcagaagataaaa

SEQ ID NO: 654698 - DNA, 25 bp, Homo sapien
agataaaatgccaagctggcaaggt

SEQ ID NO: 654699 - DNA, 25 bp, Homo sapien
gataaaatgccaagctggcaaggtg

SEQ ID NO: 654700 - DNA, 25 bp, Homo sapien
taaaatgccaagctggcaaggtggc

SEQ ID NO: 654701 - DNA, 25 bp, Homo sapien
aaaatgccaagctggcaaggtggct

SEQ ID NO: 654702 - DNA, 25 bp, Homo sapien
ctggcacctggcagcgtgaggggcc

SEQ ID NO: 654703 - DNA, 25 bp, Homo sapien
tggcacctggcagcgtgaggggcct

SEQ ID NO: 654704 - DNA, 25 bp, Homo sapien
ggcacctggcagcgtgaggggcctc

SEQ ID NO: 654705 - DNA, 25 bp, Homo sapien
gcacctggcagcgtgaggggcctca

SEQ ID NO: 654706 - DNA, 25 bp, Homo sapien
cacctggcagcgtgaggggcctcag

SEQ ID NO: 654707 - DNA, 25 bp, Homo sapien
gggcctcagggctgttaaaatccca

SEQ ID NO: 654708 - DNA, 25 bp, Homo sapien
ggcctcagggctgttaaaatcccaa

SEQ ID NO: 654709 - DNA, 25 bp, Homo sapien
gcctcagggctgttaaaatcccaac

SEQ ID NO: 654710 - DNA, 25 bp, Homo sapien
cctcagggctgttaaaatcccaacg

SEQ ID NO: 654711 - DNA, 25 bp, Homo sapien
ctcagggctgttaaaatcccaacga

SEQ ID NO: 654712 - DNA, 25 bp, Homo sapien
tcagggctgttaaaatcccaacgac

SEQ ID NO: 654713 - DNA, 25 bp, Homo sapien
agctggtggagcttcagaagtcctg

SEQ ID NO: 654714 - DNA, 25 bp, Homo sapien
gctggtggagcttcagaagtcctgt

SEQ ID NO: 654715 - DNA, 25 bp, Homo sapien
tggagcttcagaagtcctgtggagc

SEQ ID NO: 654716 - DNA, 25 bp, Homo sapien
gagcttcagaagtcctgtggagcgt

SEQ ID NO: 654717 - DNA, 25 bp, Homo sapien
agcttcagaagtcctgtggagcgtc

SEQ ID NO: 654718 - DNA, 25 bp, Homo sapien
tcagaagtcctgtggagcgtcggct

SEQ ID NO: 654719 - DNA, 25 bp, Homo sapien
aagtcctgtggagcgtcggctggga

SEQ ID NO: 654720 - DNA, 25 bp, Homo sapien
gtggagcgtcggctgggatcagttt

SEQ ID NO: 654721 - DNA, 25 bp, Homo sapien
accattcaagaccaggaagcccact

SEQ ID NO: 654722 - DNA, 25 bp, Homo sapien
ccattcaagaccaggaagcccactt

SEQ ID NO: 654723 - DNA, 25 bp, Homo sapien
gaagcccactttcaccccttctatt

SEQ ID NO: 654724 - DNA, 25 bp, Homo sapien
tgaaacgcaggcctgcgtgctaaat

SEQ ID NO: 654725 - DNA, 25 bp, Homo sapien
gtgctaaatcccacgctcagcaaat

SEQ ID NO: 654726 - DNA, 25 bp, Homo sapien
cgctgcgtgcttggaaagccgtgat

SEQ ID NO: 654727 - DNA, 25 bp, Homo sapien
gaaagccgtgatacaggctgctcat

SEQ ID NO: 654728 - DNA, 25 bp, Homo sapien
tgatacaggctgctcattttcccat

SEQ ID NO: 654729 - DNA, 25 bp, Homo sapien
tacaggctgctcattttcccatgag

SEQ ID NO: 654730 - DNA, 25 bp, Homo sapien
gctcattttcccatgagcctgtgta

SEQ ID NO: 654731 - DNA, 25 bp, Homo sapien
catgagcctgtgtattttacatgta

SEQ ID NO: 654732 - DNA, 25 bp, Homo sapien
tacatatatcctttcatatgtgtgg

SEQ ID NO: 654733 - DNA, 25 bp, Homo sapien
catatgtgtggctatttcttaattt

SEQ ID NO: 654734 - DNA, 25 bp, Homo sapien
tttaaaacaaatgcggaggctgggc

SEQ ID NO: 654735 - DNA, 25 bp, Homo sapien
agaaatgcactttctaccatgcctc

SEQ ID NO: 654736 - DNA, 25 bp, Homo sapien
aaatgcactttctaccatgcctcgc

SEQ ID NO: 654737 - DNA, 25 bp, Homo sapien
tgaagcagaacctcaggagcagagc

SEQ ID NO: 654738 - DNA, 25 bp, Homo sapien
aagcagaacctcaggagcagagccc

SEQ ID NO: 654739 - DNA, 25 bp, Homo sapien
gtgttttaaccagctctccagatgc

SEQ ID NO: 654740 - DNA, 25 bp, Homo sapien
gttttaaccagctctccagatgctt

SEQ ID NO: 654741 - DNA, 25 bp, Homo sapien
ttaaccagctctccagatgcttctg

SEQ ID NO: 654742 - DNA, 25 bp, Homo sapien
cagatgcttctgatgcacctggagt

SEQ ID NO: 654743 - DNA, 25 bp, Homo sapien
gatgcttctgatgcacctggagttg

SEQ ID NO: 654744 - DNA, 25 bp, Homo sapien
acctggagttggagagccactgcct

SEQ ID NO: 654745 - DNA, 25 bp, Homo sapien
gtgctcctgagaactgttgacctgc

SEQ ID NO: 654746 - DNA, 25 bp, Homo sapien
gcaagacggaaacgacaaaggacct

SEQ ID NO: 654747 - DNA, 25 bp, Homo sapien
tgatgagtttaatcggatcgacatt

SEQ ID NO: 654748 - DNA, 25 bp, Homo sapien
taatcggatcgacattgaggtgcta

SEQ ID NO: 654749 - DNA, 25 bp, Homo sapien
aatcggatcgacattgaggtgctat

SEQ ID NO: 654750 - DNA, 25 bp, Homo sapien
atcggatcgacattgaggtgctatc

SEQ ID NO: 654751 - DNA, 25 bp, Homo sapien
ggatcgacattgaggtgctatcggt

SEQ ID NO: 654752 - DNA, 25 bp, Homo sapien
tcgacattgaggtgctatcggtggt

SEQ ID NO: 654753 - DNA, 25 bp, Homo sapien
aggtgctatcggtggtggcacagca

SEQ ID NO: 654754 - DNA, 25 bp, Homo sapien
cacagcaacagagggtggaacgctt

SEQ ID NO: 654755 - DNA, 25 bp, Homo sapien
catgtttgagggtgttgaaatcccc

SEQ ID NO: 654756 - DNA, 25 bp, Homo sapien
tgagggtgttgaaatcccccttgta

SEQ ID NO: 654757 - DNA, 25 bp, Homo sapien
atcacaaaagacaatcatgcagtag

SEQ ID NO: 654758 - DNA, 25 bp, Homo sapien
aaagacaatcatgcagtagataatt

SEQ ID NO: 654759 - DNA, 25 bp, Homo sapien
gacaatcatgcagtagataattaag

SEQ ID NO: 654760 - DNA, 25 bp, Homo sapien
tgtgtctaagtataatggaagcatt

SEQ ID NO: 654761 - DNA, 25 bp, Homo sapien
gtataatggaagcattcaaatgttt

SEQ ID NO: 654762 - DNA, 25 bp, Homo sapien
tgtttgttttaagctttctaataca

SEQ ID NO: 654763 - DNA, 25 bp, Homo sapien
ttatttgtacagatcaagacttact

SEQ ID NO: 654764 - DNA, 25 bp, Homo sapien
atttgtacagatcaagacttactaa

SEQ ID NO: 654765 - DNA, 25 bp, Homo sapien
gtacagatcaagacttactaatatg

SEQ ID NO: 654766 - DNA, 25 bp, Homo sapien
gatcaagacttactaatatgctaaa

SEQ ID NO: 654767 - DNA, 25 bp, Homo sapien
agacttactaatatgctaaaaagga

SEQ ID NO: 654768 - DNA, 25 bp, Homo sapien
gactttgtaatagccatgggctggg

SEQ ID NO: 654769 - DNA, 25 bp, Homo sapien
ctttgtaatagccatgggctgggct

SEQ ID NO: 654770 - DNA, 25 bp, Homo sapien
tttgtaatagccatgggctgggctc

SEQ ID NO: 654771 - DNA, 25 bp, Homo sapien
ttgtaatagccatgggctgggctca

SEQ ID NO: 654772 - DNA, 25 bp, Homo sapien
tgtaatagccatgggctgggctcag

SEQ ID NO: 654773 - DNA, 25 bp, Homo sapien
gtaatagccatgggctgggctcagt

SEQ ID NO: 654774 - DNA, 25 bp, Homo sapien
taatagccatgggctgggctcagtg

SEQ ID NO: 654775 - DNA, 25 bp, Homo sapien
atagccatgggctgggctcagtgac

SEQ ID NO: 654776 - DNA, 25 bp, Homo sapien
tagccatgggctgggctcagtgact

SEQ ID NO: 654777 - DNA, 25 bp, Homo sapien
agccatgggctgggctcagtgactc

SEQ ID NO: 654778 - DNA, 25 bp, Homo sapien
gccatgggctgggctcagtgactca

SEQ ID NO: 654779 - DNA, 25 bp, Homo sapien
agacccaggacttcattgacagcaa

SEQ ID NO: 654780 - DNA, 25 bp, Homo sapien
gggcgcaactttatcttcttcatcg

SEQ ID NO: 654781 - DNA, 25 bp, Homo sapien
tcttcttcatcgatgacctgaacat

SEQ ID NO: 654782 - DNA, 25 bp, Homo sapien
tgacctgaacatgccggccctggag

SEQ ID NO: 654783 - DNA, 25 bp, Homo sapien
gctgttgcgccagtggatggaccat

SEQ ID NO: 654784 - DNA, 25 bp, Homo sapien
tggtacgaccgcaagatcattggtg

SEQ ID NO: 654785 - DNA, 25 bp, Homo sapien
tacgaccgcaagatcattggtgcct

SEQ ID NO: 654786 - DNA, 25 bp, Homo sapien
gaccgcaagatcattggtgccttca

SEQ ID NO: 654787 - DNA, 25 bp, Homo sapien
ccgcaagatcattggtgccttcaag

SEQ ID NO: 654788 - DNA, 25 bp, Homo sapien
caagatcattggtgccttcaagaac

SEQ ID NO: 654789 - DNA, 25 bp, Homo sapien
acatcaactttgtctgtgccatggg

SEQ ID NO: 654790 - DNA, 25 bp, Homo sapien
ggatcccctgagcccgggattcaag

SEQ ID NO: 654791 - DNA, 25 bp, Homo sapien
cactgtactgcagctgaggcaataa

SEQ ID NO: 654792 - DNA, 25 bp, Homo sapien
gtactgcagctgaggcaataaaacg

SEQ ID NO: 654793 - DNA, 25 bp, Homo sapien
gcaataaaacgaggccctgtctcta

SEQ ID NO: 654794 - DNA, 25 bp, Homo sapien
aaaaggctgcacagaatagactgat

SEQ ID NO: 654795 - DNA, 25 bp, Homo sapien
gctgcacagaatagactgatggact

SEQ ID NO: 654796 - DNA, 25 bp, Homo sapien
actgatggactgaaggctctgccct

SEQ ID NO: 654797 - DNA, 25 bp, Homo sapien
aggctctgcccttatcaaacattta

SEQ ID NO: 654798 - DNA, 25 bp, Homo sapien
gctctgcccttatcaaacatttact

SEQ ID NO: 654799 - DNA, 25 bp, Homo sapien
tctgcccttatcaaacatttactaa

SEQ ID NO: 654800 - DNA, 25 bp, Homo sapien
gcccttatcaaacatttactaagta

SEQ ID NO: 654801 - DNA, 25 bp, Homo sapien
ggccgactctacttgatgggcacga

SEQ ID NO: 654802 - DNA, 25 bp, Homo sapien
aagagaatacgagctccctgtagct

SEQ ID NO: 654803 - DNA, 25 bp, Homo sapien
agaatacgagctccctgtagctccc

SEQ ID NO: 654804 - DNA, 25 bp, Homo sapien
tgtagctcccgcgtgtcagacaatt

SEQ ID NO: 654805 - DNA, 25 bp, Homo sapien
gtagctcccgcgtgtcagacaattt

SEQ ID NO: 654806 - DNA, 25 bp, Homo sapien
agctcccgcgtgtcagacaatttgt

SEQ ID NO: 654807 - DNA, 25 bp, Homo sapien
ctcccgcgtgtcagacaatttgtcc

SEQ ID NO: 654808 - DNA, 25 bp, Homo sapien
caattaccacagtcctcctaaggaa

SEQ ID NO: 654809 - DNA, 25 bp, Homo sapien
gggtaacttccatcaggagccagtc

SEQ ID NO: 654810 - DNA, 25 bp, Homo sapien
ggtaacttccatcaggagccagtcc

SEQ ID NO: 654811 - DNA, 25 bp, Homo sapien
tccccaccagtgagactctagagga

SEQ ID NO: 654812 - DNA, 25 bp, Homo sapien
acttgagttaataattcagttataa

SEQ ID NO: 654813 - DNA, 25 bp, Homo sapien
tttaaggaaccaagacatttataat

SEQ ID NO: 654814 - DNA, 25 bp, Homo sapien
taaggaaccaagacatttataataa

SEQ ID NO: 654815 - DNA, 25 bp, Homo sapien
tctaactataaaaggactaccttag

SEQ ID NO: 654816 - DNA, 25 bp, Homo sapien
aaaggactaccttagtattctacat

SEQ ID NO: 654817 - DNA, 25 bp, Homo sapien
aaggactaccttagtattctacata

SEQ ID NO: 654818 - DNA, 25 bp, Homo sapien
aggactaccttagtattctacataa

SEQ ID NO: 654819 - DNA, 25 bp, Homo sapien
ggactaccttagtattctacataat

SEQ ID NO: 654820 - DNA, 25 bp, Homo sapien
gactaccttagtattctacataata

SEQ ID NO: 654821 - DNA, 25 bp, Homo sapien
accttagtattctacataatatttg

SEQ ID NO: 654822 - DNA, 25 bp, Homo sapien
gtattctacataatatttgtggttt

SEQ ID NO: 654823 - DNA, 25 bp, Homo sapien
aacgtttaaaagttcatctgataat

SEQ ID NO: 654824 - DNA, 25 bp, Homo sapien
gttcatctgataatactgctaccat

SEQ ID NO: 654825 - DNA, 25 bp, Homo sapien
actgctaccatagttttgttttcac

SEQ ID NO: 654826 - DNA, 25 bp, Homo sapien
tgttttcactgctcatctcttatta

SEQ ID NO: 654827 - DNA, 25 bp, Homo sapien
tcactgctcatctcttattaaggtt

SEQ ID NO: 654828 - DNA, 25 bp, Homo sapien
gacacaaattgataacttagtatag

SEQ ID NO: 654829 - DNA, 25 bp, Homo sapien
cataagtttgatgatatccttgtta

SEQ ID NO: 654830 - DNA, 25 bp, Homo sapien
gatgatatccttgttaatgtactga

SEQ ID NO: 654831 - DNA, 25 bp, Homo sapien
ccttgttaatgtactgatttttgaa

SEQ ID NO: 654832 - DNA, 25 bp, Homo sapien
atttgccataatccatatatttcta

SEQ ID NO: 654833 - DNA, 25 bp, Homo sapien
ttctaacatgagtattttgacagta

SEQ ID NO: 654834 - DNA, 25 bp, Homo sapien
ggtaacttcactcagagacctcggt

SEQ ID NO: 654835 - DNA, 25 bp, Homo sapien
cagagacctcggtttgtccaagggt

SEQ ID NO: 654836 - DNA, 25 bp, Homo sapien
tttgtccaagggttcacagctcagg

SEQ ID NO: 654837 - DNA, 25 bp, Homo sapien
aacccagatgggtcacatcccagaa

SEQ ID NO: 654838 - DNA, 25 bp, Homo sapien
aggagactccccacttcgaaggtag

SEQ ID NO: 654839 - DNA, 25 bp, Homo sapien
gaaggtagctctgagcatcctcaaa

SEQ ID NO: 654840 - DNA, 25 bp, Homo sapien
atcctcaaacacctggccattatta

SEQ ID NO: 654841 - DNA, 25 bp, Homo sapien
cctggccattattagctgagcaaga

SEQ ID NO: 654842 - DNA, 25 bp, Homo sapien
taaaccttattttgcacgctgacct

SEQ ID NO: 654843 - DNA, 25 bp, Homo sapien
ttgcacgctgacctatattatcaag

SEQ ID NO: 654844 - DNA, 25 bp, Homo sapien
acaggtttcgttttcattctgtcgc

SEQ ID NO: 654845 - DNA, 25 bp, Homo sapien
gagctcttggccttgcgccgaggcc

SEQ ID NO: 654846 - DNA, 25 bp, Homo sapien
gccttgcgccgaggccggtacttgt

SEQ ID NO: 654847 - DNA, 25 bp, Homo sapien
gccgaggccggtacttgtagtcggg

SEQ ID NO: 654848 - DNA, 25 bp, Homo sapien
actgcgcgcccaggcgcttggagat

SEQ ID NO: 654849 - DNA, 25 bp, Homo sapien
ggagatctcggagttgtgcatcttg

SEQ ID NO: 654850 - DNA, 25 bp, Homo sapien
ttctgctgcgccatctggcggcgct

SEQ ID NO: 654851 - DNA, 25 bp, Homo sapien
ggcgctgagcggagctccacaccat

SEQ ID NO: 654852 - DNA, 25 bp, Homo sapien
agctccacaccatgaacgcgttcat

SEQ ID NO: 654853 - DNA, 25 bp, Homo sapien
atgaacgcgttcatcggccgcttca

SEQ ID NO: 654854 - DNA, 25 bp, Homo sapien
tgaacgcgttcatcggccgcttcac

SEQ ID NO: 654855 - DNA, 25 bp, Homo sapien
aacccctttcctggtgcctgttgct

SEQ ID NO: 654856 - DNA, 25 bp, Homo sapien
acacttaagtgctttctgcatctat

SEQ ID NO: 654857 - DNA, 25 bp, Homo sapien
agtgctttctgcatctatttaggag

SEQ ID NO: 654858 - DNA, 25 bp, Homo sapien
ttaggagtctatttcttaccaataa

SEQ ID NO: 654859 - DNA, 25 bp, Homo sapien
aacttgacaacgcatttggaaaact

SEQ ID NO: 654860 - DNA, 25 bp, Homo sapien
actagtgaacaccttacagctttca

SEQ ID NO: 654861 - DNA, 25 bp, Homo sapien
aatgtttcaattcaagccggtgtaa

SEQ ID NO: 654862 - DNA, 25 bp, Homo sapien
tctgtttattctttagtaatctcac

SEQ ID NO: 654863 - DNA, 25 bp, Homo sapien
gtaatctcactactggctatgtcag

SEQ ID NO: 654864 - DNA, 25 bp, Homo sapien
ggctatgtcagcaatatctttttca

SEQ ID NO: 654865 - DNA, 25 bp, Homo sapien
atctttttcaatctggttccttttg

SEQ ID NO: 654866 - DNA, 25 bp, Homo sapien
aatctggttccttttgtatatgatg

SEQ ID NO: 654867 - DNA, 25 bp, Homo sapien
tgttgcccgccgatcacagccggaa

SEQ ID NO: 654868 - DNA, 25 bp, Homo sapien
gatcacagccggaatgcagctgaaa

SEQ ID NO: 654869 - DNA, 25 bp, Homo sapien
gcagctgaaagattccctggggcct

SEQ ID NO: 654870 - DNA, 25 bp, Homo sapien
cactgtggactctgaggcctctgca

SEQ ID NO: 654871 - DNA, 25 bp, Homo sapien
tgtggactctgaggcctctgcattt

SEQ ID NO: 654872 - DNA, 25 bp, Homo sapien
gtggtctgcctgtgatattttggtc

SEQ ID NO: 654873 - DNA, 25 bp, Homo sapien
ggtctgcctgtgatattttggtcat

SEQ ID NO: 654874 - DNA, 25 bp, Homo sapien
tctgcctgtgatattttggtcatgg

SEQ ID NO: 654875 - DNA, 25 bp, Homo sapien
gcctgtgatattttggtcatgggct

SEQ ID NO: 654876 - DNA, 25 bp, Homo sapien
ggtttcccatttgtctggccagtct

SEQ ID NO: 654877 - DNA, 25 bp, Homo sapien
tttcccatttgtctggccagtctct

SEQ ID NO: 654878 - DNA, 25 bp, Homo sapien
aaccatcaagtttaaagactgcttt

SEQ ID NO: 654879 - DNA, 25 bp, Homo sapien
accatcaagtttaaagactgctttg

SEQ ID NO: 654880 - DNA, 25 bp, Homo sapien
tcaagtttaaagactgctttgtggc

SEQ ID NO: 654881 - DNA, 25 bp, Homo sapien
taaagactgctttgtggctaggcga

SEQ ID NO: 654882 - DNA, 25 bp, Homo sapien
tgctttgtggctaggcgaagtggct

SEQ ID NO: 654883 - DNA, 25 bp, Homo sapien
gcatgcctccatagtcccagatact

SEQ ID NO: 654884 - DNA, 25 bp, Homo sapien
ttgcttgagcccacagatataagcc

SEQ ID NO: 654885 - DNA, 25 bp, Homo sapien
gatataagcccagacgcctgggcga

SEQ ID NO: 654886 - DNA, 25 bp, Homo sapien
atataagcccagacgcctgggcgag

SEQ ID NO: 654887 - DNA, 25 bp, Homo sapien
tataagcccagacgcctgggcgaga

SEQ ID NO: 654888 - DNA, 25 bp, Homo sapien
aagcccagacgcctgggcgagagtg

SEQ ID NO: 654889 - DNA, 25 bp, Homo sapien
gtagttgaattacctcactctgtca

SEQ ID NO: 654890 - DNA, 25 bp, Homo sapien
gaattacctcactctgtcaacagta

SEQ ID NO: 654891 - DNA, 25 bp, Homo sapien
acctcactctgtcaacagtaagctg

SEQ ID NO: 654892 - DNA, 25 bp, Homo sapien
cactctgtcaacagtaagctgtaaa

SEQ ID NO: 654893 - DNA, 25 bp, Homo sapien
aaatgggcactttatgtctcagaat

SEQ ID NO: 654894 - DNA, 25 bp, Homo sapien
gggcactttatgtctcagaattact

SEQ ID NO: 654895 - DNA, 25 bp, Homo sapien
ctttatgtctcagaattactcaaat

SEQ ID NO: 654896 - DNA, 25 bp, Homo sapien
taatgaataggtctctccttctcct

SEQ ID NO: 654897 - DNA, 25 bp, Homo sapien
taaaacttccctccatggctaagag

SEQ ID NO: 654898 - DNA, 25 bp, Homo sapien
aacttccctccatggctaagaggga

SEQ ID NO: 654899 - DNA, 25 bp, Homo sapien
ggctaagagggaaaacgcttacatt

SEQ ID NO: 654900 - DNA, 25 bp, Homo sapien
tcaaatctcatcctgtagatcccac

SEQ ID NO: 654901 - DNA, 25 bp, Homo sapien
atctcatcctgtagatcccacaatt

SEQ ID NO: 654902 - DNA, 25 bp, Homo sapien
gtacctggtgggaaatgactgaata

SEQ ID NO: 654903 - DNA, 25 bp, Homo sapien
gaataatggagatgggtatttccca

SEQ ID NO: 654904 - DNA, 25 bp, Homo sapien
gagatgggtatttcccatgctgttc

SEQ ID NO: 654905 - DNA, 25 bp, Homo sapien
gtcatagtggatgggtctcatgaga

SEQ ID NO: 654906 - DNA, 25 bp, Homo sapien
tttcctgacacaagctctctcttag

SEQ ID NO: 654907 - DNA, 25 bp, Homo sapien
tgacacaagctctctcttagcctgc

SEQ ID NO: 654908 - DNA, 25 bp, Homo sapien
atgtgacttgctcctacttaccttt

SEQ ID NO: 654909 - DNA, 25 bp, Homo sapien
ctcctacttacctttcaccatgatt

SEQ ID NO: 654910 - DNA, 25 bp, Homo sapien
ctgtaagttgattaaacctccttct

SEQ ID NO: 654911 - DNA, 25 bp, Homo sapien
ccttcccagtttctcttagagtcaa

SEQ ID NO: 654912 - DNA, 25 bp, Homo sapien
cttagagtcaaatcgcagtgtggta

SEQ ID NO: 654913 - DNA, 25 bp, Homo sapien
gaaaggagcctctccgtgaccatag

SEQ ID NO: 654914 - DNA, 25 bp, Homo sapien
tctccgtgaccataggcagctacct

SEQ ID NO: 654915 - DNA, 25 bp, Homo sapien
tttttggatctcagcttccccgtag

SEQ ID NO: 654916 - DNA, 25 bp, Homo sapien
acacatccattaggcaccatgcgta

SEQ ID NO: 654917 - DNA, 25 bp, Homo sapien
attaggcaccatgcgtagggtccac

SEQ ID NO: 654918 - DNA, 25 bp, Homo sapien
atgcgtagggtccacagtgctttta

SEQ ID NO: 654919 - DNA, 25 bp, Homo sapien
cagtgcttttacaggcctgccaaat

SEQ ID NO: 654920 - DNA, 25 bp, Homo sapien
ggcctgccaaatgctgtaatatctt

SEQ ID NO: 654921 - DNA, 25 bp, Homo sapien
ttcatctttatacccatgcagttaa

SEQ ID NO: 654922 - DNA, 25 bp, Homo sapien
agttgattaaagtaattctgcttcc

SEQ ID NO: 654923 - DNA, 25 bp, Homo sapien
gtaattctgcttccactttattttc

SEQ ID NO: 654924 - DNA, 25 bp, Homo sapien
taattctgcttccactttattttca

SEQ ID NO: 654925 - DNA, 25 bp, Homo sapien
aattctgcttccactttattttcaa

SEQ ID NO: 654926 - DNA, 25 bp, Homo sapien
tattttcaaagacactaattgctac

SEQ ID NO: 654927 - DNA, 25 bp, Homo sapien
ttcaaagacactaattgctacactg

SEQ ID NO: 654928 - DNA, 25 bp, Homo sapien
aaagacactaattgctacactgaat

SEQ ID NO: 654929 - DNA, 25 bp, Homo sapien
agacactaattgctacactgaataa

SEQ ID NO: 654930 - DNA, 25 bp, Homo sapien
ttgtttcattattgcttgttagttg

SEQ ID NO: 654931 - DNA, 25 bp, Homo sapien
gtttcattattgcttgttagttgat

SEQ ID NO: 654932 - DNA, 25 bp, Homo sapien
cattattgcttgttagttgattaaa

SEQ ID NO: 654933 - DNA, 25 bp, Homo sapien
gggctggctctctgtactcgcctct

SEQ ID NO: 654934 - DNA, 25 bp, Homo sapien
tctgtactcgcctctcgatgggtgc

SEQ ID NO: 654935 - DNA, 25 bp, Homo sapien
gtactcgcctctcgatgggtgcctc

SEQ ID NO: 654936 - DNA, 25 bp, Homo sapien
gtaagagggcctagctctgagtccc

SEQ ID NO: 654937 - DNA, 25 bp, Homo sapien
agagggcctagctctgagtcccttc

SEQ ID NO: 654938 - DNA, 25 bp, Homo sapien
tgagtcccttcctctcggcgggtgc

SEQ ID NO: 654939 - DNA, 25 bp, Homo sapien
ctgcgatggcggtcccaagtgtcag

SEQ ID NO: 654940 - DNA, 25 bp, Homo sapien
tggctgtcactcctcggctcgtgga

SEQ ID NO: 654941 - DNA, 25 bp, Homo sapien
actcctcggctcgtggaggctgtct

SEQ ID NO: 654942 - DNA, 25 bp, Homo sapien
ggctcgtggaggctgtctcccacca

SEQ ID NO: 654943 - DNA, 25 bp, Homo sapien
ggctgtctcccaccactgcgatggg

SEQ ID NO: 654944 - DNA, 25 bp, Homo sapien
gagaaattaattgccaaccaggagg

SEQ ID NO: 654945 - DNA, 25 bp, Homo sapien
aattaattgccaaccaggaggagtt

SEQ ID NO: 654946 - DNA, 25 bp, Homo sapien
aaccaggaggagttgggctgtattt

SEQ ID NO: 654947 - DNA, 25 bp, Homo sapien
gaggagttgggctgtatttttcaaa

SEQ ID NO: 654948 - DNA, 25 bp, Homo sapien
ttgggctgtatttttcaaaggtggg

SEQ ID NO: 654949 - DNA, 25 bp, Homo sapien
agagtggagcacacaccttgaggag

SEQ ID NO: 654950 - DNA, 25 bp, Homo sapien
gagcacacaccttgaggaggaaagc

SEQ ID NO: 654951 - DNA, 25 bp, Homo sapien
gggaattcagcggatcagtcttaag

SEQ ID NO: 654952 - DNA, 25 bp, Homo sapien
attcagcggatcagtcttaagagga

SEQ ID NO: 654953 - DNA, 25 bp, Homo sapien
gcggatcagtcttaagaggagcttt

SEQ ID NO: 654954 - DNA, 25 bp, Homo sapien
gatcagtcttaagaggagctttttt

SEQ ID NO: 654955 - DNA, 25 bp, Homo sapien
aaggtgtggactgtgttatacccaa

SEQ ID NO: 654956 - DNA, 25 bp, Homo sapien
ggactgtgttatacccaagagtaca

SEQ ID NO: 654957 - DNA, 25 bp, Homo sapien
gttatacccaagagtacataggatg

SEQ ID NO: 654958 - DNA, 25 bp, Homo sapien
taggatgaaaaaagccacgacagag

SEQ ID NO: 654959 - DNA, 25 bp, Homo sapien
gggaagaacacaaaatcagctctgt

SEQ ID NO: 654960 - DNA, 25 bp, Homo sapien
aatcagctctgtgtccaagtagcaa

SEQ ID NO: 654961 - DNA, 25 bp, Homo sapien
agcagtcctgcttcattagtcaatt

SEQ ID NO: 654962 - DNA, 25 bp, Homo sapien
gtcctgcttcattagtcaattaaaa

SEQ ID NO: 654963 - DNA, 25 bp, Homo sapien
aaaattctttggtcttaagagatgt

SEQ ID NO: 654964 - DNA, 25 bp, Homo sapien
tcttaagagatgtaacttgggctgg

SEQ ID NO: 654965 - DNA, 25 bp, Homo sapien
caggcgggaggatggtccgaggcca

SEQ ID NO: 654966 - DNA, 25 bp, Homo sapien
tatagaatagtagtataatgaacct

SEQ ID NO: 654967 - DNA, 25 bp, Homo sapien
atagaatagtagtataatgaacctc

SEQ ID NO: 654968 - DNA, 25 bp, Homo sapien
tagaatagtagtataatgaacctca

SEQ ID NO: 654969 - DNA, 25 bp, Homo sapien
agaatagtagtataatgaacctcat

SEQ ID NO: 654970 - DNA, 25 bp, Homo sapien
tagtcttattttcttccctcccata

SEQ ID NO: 654971 - DNA, 25 bp, Homo sapien
tgtgttaaaatctctgtgtgtattg

SEQ ID NO: 654972 - DNA, 25 bp, Homo sapien
gtgttaaaatctctgtgtgtattgt

SEQ ID NO: 654973 - DNA, 25 bp, Homo sapien
tgttaaaatctctgtgtgtattgtt

SEQ ID NO: 654974 - DNA, 25 bp, Homo sapien
gttaaaatctctgtgtgtattgttt

SEQ ID NO: 654975 - DNA, 25 bp, Homo sapien
ttaaaatctctgtgtgtattgtttt

SEQ ID NO: 654976 - DNA, 25 bp, Homo sapien
attgtcattgacatgtagggtatgt

SEQ ID NO: 654977 - DNA, 25 bp, Homo sapien
ttgtcattgacatgtagggtatgtt

SEQ ID NO: 654978 - DNA, 25 bp, Homo sapien
gtcattgacatgtagggtatgtttc

SEQ ID NO: 654979 - DNA, 25 bp, Homo sapien
cattgacatgtagggtatgtttcaa

SEQ ID NO: 654980 - DNA, 25 bp, Homo sapien
gacatgtagggtatgtttcaagtca

SEQ ID NO: 654981 - DNA, 25 bp, Homo sapien
atgtagggtatgtttcaagtcatag

SEQ ID NO: 654982 - DNA, 25 bp, Homo sapien
caagtcataggatcagaagataaaa

SEQ ID NO: 654983 - DNA, 25 bp, Homo sapien
ggatcagaagataaaatgccaagct

SEQ ID NO: 654984 - DNA, 25 bp, Homo sapien
aaaatgccaagctggcaaggtggct

SEQ ID NO: 654985 - DNA, 25 bp, Homo sapien
atgccaagctggcaaggtggctcat

SEQ ID NO: 654986 - DNA, 25 bp, Homo sapien
ggactaccttagtattctacataat

SEQ ID NO: 654987 - DNA, 25 bp, Homo sapien
actgtacttgcatgtttgagggaca

SEQ ID NO: 654988 - DNA, 25 bp, Homo sapien
gtacttgcatgtttgagggacagca

SEQ ID NO: 654989 - DNA, 25 bp, Homo sapien
tgagggacagcagggtgcccagtgt

SEQ ID NO: 654990 - DNA, 25 bp, Homo sapien
aatagtaagaaatggcctgtaggac

SEQ ID NO: 654991 - DNA, 25 bp, Homo sapien
aaatggcctgtaggactgactcagt

SEQ ID NO: 654992 - DNA, 25 bp, Homo sapien
atggcctgtaggactgactcagtga

SEQ ID NO: 654993 - DNA, 25 bp, Homo sapien
cctgtaggactgactcagtgaggta

SEQ ID NO: 654994 - DNA, 25 bp, Homo sapien
agatattaaagggtttcgagcaaag

SEQ ID NO: 654995 - DNA, 25 bp, Homo sapien
gtttcgagcaaagggatgagataat

SEQ ID NO: 654996 - DNA, 25 bp, Homo sapien
gataatcctggaaatttggttgcct

SEQ ID NO: 654997 - DNA, 25 bp, Homo sapien
taatcctggaaatttggttgccttc

SEQ ID NO: 654998 - DNA, 25 bp, Homo sapien
gcccgggcaggtactggatgtcagg

SEQ ID NO: 654999 - DNA, 25 bp, Homo sapien
actggatgtcaggtctgcgaaactt

SEQ ID NO: 655000 - DNA, 25 bp, Homo sapien
ctggatgtcaggtctgcgaaacttc

SEQ ID NO: 655001 - DNA, 25 bp, Homo sapien
tggatgtcaggtctgcgaaacttct

SEQ ID NO: 655002 - DNA, 25 bp, Homo sapien
ggatgtcaggtctgcgaaacttctt

SEQ ID NO: 655003 - DNA, 25 bp, Homo sapien
gatgtcaggtctgcgaaacttctta

SEQ ID NO: 655004 - DNA, 25 bp, Homo sapien
atgtcaggtctgcgaaacttcttag

SEQ ID NO: 655005 - DNA, 25 bp, Homo sapien
tgtcaggtctgcgaaacttcttaga

SEQ ID NO: 655006 - DNA, 25 bp, Homo sapien
gtcaggtctgcgaaacttcttagat

SEQ ID NO: 655007 - DNA, 25 bp, Homo sapien
tcaggtctgcgaaacttcttagatt

SEQ ID NO: 655008 - DNA, 25 bp, Homo sapien
agacgtcctcctcactatggtggga

SEQ ID NO: 655009 - DNA, 25 bp, Homo sapien
ggtgggatcagctgcaaagcgaact

SEQ ID NO: 655010 - DNA, 25 bp, Homo sapien
aaagcgaactgtcccatgctcatgt

SEQ ID NO: 655011 - DNA, 25 bp, Homo sapien
gttagctctttctggtgccgatgaa

SEQ ID NO: 655012 - DNA, 25 bp, Homo sapien
ggtgccgatgaatttcaaacgcgaa

SEQ ID NO: 655013 - DNA, 25 bp, Homo sapien
atgtgggtttgcactagacatttcc

SEQ ID NO: 655014 - DNA, 25 bp, Homo sapien
agacatttccatgcctggagctatt

SEQ ID NO: 655015 - DNA, 25 bp, Homo sapien
ccatgcctggagctatttttctggg

SEQ ID NO: 655016 - DNA, 25 bp, Homo sapien
ggtagttccctcatgtgggtactag

SEQ ID NO: 655017 - DNA, 25 bp, Homo sapien
tgggtactagttcccacagagtagc

SEQ ID NO: 655018 - DNA, 25 bp, Homo sapien
gaactttgattgtaacactgcactt

SEQ ID NO: 655019 - DNA, 25 bp, Homo sapien
tgatacctctgcaacttggcacctc

SEQ ID NO: 655020 - DNA, 25 bp, Homo sapien
gttggtttggcccatcaggactaat

SEQ ID NO: 655021 - DNA, 25 bp, Homo sapien
caggactaatattacccctcatatc

SEQ ID NO: 655022 - DNA, 25 bp, Homo sapien
taatattacccctcatatcctagtc

SEQ ID NO: 655023 - DNA, 25 bp, Homo sapien
atatcctagtctctcttgtaggcag

SEQ ID NO: 655024 - DNA, 25 bp, Homo sapien
ataatgaacctccatgtacccaaca

SEQ ID NO: 655025 - DNA, 25 bp, Homo sapien
tccatgtacccaacacccggattaa

SEQ ID NO: 655026 - DNA, 25 bp, Homo sapien
cacccggattaaacagttatctcaa

SEQ ID NO: 655027 - DNA, 25 bp, Homo sapien
ttatctcaattttgccagacttgtt

SEQ ID NO: 655028 - DNA, 25 bp, Homo sapien
tttgccagacttgtttcatctactt

SEQ ID NO: 655029 - DNA, 25 bp, Homo sapien
atctacttcaatctccctaaacatt

SEQ ID NO: 655030 - DNA, 25 bp, Homo sapien
tcttcctttctttcaaaggtttgca

SEQ ID NO: 655031 - DNA, 25 bp, Homo sapien
tttctttcaaaggtttgcattaact

SEQ ID NO: 655032 - DNA, 25 bp, Homo sapien
ggaaaactgagaaaacccatattct

SEQ ID NO: 655033 - DNA, 25 bp, Homo sapien
gaaaacccatattctcctaatacaa

SEQ ID NO: 655034 - DNA, 25 bp, Homo sapien
ccatattctcctaatacaacccgta

SEQ ID NO: 655035 - DNA, 25 bp, Homo sapien
acaacccgtaatagcatttttgcct

SEQ ID NO: 655036 - DNA, 25 bp, Homo sapien
agcatttttgcctgcctcgaggcag

SEQ ID NO: 655037 - DNA, 25 bp, Homo sapien
tttttgcctgcctcgaggcagagtt

SEQ ID NO: 655038 - DNA, 25 bp, Homo sapien
tgcctcgaggcagagtttcccgtga

SEQ ID NO: 655039 - DNA, 25 bp, Homo sapien
gcagagtttcccgtgagcaataaac

SEQ ID NO: 655040 - DNA, 25 bp, Homo sapien
gtttcccgtgagcaataaactcagc

SEQ ID NO: 655041 - DNA, 25 bp, Homo sapien
ggcccagcggctggcattagctcta

SEQ ID NO: 655042 - DNA, 25 bp, Homo sapien
agcggctggcattagctctacccgc

SEQ ID NO: 655043 - DNA, 25 bp, Homo sapien
ctgccttctcttctcatatgcaata

SEQ ID NO: 655044 - DNA, 25 bp, Homo sapien
gccttctcttctcatatgcaatatc

SEQ ID NO: 655045 - DNA, 25 bp, Homo sapien
ctcttctcatatgcaatatcagtca

SEQ ID NO: 655046 - DNA, 25 bp, Homo sapien
tcagtcattcacaggggcggccggt

SEQ ID NO: 655047 - DNA, 25 bp, Homo sapien
gggcggccggtctccaaaatgcaaa

SEQ ID NO: 655048 - DNA, 25 bp, Homo sapien
gcggccggtctccaaaatgcaaaat

SEQ ID NO: 655049 - DNA, 25 bp, Homo sapien
gccggtctccaaaatgcaaaatgcg

SEQ ID NO: 655050 - DNA, 25 bp, Homo sapien
aaaatgcaaaatgcgcttcagcccc

SEQ ID NO: 655051 - DNA, 25 bp, Homo sapien
gaaaggaaacccacaaatccaacag

SEQ ID NO: 655052 - DNA, 25 bp, Homo sapien
ataaaggaaaagaacatacgtgtgt

SEQ ID NO: 655053 - DNA, 25 bp, Homo sapien
aaggaaaagaacatacgtgtgttag

SEQ ID NO: 655054 - DNA, 25 bp, Homo sapien
aggaaaagaacatacgtgtgttagg

SEQ ID NO: 655055 - DNA, 25 bp, Homo sapien
ggaaaagaacatacgtgtgttagga

SEQ ID NO: 655056 - DNA, 25 bp, Homo sapien
gaaaagaacatacgtgtgttaggaa

SEQ ID NO: 655057 - DNA, 25 bp, Homo sapien
gaacatacgtgtgttaggaacccct

SEQ ID NO: 655058 - DNA, 25 bp, Homo sapien
catacgtgtgttaggaacccctttg

SEQ ID NO: 655059 - DNA, 25 bp, Homo sapien
tacgtgtgttaggaacccctttgat

SEQ ID NO: 655060 - DNA, 25 bp, Homo sapien
cgtgtgttaggaacccctttgatag

SEQ ID NO: 655061 - DNA, 25 bp, Homo sapien
gtgtgttaggaacccctttgatagg

SEQ ID NO: 655062 - DNA, 25 bp, Homo sapien
tgtgttaggaacccctttgataggg

SEQ ID NO: 655063 - DNA, 25 bp, Homo sapien
tcacttgaactagaaggcaaaggtt

SEQ ID NO: 655064 - DNA, 25 bp, Homo sapien
ttgaactagaaggcaaaggttgcag

SEQ ID NO: 655065 - DNA, 25 bp, Homo sapien
tgaactagaaggcaaaggttgcagt

SEQ ID NO: 655066 - DNA, 25 bp, Homo sapien
gaactagaaggcaaaggttgcagtg

SEQ ID NO: 655067 - DNA, 25 bp, Homo sapien
aactagaaggcaaaggttgcagtga

SEQ ID NO: 655068 - DNA, 25 bp, Homo sapien
actagaaggcaaaggttgcagtgag

SEQ ID NO: 655069 - DNA, 25 bp, Homo sapien
ctagaaggcaaaggttgcagtgagc

SEQ ID NO: 655070 - DNA, 25 bp, Homo sapien
tagaaggcaaaggttgcagtgagcc

SEQ ID NO: 655071 - DNA, 25 bp, Homo sapien
agaaggcaaaggttgcagtgagccc

SEQ ID NO: 655072 - DNA, 25 bp, Homo sapien
gaaggcaaaggttgcagtgagccca

SEQ ID NO: 655073 - DNA, 25 bp, Homo sapien
aaggcaaaggttgcagtgagcccag

SEQ ID NO: 655074 - DNA, 25 bp, Homo sapien
tagtatttagccatattagcatatc

SEQ ID NO: 655075 - DNA, 25 bp, Homo sapien
attagcatatctttagaggaggcct

SEQ ID NO: 655076 - DNA, 25 bp, Homo sapien
gggcctctactagtctgtttttccg

SEQ ID NO: 655077 - DNA, 25 bp, Homo sapien
ctactagtctgtttttccggtcata

SEQ ID NO: 655078 - DNA, 25 bp, Homo sapien
tagtctgtttttccggtcataggaa

SEQ ID NO: 655079 - DNA, 25 bp, Homo sapien
tacgtatcaaagtatgtgtttacag

SEQ ID NO: 655080 - DNA, 25 bp, Homo sapien
ttacagagtgtgatccgtatgcatc

SEQ ID NO: 655081 - DNA, 25 bp, Homo sapien
gatccgtatgcatcaaagggataca

SEQ ID NO: 655082 - DNA, 25 bp, Homo sapien
atacagccccagactgtttctttaa

SEQ ID NO: 655083 - DNA, 25 bp, Homo sapien
gactgtttctttaatggtcattcat

SEQ ID NO: 655084 - DNA, 25 bp, Homo sapien
taaactacatctagatagcctaaac

SEQ ID NO: 655085 - DNA, 25 bp, Homo sapien
accgcgtccagccagctttattatt

SEQ ID NO: 655086 - DNA, 25 bp, Homo sapien
cgcgtccagccagctttattatttt

SEQ ID NO: 655087 - DNA, 25 bp, Homo sapien
ttttttaagctgtctttgtgtcaaa

SEQ ID NO: 655088 - DNA, 25 bp, Homo sapien
gatagttcatgctcctcttgttaaa

SEQ ID NO: 655089 - DNA, 25 bp, Homo sapien
atagttcatgctcctcttgttaaaa

SEQ ID NO: 655090 - DNA, 25 bp, Homo sapien
gttcatgctcctcttgttaaaacct

SEQ ID NO: 655091 - DNA, 25 bp, Homo sapien
tcatgctcctcttgttaaaacctgc

SEQ ID NO: 655092 - DNA, 25 bp, Homo sapien
tgctcctcttgttaaaacctgcagg

SEQ ID NO: 655093 - DNA, 25 bp, Homo sapien
tcctcttgttaaaacctgcaggccg

SEQ ID NO: 655094 - DNA, 25 bp, Homo sapien
tcttgttaaaacctgcaggccgagc

SEQ ID NO: 655095 - DNA, 25 bp, Homo sapien
ttgttaaaacctgcaggccgagcac

SEQ ID NO: 655096 - DNA, 25 bp, Homo sapien
agagccatgaaggacatccactatt

SEQ ID NO: 655097 - DNA, 25 bp, Homo sapien
aaatgaagatagaacgtgctcacat

SEQ ID NO: 655098 - DNA, 25 bp, Homo sapien
atgaagatagaacgtgctcacatga

SEQ ID NO: 655099 - DNA, 25 bp, Homo sapien
tgaagatagaacgtgctcacatgag

SEQ ID NO: 655100 - DNA, 25 bp, Homo sapien
aagatagaacgtgctcacatgaggc

SEQ ID NO: 655101 - DNA, 25 bp, Homo sapien
agatagaacgtgctcacatgaggct

SEQ ID NO: 655102 - DNA, 25 bp, Homo sapien
gatagaacgtgctcacatgaggctt

SEQ ID NO: 655103 - DNA, 25 bp, Homo sapien
atagaacgtgctcacatgaggcttc

SEQ ID NO: 655104 - DNA, 25 bp, Homo sapien
aaagaaaagctcaagccactgatca

SEQ ID NO: 655105 - DNA, 25 bp, Homo sapien
agaaaagctcaagccactgatcaag

SEQ ID NO: 655106 - DNA, 25 bp, Homo sapien
aagattatggccaacagttagaaat

SEQ ID NO: 655107 - DNA, 25 bp, Homo sapien
aaacagttctggagagcagaagcat

SEQ ID NO: 655108 - DNA, 25 bp, Homo sapien
gaagcatcacagtgtacatcccagg

SEQ ID NO: 655109 - DNA, 25 bp, Homo sapien
atcacagtgtacatcccaggaaaga

SEQ ID NO: 655110 - DNA, 25 bp, Homo sapien
attgatcaacagatgacttttccag

SEQ ID NO: 655111 - DNA, 25 bp, Homo sapien
tttggtcttttgttgatgtggattc

SEQ ID NO: 655112 - DNA, 25 bp, Homo sapien
atgtggattcatcttcaaggagaaa

SEQ ID NO: 655113 - DNA, 25 bp, Homo sapien
gaaaatcaacactctaattggtcag

SEQ ID NO: 655114 - DNA, 25 bp, Homo sapien
ctaattggtcagatggattgcagtt

SEQ ID NO: 655115 - DNA, 25 bp, Homo sapien
gattgcagtttgattccagctaacc

SEQ ID NO: 655116 - DNA, 25 bp, Homo sapien
gattccagctaaccttgtggaggca

SEQ ID NO: 655117 - DNA, 25 bp, Homo sapien
accttgtggaggcatttggtttatt

SEQ ID NO: 655118 - DNA, 25 bp, Homo sapien
caattgcttctttacacattataaa

SEQ ID NO: 655119 - DNA, 25 bp, Homo sapien
cacattataaatgtaacctggcatt

SEQ ID NO: 655120 - DNA, 25 bp, Homo sapien
gtaacctggcattatatttaagcta

SEQ ID NO: 655121 - DNA, 25 bp, Homo sapien
ggcattatatttaagctaagaacat

SEQ ID NO: 655122 - DNA, 25 bp, Homo sapien
catgcatgtttttaatactcgaatt

SEQ ID NO: 655123 - DNA, 25 bp, Homo sapien
gcatgtttttaatactcgaatttca

SEQ ID NO: 655124 - DNA, 25 bp, Homo sapien
aaagttctatgttacactagtgtga

SEQ ID NO: 655125 - DNA, 25 bp, Homo sapien
tacactagtgtgatggattttttaa

SEQ ID NO: 655126 - DNA, 25 bp, Homo sapien
gttcatgtagtaatcaaagcatcta

SEQ ID NO: 655127 - DNA, 25 bp, Homo sapien
gtaatcaaagcatctactctaggtt

SEQ ID NO: 655128 - DNA, 25 bp, Homo sapien
atcaaagcatctactctaggttgtt

SEQ ID NO: 655129 - DNA, 25 bp, Homo sapien
gtcactttcctgtctttgggtccct

SEQ ID NO: 655130 - DNA, 25 bp, Homo sapien
cactttcctgtctttgggtccctga

SEQ ID NO: 655131 - DNA, 25 bp, Homo sapien
tttcctgtctttgggtccctgaact

SEQ ID NO: 655132 - DNA, 25 bp, Homo sapien
tcctgtctttgggtccctgaactta

SEQ ID NO: 655133 - DNA, 25 bp, Homo sapien
gtctttgggtccctgaacttaacag

SEQ ID NO: 655134 - DNA, 25 bp, Homo sapien
tttgggtccctgaacttaacagaat

SEQ ID NO: 655135 - DNA, 25 bp, Homo sapien
gggtccctgaacttaacagaattat

SEQ ID NO: 655136 - DNA, 25 bp, Homo sapien
gtccctgaacttaacagaattattt

SEQ ID NO: 655137 - DNA, 25 bp, Homo sapien
agaattatttagttgctgcttagac

SEQ ID NO: 655138 - DNA, 25 bp, Homo sapien
atttagttgctgcttagacagaaat

SEQ ID NO: 655139 - DNA, 25 bp, Homo sapien
ttgctgcttagacagaaatgacttt

SEQ ID NO: 655140 - DNA, 25 bp, Homo sapien
ggttggcccccaatttgagcttgaa

SEQ ID NO: 655141 - DNA, 25 bp, Homo sapien
tggcccccaatttgagcttgaactg

SEQ ID NO: 655142 - DNA, 25 bp, Homo sapien
ccccaatttgagcttgaactgaaaa

SEQ ID NO: 655143 - DNA, 25 bp, Homo sapien
gagcttgaactgaaaaggcatccct

SEQ ID NO: 655144 - DNA, 25 bp, Homo sapien
gcttgaactgaaaaggcatccctgc

SEQ ID NO: 655145 - DNA, 25 bp, Homo sapien
ttgaactgaaaaggcatccctgcat

SEQ ID NO: 655146 - DNA, 25 bp, Homo sapien
gaactgaaaaggcatccctgcatgg

SEQ ID NO: 655147 - DNA, 25 bp, Homo sapien
aactgaaaaggcatccctgcatggt

SEQ ID NO: 655148 - DNA, 25 bp, Homo sapien
actgaaaaggcatccctgcatggtc

SEQ ID NO: 655149 - DNA, 25 bp, Homo sapien
ctgaaaaggcatccctgcatggtca

SEQ ID NO: 655150 - DNA, 25 bp, Homo sapien
gaaaaggcatccctgcatggtcaac

SEQ ID NO: 655151 - DNA, 25 bp, Homo sapien
aaaagtaaaacaaggccaggcgcag

SEQ ID NO: 655152 - DNA, 25 bp, Homo sapien
aaagtaaaacaaggccaggcgcagt

SEQ ID NO: 655153 - DNA, 25 bp, Homo sapien
aagtaaaacaaggccaggcgcagtg

SEQ ID NO: 655154 - DNA, 25 bp, Homo sapien
gaggcagaagattacagtaagccaa

SEQ ID NO: 655155 - DNA, 25 bp, Homo sapien
aggcagaagattacagtaagccaag

SEQ ID NO: 655156 - DNA, 25 bp, Homo sapien
ggcagaagattacagtaagccaaga

SEQ ID NO: 655157 - DNA, 25 bp, Homo sapien
gcagaagattacagtaagccaagat

SEQ ID NO: 655158 - DNA, 25 bp, Homo sapien
cagaagattacagtaagccaagatc

SEQ ID NO: 655159 - DNA, 25 bp, Homo sapien
aagattacagtaagccaagatcgcc

SEQ ID NO: 655160 - DNA, 25 bp, Homo sapien
agattacagtaagccaagatcgccc

SEQ ID NO: 655161 - DNA, 25 bp, Homo sapien
gattacagtaagccaagatcgcccc

SEQ ID NO: 655162 - DNA, 25 bp, Homo sapien
cacggtctcggctcaatgaacccat

SEQ ID NO: 655163 - DNA, 25 bp, Homo sapien
ggtctcggctcaatgaacccatcag

SEQ ID NO: 655164 - DNA, 25 bp, Homo sapien
gctcaatgaacccatcagcagccag

SEQ ID NO: 655165 - DNA, 25 bp, Homo sapien
gttctaggacttctccggctttagt

SEQ ID NO: 655166 - DNA, 25 bp, Homo sapien
tctaggacttctccggctttagtgt

SEQ ID NO: 655167 - DNA, 25 bp, Homo sapien
gacttctccggctttagtgttccaa

SEQ ID NO: 655168 - DNA, 25 bp, Homo sapien
ttctccggctttagtgttccaagta

SEQ ID NO: 655169 - DNA, 25 bp, Homo sapien
tccggctttagtgttccaagtagct

SEQ ID NO: 655170 - DNA, 25 bp, Homo sapien
cggctttagtgttccaagtagctgg

SEQ ID NO: 655171 - DNA, 25 bp, Homo sapien
atcacgcccagctcaaatcatttta

SEQ ID NO: 655172 - DNA, 25 bp, Homo sapien
cacgcccagctcaaatcattttatg

SEQ ID NO: 655173 - DNA, 25 bp, Homo sapien
gagacattgcccagttattgctggt

SEQ ID NO: 655174 - DNA, 25 bp, Homo sapien
ttgcccagttattgctggtactttt

SEQ ID NO: 655175 - DNA, 25 bp, Homo sapien
aatacaactggttctgggagtgcag

SEQ ID NO: 655176 - DNA, 25 bp, Homo sapien
gaaacaacttgtatcttgctgaaac

SEQ ID NO: 655177 - DNA, 25 bp, Homo sapien
gtatcttgctgaaaccacactatca

SEQ ID NO: 655178 - DNA, 25 bp, Homo sapien
tctcatcctgaaactcttcctgatg

SEQ ID NO: 655179 - DNA, 25 bp, Homo sapien
aactcttcctgatgtgcttcctgtt

SEQ ID NO: 655180 - DNA, 25 bp, Homo sapien
tcttcctgatgtgcttcctgttctc

SEQ ID NO: 655181 - DNA, 25 bp, Homo sapien
tgttctccggcatcacaaagcagag

SEQ ID NO: 655182 - DNA, 25 bp, Homo sapien
gacttggagatgaaagacactagtt

SEQ ID NO: 655183 - DNA, 25 bp, Homo sapien
acattgtatggcttagaaggttatc

SEQ ID NO: 655184 - DNA, 25 bp, Homo sapien
caaaaattagcgtggagtggtggca

SEQ ID NO: 655185 - DNA, 25 bp, Homo sapien
aaaaattagcgtggagtggtggcag

SEQ ID NO: 655186 - DNA, 25 bp, Homo sapien
aaaattagcgtggagtggtggcagg

SEQ ID NO: 655187 - DNA, 25 bp, Homo sapien
aattagcgtggagtggtggcaggcg

SEQ ID NO: 655188 - DNA, 25 bp, Homo sapien
attagcgtggagtggtggcaggcgc

SEQ ID NO: 655189 - DNA, 25 bp, Homo sapien
ttagcgtggagtggtggcaggcgcc

SEQ ID NO: 655190 - DNA, 25 bp, Homo sapien
tgggcgacaaagcgagactttgtcc

SEQ ID NO: 655191 - DNA, 25 bp, Homo sapien
gggcgacaaagcgagactttgtccc

SEQ ID NO: 655192 - DNA, 25 bp, Homo sapien
gaaaatcacaactctaaccataatc

SEQ ID NO: 655193 - DNA, 25 bp, Homo sapien
acaactctaaccataatcatctgca

SEQ ID NO: 655194 - DNA, 25 bp, Homo sapien
taatcatctgcactatatgcctcgc

SEQ ID NO: 655195 - DNA, 25 bp, Homo sapien
gcactatatgcctcgcatcaggtaa

SEQ ID NO: 655196 - DNA, 25 bp, Homo sapien
tgcctcgcatcaggtaatgtgtcta

SEQ ID NO: 655197 - DNA, 25 bp, Homo sapien
gtaacatttagcatttctgacctta

SEQ ID NO: 655198 - DNA, 25 bp, Homo sapien
atttagcatttctgaccttatccca

SEQ ID NO: 655199 - DNA, 25 bp, Homo sapien
gcatttctgaccttatcccaaagta

SEQ ID NO: 655200 - DNA, 25 bp, Homo sapien
tttctgaccttatcccaaagtattt

SEQ ID NO: 655201 - DNA, 25 bp, Homo sapien
ttttgtattgcatctcctggataac

SEQ ID NO: 655202 - DNA, 25 bp, Homo sapien
ttgcatctcctggataacaaagtag

SEQ ID NO: 655203 - DNA, 25 bp, Homo sapien
actgaaagaagttccactttaattg

SEQ ID NO: 655204 - DNA, 25 bp, Homo sapien
ctgaaagaagttccactttaattga

SEQ ID NO: 655205 - DNA, 25 bp, Homo sapien
tgaaagaagttccactttaattgac

SEQ ID NO: 655206 - DNA, 25 bp, Homo sapien
gaaagaagttccactttaattgact

SEQ ID NO: 655207 - DNA, 25 bp, Homo sapien
aagaagttccactttaattgactag

SEQ ID NO: 655208 - DNA, 25 bp, Homo sapien
agaagttccactttaattgactagg

SEQ ID NO: 655209 - DNA, 25 bp, Homo sapien
gaagttccactttaattgactaggt

SEQ ID NO: 655210 - DNA, 25 bp, Homo sapien
tccactttaattgactaggttaaat

SEQ ID NO: 655211 - DNA, 25 bp, Homo sapien
aattgactaggttaaatacatttgc

SEQ ID NO: 655212 - DNA, 25 bp, Homo sapien
tgttttactagcagtagtttccctt

SEQ ID NO: 655213 - DNA, 25 bp, Homo sapien
tactagcagtagtttccctttaaat

SEQ ID NO: 655214 - DNA, 25 bp, Homo sapien
agaacaaacgcttgagaccactggg

SEQ ID NO: 655215 - DNA, 25 bp, Homo sapien
gaatgagggaccatcccagttctgc

SEQ ID NO: 655216 - DNA, 25 bp, Homo sapien
ccagttctgccacggatgccttcgg

SEQ ID NO: 655217 - DNA, 25 bp, Homo sapien
ggtggccaagtcagatctttgtgtc

SEQ ID NO: 655218 - DNA, 25 bp, Homo sapien
ttgtgtcttgtttcttcgtagcaga

SEQ ID NO: 655219 - DNA, 25 bp, Homo sapien
cttgtttcttcgtagcagattgaat

SEQ ID NO: 655220 - DNA, 25 bp, Homo sapien
aatagaactatcttcaccacactca

SEQ ID NO: 655221 - DNA, 25 bp, Homo sapien
tcttcaccacactcactatttcaaa

SEQ ID NO: 655222 - DNA, 25 bp, Homo sapien
attgaaaggcactctctgaagggaa

SEQ ID NO: 655223 - DNA, 25 bp, Homo sapien
agccattttatctgcctacaatttg

SEQ ID NO: 655224 - DNA, 25 bp, Homo sapien
atctgcctacaatttggtcatttca

SEQ ID NO: 655225 - DNA, 25 bp, Homo sapien
gtagagtatgaactaatgggtgata

SEQ ID NO: 655226 - DNA, 25 bp, Homo sapien
gaattctctcctaatgtgttactat

SEQ ID NO: 655227 - DNA, 25 bp, Homo sapien
ttctctcctaatgtgttactatgat

SEQ ID NO: 655228 - DNA, 25 bp, Homo sapien
ctcctaatgtgttactatgatagtg

SEQ ID NO: 655229 - DNA, 25 bp, Homo sapien
atagtgattatagtgctcatggaat

SEQ ID NO: 655230 - DNA, 25 bp, Homo sapien
tatagtgctcatggaatacagtcat

SEQ ID NO: 655231 - DNA, 25 bp, Homo sapien
tacagtcatgcgtcaccgaacaaca

SEQ ID NO: 655232 - DNA, 25 bp, Homo sapien
tcatgcgtcaccgaacaacaggata

SEQ ID NO: 655233 - DNA, 25 bp, Homo sapien
tgcgtcaccgaacaacaggatacat

SEQ ID NO: 655234 - DNA, 25 bp, Homo sapien
gtatccttaggcaatttcatccttc

SEQ ID NO: 655235 - DNA, 25 bp, Homo sapien
aggctattgctcctagaccacaaat

SEQ ID NO: 655236 - DNA, 25 bp, Homo sapien
ggccgactctacttgatgggcacga

SEQ ID NO: 655237 - DNA, 25 bp, Homo sapien
caagagaatacgagctccctgtagc

SEQ ID NO: 655238 - DNA, 25 bp, Homo sapien
aagagaatacgagctccctgtagct

SEQ ID NO: 655239 - DNA, 25 bp, Homo sapien
gagaatacgagctccctgtagctcc

SEQ ID NO: 655240 - DNA, 25 bp, Homo sapien
agaatacgagctccctgtagctccc

SEQ ID NO: 655241 - DNA, 25 bp, Homo sapien
tgtagctcccgcgtgtcagacaatt

SEQ ID NO: 655242 - DNA, 25 bp, Homo sapien
gtagctcccgcgtgtcagacaattt

SEQ ID NO: 655243 - DNA, 25 bp, Homo sapien
agctcccgcgtgtcagacaatttgt

SEQ ID NO: 655244 - DNA, 25 bp, Homo sapien
ctcccgcgtgtcagacaatttgtcc

SEQ ID NO: 655245 - DNA, 25 bp, Homo sapien
gggtaacttccatcaggagccagtc

SEQ ID NO: 655246 - DNA, 25 bp, Homo sapien
ggtaacttccatcaggagccagtcc

SEQ ID NO: 655247 - DNA, 25 bp, Homo sapien
agtagagtagatttttggtgataac

SEQ ID NO: 655248 - DNA, 25 bp, Homo sapien
tggtgataacatttgatttctgata

SEQ ID NO: 655249 - DNA, 25 bp, Homo sapien
ttctgataaatattctgcattgata

SEQ ID NO: 655250 - DNA, 25 bp, Homo sapien
aatattctgcattgatattaccaaa

SEQ ID NO: 655251 - DNA, 25 bp, Homo sapien
atattaccaaatgttgccaaattaa

SEQ ID NO: 655252 - DNA, 25 bp, Homo sapien
ttaccaaatgttgccaaattaatat

SEQ ID NO: 655253 - DNA, 25 bp, Homo sapien
atttttatactgctgagactagctc

SEQ ID NO: 655254 - DNA, 25 bp, Homo sapien
tatactgctgagactagctcagtcg

SEQ ID NO: 655255 - DNA, 25 bp, Homo sapien
tactgctgagactagctcagtcgtg

SEQ ID NO: 655256 - DNA, 25 bp, Homo sapien
ctgctgagactagctcagtcgtgga

SEQ ID NO: 655257 - DNA, 25 bp, Homo sapien
tgagactagctcagtcgtggagacc

SEQ ID NO: 655258 - DNA, 25 bp, Homo sapien
cagactaagaatgtcctctgtggac

SEQ ID NO: 655259 - DNA, 25 bp, Homo sapien
tgtggacagagtttagagcccatct

SEQ ID NO: 655260 - DNA, 25 bp, Homo sapien
gtgtctaacgagtgcctaattctgt

SEQ ID NO: 655261 - DNA, 25 bp, Homo sapien
gataagtccacaaatcactgtgcca

SEQ ID NO: 655262 - DNA, 25 bp, Homo sapien
acaaatcactgtgccagacacggat

SEQ ID NO: 655263 - DNA, 25 bp, Homo sapien
cacggatagatagcagtgtcacgga

SEQ ID NO: 655264 - DNA, 25 bp, Homo sapien
agcagtgtcacggaggatgtataga

SEQ ID NO: 655265 - DNA, 25 bp, Homo sapien
catctctggttagaggattccatga

SEQ ID NO: 655266 - DNA, 25 bp, Homo sapien
gattccatgaattctttgaggacat

SEQ ID NO: 655267 - DNA, 25 bp, Homo sapien
tgaggacatcctctgcagagcgtgt

SEQ ID NO: 655268 - DNA, 25 bp, Homo sapien
tctgcagagcgtgtctttgaggagt

SEQ ID NO: 655269 - DNA, 25 bp, Homo sapien
acaggacggcactggtcagtgatgc

SEQ ID NO: 655270 - DNA, 25 bp, Homo sapien
ctggtcagtgatgccgtgtgaggct

SEQ ID NO: 655271 - DNA, 25 bp, Homo sapien
cagtgatgccgtgtgaggctgggcc

SEQ ID NO: 655272 - DNA, 25 bp, Homo sapien
tgggccctggtctctgcccgtctgt

SEQ ID NO: 655273 - DNA, 25 bp, Homo sapien
ggtctctgcccgtctgtcacctggg

SEQ ID NO: 655274 - DNA, 25 bp, Homo sapien
gtcacctgggcctgtcaccagggct

SEQ ID NO: 655275 - DNA, 25 bp, Homo sapien
gctgctgggagcaccatggtcaaga

SEQ ID NO: 655276 - DNA, 25 bp, Homo sapien
gctgggagcaccatggtcaagagca

SEQ ID NO: 655277 - DNA, 25 bp, Homo sapien
gggagcaccatggtcaagagcagca

SEQ ID NO: 655278 - DNA, 25 bp, Homo sapien
gagcaccatggtcaagagcagcagc

SEQ ID NO: 655279 - DNA, 25 bp, Homo sapien
gcaccatggtcaagagcagcagctc

SEQ ID NO: 655280 - DNA, 25 bp, Homo sapien
catatttgtgtagtcgggctgggca

SEQ ID NO: 655281 - DNA, 25 bp, Homo sapien
cctgtcagtatccagatgaatggct

SEQ ID NO: 655282 - DNA, 25 bp, Homo sapien
gattcacgatggaaacctgctctgc

SEQ ID NO: 655283 - DNA, 25 bp, Homo sapien
gctctgcccatcatgttgggacttc

SEQ ID NO: 655284 - DNA, 25 bp, Homo sapien
tcatgttgggacttctgtgagctct

SEQ ID NO: 655285 - DNA, 25 bp, Homo sapien
gacttctgtgagctctgtcctccag

SEQ ID NO: 655286 - DNA, 25 bp, Homo sapien
cgagctctgccacttgatctttgtt

SEQ ID NO: 655287 - DNA, 25 bp, Homo sapien
ttgatctttgttcctgttcctcgag

SEQ ID NO: 655288 - DNA, 25 bp, Homo sapien
tcctgttcctcgagcctggtggtca

SEQ ID NO: 655289 - DNA, 25 bp, Homo sapien
tctggcttctgctaggcaatctgtt

SEQ ID NO: 655290 - DNA, 25 bp, Homo sapien
gctaggcaatctgtttcctctgctg

SEQ ID NO: 655291 - DNA, 25 bp, Homo sapien
ggttggccaaatctcactaaatgca

SEQ ID NO: 655292 - DNA, 25 bp, Homo sapien
cttgagtgtgacgagtcctgtggtg

SEQ ID NO: 655293 - DNA, 25 bp, Homo sapien
acaggacggcactggtcagtgatgc

SEQ ID NO: 655294 - DNA, 25 bp, Homo sapien
cagtgatgccgtgtgaggctgggcc

SEQ ID NO: 655295 - DNA, 25 bp, Homo sapien
tgggccctggtctctgcccgtctgt

SEQ ID NO: 655296 - DNA, 25 bp, Homo sapien
ggtctctgcccgtctgtcacctggg

SEQ ID NO: 655297 - DNA, 25 bp, Homo sapien
gtcacctgggcctgtcaccagggct

SEQ ID NO: 655298 - DNA, 25 bp, Homo sapien
gctgctgggagcaccatggtcaaga

SEQ ID NO: 655299 - DNA, 25 bp, Homo sapien
gagcaccatggtcaagagcagcagc

SEQ ID NO: 655300 - DNA, 25 bp, Homo sapien
gcaccatggtcaagagcagcagctc

SEQ ID NO: 655301 - DNA, 25 bp, Homo sapien
ggtcaagagcagcagctcccagaaa

SEQ ID NO: 655302 - DNA, 25 bp, Homo sapien
gaagtcagctatgcttcattagccg

SEQ ID NO: 655303 - DNA, 25 bp, Homo sapien
gtcagctatgcttcattagccgggc

SEQ ID NO: 655304 - DNA, 25 bp, Homo sapien
gctatgcttcattagccgggcgtga

SEQ ID NO: 655305 - DNA, 25 bp, Homo sapien
cagcctgatggtgtgaaatcgggac

SEQ ID NO: 655306 - DNA, 25 bp, Homo sapien
gatggtgtgaaatcgggactattat

SEQ ID NO: 655307 - DNA, 25 bp, Homo sapien
gactattataattcccattttccag

SEQ ID NO: 655308 - DNA, 25 bp, Homo sapien
tattataattcccattttccagatg

SEQ ID NO: 655309 - DNA, 25 bp, Homo sapien
taagtaacttgtagaagaccacaca

SEQ ID NO: 655310 - DNA, 25 bp, Homo sapien
ttgtagaagaccacacagcaggcaa

SEQ ID NO: 655311 - DNA, 25 bp, Homo sapien
tagaagaccacacagcaggcaaggg

SEQ ID NO: 655312 - DNA, 25 bp, Homo sapien
gtaggattagaagtcagctatgctt

SEQ ID NO: 655313 - DNA, 25 bp, Homo sapien
gaagagaagtgaccgagagaacctc

SEQ ID NO: 655314 - DNA, 25 bp, Homo sapien
gagaagtgaccgagagaacctcaga

SEQ ID NO: 655315 - DNA, 25 bp, Homo sapien
gaagtgaccgagagaacctcagatt

SEQ ID NO: 655316 - DNA, 25 bp, Homo sapien
agtgaccgagagaacctcagattct

SEQ ID NO: 655317 - DNA, 25 bp, Homo sapien
gtgaccgagagaacctcagattctt

SEQ ID NO: 655318 - DNA, 25 bp, Homo sapien
tgaccgagagaacctcagattcttc

SEQ ID NO: 655319 - DNA, 25 bp, Homo sapien
gaccgagagaacctcagattcttca

SEQ ID NO: 655320 - DNA, 25 bp, Homo sapien
accgagagaacctcagattcttcat

SEQ ID NO: 655321 - DNA, 25 bp, Homo sapien
ccgagagaacctcagattcttcatt

SEQ ID NO: 655322 - DNA, 25 bp, Homo sapien
cgagagaacctcagattcttcattg

SEQ ID NO: 655323 - DNA, 25 bp, Homo sapien
catgatttcagtcatagcaagcttt

SEQ ID NO: 655324 - DNA, 25 bp, Homo sapien
agaaatgcactttctaccatgcctc

SEQ ID NO: 655325 - DNA, 25 bp, Homo sapien
gaaatgcactttctaccatgcctcg

SEQ ID NO: 655326 - DNA, 25 bp, Homo sapien
aaatgcactttctaccatgcctcgc

SEQ ID NO: 655327 - DNA, 25 bp, Homo sapien
tctaccatgcctcgccccagaggaa

SEQ ID NO: 655328 - DNA, 25 bp, Homo sapien
tgaagcagaacctcaggagcagagc

SEQ ID NO: 655329 - DNA, 25 bp, Homo sapien
gtgttttaaccagctctccagatgc

SEQ ID NO: 655330 - DNA, 25 bp, Homo sapien
gttttaaccagctctccagatgctt

SEQ ID NO: 655331 - DNA, 25 bp, Homo sapien
ttaaccagctctccagatgcttctg

SEQ ID NO: 655332 - DNA, 25 bp, Homo sapien
cagatgcttctgatgcacctggagt

SEQ ID NO: 655333 - DNA, 25 bp, Homo sapien
agatgcttctgatgcacctggagtt

SEQ ID NO: 655334 - DNA, 25 bp, Homo sapien
gatgcttctgatgcacctggagttg

SEQ ID NO: 655335 - DNA, 25 bp, Homo sapien
tcctcttctgcattgtttttccctg

SEQ ID NO: 655336 - DNA, 25 bp, Homo sapien
ttctgcattgtttttccctgctcat

SEQ ID NO: 655337 - DNA, 25 bp, Homo sapien
attgtttttccctgctcatcctgtt

SEQ ID NO: 655338 - DNA, 25 bp, Homo sapien
ttttccctgctcatcctgttctttt

SEQ ID NO: 655339 - DNA, 25 bp, Homo sapien
tttttgttctagaggtcctttgaag

SEQ ID NO: 655340 - DNA, 25 bp, Homo sapien
ctagaggtcctttgaagaatggaat

SEQ ID NO: 655341 - DNA, 25 bp, Homo sapien
gatatgtagctagattcattgttgt

SEQ ID NO: 655342 - DNA, 25 bp, Homo sapien
agctagattcattgttgtgtttgtt

SEQ ID NO: 655343 - DNA, 25 bp, Homo sapien
tttgttttacctgatattatcttgg

SEQ ID NO: 655344 - DNA, 25 bp, Homo sapien
tcttgggggtggttataactcttat

SEQ ID NO: 655345 - DNA, 25 bp, Homo sapien
taactcttataaactagaaaagcct

SEQ ID NO: 655346 - DNA, 25 bp, Homo sapien
gcccgggcaggtactggatgtcagg

SEQ ID NO: 655347 - DNA, 25 bp, Homo sapien
actggatgtcaggtctgcgaaactt

SEQ ID NO: 655348 - DNA, 25 bp, Homo sapien
ctggatgtcaggtctgcgaaacttc

SEQ ID NO: 655349 - DNA, 25 bp, Homo sapien
tggatgtcaggtctgcgaaacttct

SEQ ID NO: 655350 - DNA, 25 bp, Homo sapien
ggatgtcaggtctgcgaaacttctt

SEQ ID NO: 655351 - DNA, 25 bp, Homo sapien
gatgtcaggtctgcgaaacttctta

SEQ ID NO: 655352 - DNA, 25 bp, Homo sapien
tgtcaggtctgcgaaacttcttaga

SEQ ID NO: 655353 - DNA, 25 bp, Homo sapien
gtcaggtctgcgaaacttcttagat

SEQ ID NO: 655354 - DNA, 25 bp, Homo sapien
tcaggtctgcgaaacttcttagatt

SEQ ID NO: 655355 - DNA, 25 bp, Homo sapien
aacttcttagattttgacctcagtc

SEQ ID NO: 655356 - DNA, 25 bp, Homo sapien
tcttagattttgacctcagtccata

SEQ ID NO: 655357 - DNA, 25 bp, Homo sapien
gaacgaactgtatctcattgactca

SEQ ID NO: 655358 - DNA, 25 bp, Homo sapien
aaaacattgcatctgcctttctgtc

SEQ ID NO: 655359 - DNA, 25 bp, Homo sapien
atttgtatcctagaaccatcctctc

SEQ ID NO: 655360 - DNA, 25 bp, Homo sapien
tagaaccatcctctcgagttccaca

SEQ ID NO: 655361 - DNA, 25 bp, Homo sapien
gagttccacaccgttgtattttcta

SEQ ID NO: 655362 - DNA, 25 bp, Homo sapien
tgtattttctacacctaagcttggt

SEQ ID NO: 655363 - DNA, 25 bp, Homo sapien
gcacaggaaatgtttcttggatgtt

SEQ ID NO: 655364 - DNA, 25 bp, Homo sapien
gtttcttggatgttttatcctcata

SEQ ID NO: 655365 - DNA, 25 bp, Homo sapien
ttttatcctcataccaagtgggaat

SEQ ID NO: 655366 - DNA, 25 bp, Homo sapien
aagagattacccacactctttgcct

SEQ ID NO: 655367 - DNA, 25 bp, Homo sapien
tgggtgtaacccagcactctaaaat

SEQ ID NO: 655368 - DNA, 25 bp, Homo sapien
gacttctagagaaaggcctggtgca

SEQ ID NO: 655369 - DNA, 25 bp, Homo sapien
tgaggtactcgtggttctggagctc

SEQ ID NO: 655370 - DNA, 25 bp, Homo sapien
gtactcgtggttctggagctctaga

SEQ ID NO: 655371 - DNA, 25 bp, Homo sapien
ctcgtggttctggagctctagaaac

SEQ ID NO: 655372 - DNA, 25 bp, Homo sapien
gttctggagctctagaaacacttct

SEQ ID NO: 655373 - DNA, 25 bp, Homo sapien
gagctctagaaacacttctgatgca

SEQ ID NO: 655374 - DNA, 25 bp, Homo sapien
aaaaatgtgtgatggtgcaaggaat

SEQ ID NO: 655375 - DNA, 25 bp, Homo sapien
ggattcaggatgttgttggagaaac

SEQ ID NO: 655376 - DNA, 25 bp, Homo sapien
gaaacaagtttgtgattagtcctta

SEQ ID NO: 655377 - DNA, 25 bp, Homo sapien
gggacattcttcaattccacatctg

SEQ ID NO: 655378 - DNA, 25 bp, Homo sapien
ttccacatctgtttctagaaaccag

SEQ ID NO: 655379 - DNA, 25 bp, Homo sapien
agtgaaaggagcagcacttcaggag

SEQ ID NO: 655380 - DNA, 25 bp, Homo sapien
gtgaaaggagcagcacttcaggagg

SEQ ID NO: 655381 - DNA, 25 bp, Homo sapien
gaaaggagcagcacttcaggaggtt

SEQ ID NO: 655382 - DNA, 25 bp, Homo sapien
aaaggagcagcacttcaggaggtta

SEQ ID NO: 655383 - DNA, 25 bp, Homo sapien
ttcaggaggttacatcttttacacc

SEQ ID NO: 655384 - DNA, 25 bp, Homo sapien
tcaggaggttacatcttttacacct

SEQ ID NO: 655385 - DNA, 25 bp, Homo sapien
caggaggttacatcttttacacctt

SEQ ID NO: 655386 - DNA, 25 bp, Homo sapien
ctccagtgaaaggagcagcacttca

SEQ ID NO: 655387 - DNA, 25 bp, Homo sapien
tccagtgaaaggagcagcacttcag

SEQ ID NO: 655388 - DNA, 25 bp, Homo sapien
ccagtgaaaggagcagcacttcagg

SEQ ID NO: 655389 - DNA, 25 bp, Homo sapien
cagtgaaaggagcagcacttcagga

SEQ ID NO: 655390 - DNA, 25 bp, Homo sapien
aagtggattatttcaatgcaggcaa

SEQ ID NO: 655391 - DNA, 25 bp, Homo sapien
aagatagcatgcttttcgtgtgcaa

SEQ ID NO: 655392 - DNA, 25 bp, Homo sapien
gcatgcttttcgtgtgcaagtacct

SEQ ID NO: 655393 - DNA, 25 bp, Homo sapien
tttcgtgtgcaagtacctgtcagta

SEQ ID NO: 655394 - DNA, 25 bp, Homo sapien
agtacctgtcagtaataagcctttt

SEQ ID NO: 655395 - DNA, 25 bp, Homo sapien
gtagctgctatgtggacagttgttt

SEQ ID NO: 655396 - DNA, 25 bp, Homo sapien
ggacagttgttttctagtgtggtct

SEQ ID NO: 655397 - DNA, 25 bp, Homo sapien
gttttctagtgtggtctgtagccca

SEQ ID NO: 655398 - DNA, 25 bp, Homo sapien
gtgtggtctgtagcccaataactgg

SEQ ID NO: 655399 - DNA, 25 bp, Homo sapien
cgagttacagacaaacatcaccgta

SEQ ID NO: 655400 - DNA, 25 bp, Homo sapien
acatcaccgtaaatgactcacaaca

SEQ ID NO: 655401 - DNA, 25 bp, Homo sapien
tgggctggcacctggcagcgtgagg

SEQ ID NO: 655402 - DNA, 25 bp, Homo sapien
gggctggcacctggcagcgtgaggg

SEQ ID NO: 655403 - DNA, 25 bp, Homo sapien
tggcacctggcagcgtgaggggcct

SEQ ID NO: 655404 - DNA, 25 bp, Homo sapien
gcacctggcagcgtgaggggcctca

SEQ ID NO: 655405 - DNA, 25 bp, Homo sapien
cacctggcagcgtgaggggcctcag

SEQ ID NO: 655406 - DNA, 25 bp, Homo sapien
gggcctcagggctgttaaaatccca

SEQ ID NO: 655407 - DNA, 25 bp, Homo sapien
ggcctcagggctgttaaaatcccaa

SEQ ID NO: 655408 - DNA, 25 bp, Homo sapien
gcctcagggctgttaaaatcccaac

SEQ ID NO: 655409 - DNA, 25 bp, Homo sapien
cctcagggctgttaaaatcccaacg

SEQ ID NO: 655410 - DNA, 25 bp, Homo sapien
ctcagggctgttaaaatcccaacga

SEQ ID NO: 655411 - DNA, 25 bp, Homo sapien
tcagggctgttaaaatcccaacgac

SEQ ID NO: 655412 - DNA, 25 bp, Homo sapien
gacagacaaaacaggtactgttcgt

SEQ ID NO: 655413 - DNA, 25 bp, Homo sapien
aacaggtactgttcgtggtctgtgt

SEQ ID NO: 655414 - DNA, 25 bp, Homo sapien
aggtactgttcgtggtctgtgttca

SEQ ID NO: 655415 - DNA, 25 bp, Homo sapien
gtactgttcgtggtctgtgttcacc

SEQ ID NO: 655416 - DNA, 25 bp, Homo sapien
actgttcgtggtctgtgttcacctt

SEQ ID NO: 655417 - DNA, 25 bp, Homo sapien
gttcgtggtctgtgttcacctttga

SEQ ID NO: 655418 - DNA, 25 bp, Homo sapien
tcgtggtctgtgttcacctttgaat

SEQ ID NO: 655419 - DNA, 25 bp, Homo sapien
cgtggtctgtgttcacctttgaatg

SEQ ID NO: 655420 - DNA, 25 bp, Homo sapien
tggtctgtgttcacctttgaatgga

SEQ ID NO: 655421 - DNA, 25 bp, Homo sapien
gtctgtgttcacctttgaatggaca

SEQ ID NO: 655422 - DNA, 25 bp, Homo sapien
ctgtgttcacctttgaatggacaaa

SEQ ID NO: 655423 - DNA, 25 bp, Homo sapien
ggatcccctgagcccgggattcaag

SEQ ID NO: 655424 - DNA, 25 bp, Homo sapien
cactgtactgcagctgaggcaataa

SEQ ID NO: 655425 - DNA, 25 bp, Homo sapien
gtactgcagctgaggcaataaaacg

SEQ ID NO: 655426 - DNA, 25 bp, Homo sapien
aaaaggctgcacagaatagactgat

SEQ ID NO: 655427 - DNA, 25 bp, Homo sapien
gctgcacagaatagactgatggact

SEQ ID NO: 655428 - DNA, 25 bp, Homo sapien
cagaatagactgatggactgaaggc

SEQ ID NO: 655429 - DNA, 25 bp, Homo sapien
aggctctgcccttatcaaacattta

SEQ ID NO: 655430 - DNA, 25 bp, Homo sapien
ggctctgcccttatcaaacatttac

SEQ ID NO: 655431 - DNA, 25 bp, Homo sapien
gctctgcccttatcaaacatttact

SEQ ID NO: 655432 - DNA, 25 bp, Homo sapien
tctgcccttatcaaacatttactaa

SEQ ID NO: 655433 - DNA, 25 bp, Homo sapien
gcccttatcaaacatttactaagta

SEQ ID NO: 655434 - DNA, 25 bp, Homo sapien
aagatgtatcctagtgacagcataa

SEQ ID NO: 655435 - DNA, 25 bp, Homo sapien
agtgacagcataaaccctagaggtg

SEQ ID NO: 655436 - DNA, 25 bp, Homo sapien
cagtctgtattattgcttttcgctt

SEQ ID NO: 655437 - DNA, 25 bp, Homo sapien
attgcttttcgcttctcttttctgc

SEQ ID NO: 655438 - DNA, 25 bp, Homo sapien
tttctgcttctgttgggagccagtt

SEQ ID NO: 655439 - DNA, 25 bp, Homo sapien
ttgggagccagttttcttcttacgc

SEQ ID NO: 655440 - DNA, 25 bp, Homo sapien
cttcttacgccgcattacagagaga

SEQ ID NO: 655441 - DNA, 25 bp, Homo sapien
gagaacgtcaaatttagcagccata

SEQ ID NO: 655442 - DNA, 25 bp, Homo sapien
agccatatctgccatagggtccaaa

SEQ ID NO: 655443 - DNA, 25 bp, Homo sapien
cttttttggatggaatactgcgtga

SEQ ID NO: 655444 - DNA, 25 bp, Homo sapien
aatactgcgtgaaatggttatccat

SEQ ID NO: 655445 - DNA, 25 bp, Homo sapien
ttctctggagctggtggagcttcag

SEQ ID NO: 655446 - DNA, 25 bp, Homo sapien
gctggtggagcttcagaagtcctgt

SEQ ID NO: 655447 - DNA, 25 bp, Homo sapien
gagcttcagaagtcctgtggagcgt

SEQ ID NO: 655448 - DNA, 25 bp, Homo sapien
tcagaagtcctgtggagcgtcggct

SEQ ID NO: 655449 - DNA, 25 bp, Homo sapien
gtggagcgtcggctgggatcagttt

SEQ ID NO: 655450 - DNA, 25 bp, Homo sapien
gtaaactttgaaagctttccagagt

SEQ ID NO: 655451 - DNA, 25 bp, Homo sapien
gaaagctttccagagtgttgaatct

SEQ ID NO: 655452 - DNA, 25 bp, Homo sapien
aatatctgcagttccaatttcccaa

SEQ ID NO: 655453 - DNA, 25 bp, Homo sapien
accattcaagaccaggaagcccact

SEQ ID NO: 655454 - DNA, 25 bp, Homo sapien
ccattcaagaccaggaagcccactt

SEQ ID NO: 655455 - DNA, 25 bp, Homo sapien
ttcaccccttctattcaacacagga

SEQ ID NO: 655456 - DNA, 25 bp, Homo sapien
tgtgtaccagtttataagtttagac

SEQ ID NO: 655457 - DNA, 25 bp, Homo sapien
aaaactacccttgtagagtctctgg

SEQ ID NO: 655458 - DNA, 25 bp, Homo sapien
acccttgtagagtctctggcttcct

SEQ ID NO: 655459 - DNA, 25 bp, Homo sapien
ctctggcttcctcatagctattata

SEQ ID NO: 655460 - DNA, 25 bp, Homo sapien
ctggcttcctcatagctattatagt

SEQ ID NO: 655461 - DNA, 25 bp, Homo sapien
ttaaccagcacttttggggaacctg

SEQ ID NO: 655462 - DNA, 25 bp, Homo sapien
aacctggcaccaggcagatggtcgc

SEQ ID NO: 655463 - DNA, 25 bp, Homo sapien
gcaccaggcagatggtcgcccatga

SEQ ID NO: 655464 - DNA, 25 bp, Homo sapien
cagatggtcgcccatgagccatgac

SEQ ID NO: 655465 - DNA, 25 bp, Homo sapien
tcgcccatgagccatgaccttgaag

SEQ ID NO: 655466 - DNA, 25 bp, Homo sapien
gaatcaagatttccacatagtgtgc

SEQ ID NO: 655467 - DNA, 25 bp, Homo sapien
actctgggactgagaacagactcaa

SEQ ID NO: 655468 - DNA, 25 bp, Homo sapien
gagaacagactcaaggtgacctcca

SEQ ID NO: 655469 - DNA, 25 bp, Homo sapien
tcccctgcaagaagcgggaagcatc

SEQ ID NO: 655470 - DNA, 25 bp, Homo sapien
gggaagcatcccagtaaccaaacct

SEQ ID NO: 655471 - DNA, 25 bp, Homo sapien
gtaaccaaacctgaattgccaaaga

SEQ ID NO: 655472 - DNA, 25 bp, Homo sapien
caaaccctggccttatacgaagtgt

SEQ ID NO: 655473 - DNA, 25 bp, Homo sapien
ggccttatacgaagtgttaatcctg

SEQ ID NO: 655474 - DNA, 25 bp, Homo sapien
gttaatcctgagattccgggaagag

SEQ ID NO: 655475 - DNA, 25 bp, Homo sapien
ctgagattccgggaagagggcccct

SEQ ID NO: 655476 - DNA, 25 bp, Homo sapien
ctgagagctctgatagtgggaagaa

SEQ ID NO: 655477 - DNA, 25 bp, Homo sapien
tgggaagaaagtgccaactcctgcc

SEQ ID NO: 655478 - DNA, 25 bp, Homo sapien
aaacctcattctctgtatcatactt

SEQ ID NO: 655479 - DNA, 25 bp, Homo sapien
aataaaaatccctgtgtcacaggtg

SEQ ID NO: 655480 - DNA, 25 bp, Homo sapien
acaggtgcttgctcagggctgccaa

SEQ ID NO: 655481 - DNA, 25 bp, Homo sapien
agggctgccaacttctatttttcac

SEQ ID NO: 655482 - DNA, 25 bp, Homo sapien
gagagacatctaaaagcgcaaacta

SEQ ID NO: 655483 - DNA, 25 bp, Homo sapien
gcgcaaactatgcttgtaaaaacca

SEQ ID NO: 655484 - DNA, 25 bp, Homo sapien
gtaaatctctacataggacaatact

SEQ ID NO: 655485 - DNA, 25 bp, Homo sapien
ggacaatacttataagcagacctat

SEQ ID NO: 655486 - DNA, 25 bp, Homo sapien
gcagacctattgataccacttatat

SEQ ID NO: 655487 - DNA, 25 bp, Homo sapien
gtatcagagcagaaacgtctttggt

SEQ ID NO: 655488 - DNA, 25 bp, Homo sapien
gcagaaacgtctttggttaattctt

SEQ ID NO: 655489 - DNA, 25 bp, Homo sapien
aaagttcttcaagggtctggccagc

SEQ ID NO: 655490 - DNA, 25 bp, Homo sapien
gcaagacggaaacgacaaaggacct

SEQ ID NO: 655491 - DNA, 25 bp, Homo sapien
aatcggatcgacattgaggtgctat

SEQ ID NO: 655492 - DNA, 25 bp, Homo sapien
tcgacattgaggtgctatcggtggt

SEQ ID NO: 655493 - DNA, 25 bp, Homo sapien
agcagatcactaccatccagaaggc

SEQ ID NO: 655494 - DNA, 25 bp, Homo sapien
cacagcaacagagggtggaacgctt

SEQ ID NO: 655495 - DNA, 25 bp, Homo sapien
tggaacgcttcatgtttgagggtgt

SEQ ID NO: 655496 - DNA, 25 bp, Homo sapien
catgtttgagggtgttgaaatcccc

SEQ ID NO: 655497 - DNA, 25 bp, Homo sapien
aggccttagccatacagacagttgt

SEQ ID NO: 655498 - DNA, 25 bp, Homo sapien
gttcaactgttctgacctgctcgac

SEQ ID NO: 655499 - DNA, 25 bp, Homo sapien
tgctcgacttcatggccatgggaaa

SEQ ID NO: 655500 - DNA, 25 bp, Homo sapien
aaccaatatgtccacgcagagtatg

SEQ ID NO: 655501 - DNA, 25 bp, Homo sapien
ccaatatgtccacgcagagtatgct

SEQ ID NO: 655502 - DNA, 25 bp, Homo sapien
tatgtccacgcagagtatgctgtac

SEQ ID NO: 655503 - DNA, 25 bp, Homo sapien
gtccacgcagagtatgctgtacaat

SEQ ID NO: 655504 - DNA, 25 bp, Homo sapien
tttacatcaagccatgcatataaaa

SEQ ID NO: 655505 - DNA, 25 bp, Homo sapien
caagccatgcatataaaatttagat

SEQ ID NO: 655506 - DNA, 25 bp, Homo sapien
gataaattccattcagatctgatgt

SEQ ID NO: 655507 - DNA, 25 bp, Homo sapien
tccattcagatctgatgttgcctga

SEQ ID NO: 655508 - DNA, 25 bp, Homo sapien
gcctgacacacaatgtatgcaaaca

SEQ ID NO: 655509 - DNA, 25 bp, Homo sapien
caatgtatgcaaacagatgtctgtg

SEQ ID NO: 655510 - DNA, 25 bp, Homo sapien
tgtggggctttttctgtgctttaga

SEQ ID NO: 655511 - DNA, 25 bp, Homo sapien
gaaaatgtctactaagacctccact

SEQ ID NO: 655512 - DNA, 25 bp, Homo sapien
aaatgtctactaagacctccactcc

SEQ ID NO: 655513 - DNA, 25 bp, Homo sapien
tactaagacctccactccctataat

SEQ ID NO: 655514 - DNA, 25 bp, Homo sapien
aagacctccactccctataatggca

SEQ ID NO: 655515 - DNA, 25 bp, Homo sapien
ctccactccctataatggcacatta

SEQ ID NO: 655516 - DNA, 25 bp, Homo sapien
tccactccctataatggcacattaa

SEQ ID NO: 655517 - DNA, 25 bp, Homo sapien
ataatggcacattaagtatctccaa

SEQ ID NO: 655518 - DNA, 25 bp, Homo sapien
atggcacattaagtatctccaacca

SEQ ID NO: 655519 - DNA, 25 bp, Homo sapien
ggcacattaagtatctccaaccaac

SEQ ID NO: 655520 - DNA, 25 bp, Homo sapien
gcacattaagtatctccaaccaacc

SEQ ID NO: 655521 - DNA, 25 bp, Homo sapien
acattaagtatctccaaccaaccca

SEQ ID NO: 655522 - DNA, 25 bp, Homo sapien
tatcagactgtcctgtagatacatt

SEQ ID NO: 655523 - DNA, 25 bp, Homo sapien
gaagagcacatttagctttgtcagc

SEQ ID NO: 655524 - DNA, 25 bp, Homo sapien
gcacatttagctttgtcagctgtct

SEQ ID NO: 655525 - DNA, 25 bp, Homo sapien
cagctgtctttcagatcatttgcgt

SEQ ID NO: 655526 - DNA, 25 bp, Homo sapien
atcatttgcgttagagagctgcgtt

SEQ ID NO: 655527 - DNA, 25 bp, Homo sapien
gagctgcgttagagagttcgtacaa

SEQ ID NO: 655528 - DNA, 25 bp, Homo sapien
gagagttcgtacaatctgctgattc

SEQ ID NO: 655529 - DNA, 25 bp, Homo sapien
cgtacaatctgctgattctgcacat

SEQ ID NO: 655530 - DNA, 25 bp, Homo sapien
ttctgcacatgccacttctgaccat

SEQ ID NO: 655531 - DNA, 25 bp, Homo sapien
gaatccaaaaggcaagtgtttagta

SEQ ID NO: 655532 - DNA, 25 bp, Homo sapien
taagcataataaacacacctgaatt

SEQ ID NO: 655533 - DNA, 25 bp, Homo sapien
agctacttaggagcctaaggtcgaa

SEQ ID NO: 655534 - DNA, 25 bp, Homo sapien
acttaggagcctaaggtcgaagatc

SEQ ID NO: 655535 - DNA, 25 bp, Homo sapien
cttaggagcctaaggtcgaagatcg

SEQ ID NO: 655536 - DNA, 25 bp, Homo sapien
ttaggagcctaaggtcgaagatcgc

SEQ ID NO: 655537 - DNA, 25 bp, Homo sapien
taggagcctaaggtcgaagatcgct

SEQ ID NO: 655538 - DNA, 25 bp, Homo sapien
aggagcctaaggtcgaagatcgctt

SEQ ID NO: 655539 - DNA, 25 bp, Homo sapien
gagcctaaggtcgaagatcgcttga

SEQ ID NO: 655540 - DNA, 25 bp, Homo sapien
agcctaaggtcgaagatcgcttgag

SEQ ID NO: 655541 - DNA, 25 bp, Homo sapien
gcctaaggtcgaagatcgcttgagt

SEQ ID NO: 655542 - DNA, 25 bp, Homo sapien
aagatcgcttgagtctggcaggcgg

SEQ ID NO: 655543 - DNA, 25 bp, Homo sapien
agctggggtggtgcgccactgcact

SEQ ID NO: 655544 - DNA, 25 bp, Homo sapien
aatacctttgttgtgatgatgtgag

SEQ ID NO: 655545 - DNA, 25 bp, Homo sapien
atcagtgggtcaatgggatccgcat

SEQ ID NO: 655546 - DNA, 25 bp, Homo sapien
aatgggatccgcattgcaaagtatg

SEQ ID NO: 655547 - DNA, 25 bp, Homo sapien
tgggaagcagctctatatgaactac

SEQ ID NO: 655548 - DNA, 25 bp, Homo sapien
aagaggacagagtcagcctatgatt

SEQ ID NO: 655549 - DNA, 25 bp, Homo sapien
atgattggacttccttatccagctc

SEQ ID NO: 655550 - DNA, 25 bp, Homo sapien
tatccagctccagcattaaatcggg

SEQ ID NO: 655551 - DNA, 25 bp, Homo sapien
attaaatcgggatccagttcttcca

SEQ ID NO: 655552 - DNA, 25 bp, Homo sapien
atcccagagtctcagtcaaaccact

SEQ ID NO: 655553 - DNA, 25 bp, Homo sapien
gtcaaaccactccaatcagtctgat

SEQ ID NO: 655554 - DNA, 25 bp, Homo sapien
gatagcggagtttctgacacccagc

SEQ ID NO: 655555 - DNA, 25 bp, Homo sapien
agcgagacccagactcgtacaacaa

SEQ ID NO: 655556 - DNA, 25 bp, Homo sapien
tcgtacaacaaacacctcttcgtgc

SEQ ID NO: 655557 - DNA, 25 bp, Homo sapien
tcttcgtgcacattgggcatgccaa

SEQ ID NO: 655558 - DNA, 25 bp, Homo sapien
ggcatgccaaccattcttacagtga

SEQ ID NO: 655559 - DNA, 25 bp, Homo sapien
attcttacagtgacccattgcttga

SEQ ID NO: 655560 - DNA, 25 bp, Homo sapien
gtgacccattgcttgaatcagtgga

SEQ ID NO: 655561 - DNA, 25 bp, Homo sapien
gaatcagtggacattcgtcagattt

SEQ ID NO: 655562 - DNA, 25 bp, Homo sapien
gaaagggccctcaaaatgccttctt

SEQ ID NO: 655563 - DNA, 25 bp, Homo sapien
atgccttcttcctcgtaaaattctg

SEQ ID NO: 655564 - DNA, 25 bp, Homo sapien
aattctgggctgatttaaactgcaa

SEQ ID NO: 655565 - DNA, 25 bp, Homo sapien
tatggtgtaaccagtcagtacgaga

SEQ ID NO: 655566 - DNA, 25 bp, Homo sapien
aagaccctagagatcgtggacacag

SEQ ID NO: 655567 - DNA, 25 bp, Homo sapien
tagagatcgtggacacagcgtctgg

SEQ ID NO: 655568 - DNA, 25 bp, Homo sapien
ggacacagcgtctgggccgtatcag

SEQ ID NO: 655569 - DNA, 25 bp, Homo sapien
cgcccactcgagattattactgctt

SEQ ID NO: 655570 - DNA, 25 bp, Homo sapien
attactgcttatgcctgcaaccgga

SEQ ID NO: 655571 - DNA, 25 bp, Homo sapien
accggatgctgtgcgcccggttaga

SEQ ID NO: 655572 - DNA, 25 bp, Homo sapien
tgtgcgcccggttagaaaaggtcaa

SEQ ID NO: 655573 - DNA, 25 bp, Homo sapien
tcaggagagtcactttgccccgttt

SEQ ID NO: 655574 - DNA, 25 bp, Homo sapien
gtttcctcgcataccagagagccca

SEQ ID NO: 655575 - DNA, 25 bp, Homo sapien
gcataccagagagcccagtaacacg

SEQ ID NO: 655576 - DNA, 25 bp, Homo sapien
gagagcccagtaacacgctccgcgg

SEQ ID NO: 655577 - DNA, 25 bp, Homo sapien
ctatgttgtgctcctgtagcaccac

SEQ ID NO: 655578 - DNA, 25 bp, Homo sapien
tatgttgtgctcctgtagcaccacc

SEQ ID NO: 655579 - DNA, 25 bp, Homo sapien
atgttgtgctcctgtagcaccacct

SEQ ID NO: 655580 - DNA, 25 bp, Homo sapien
tgttgtgctcctgtagcaccaccta

SEQ ID NO: 655581 - DNA, 25 bp, Homo sapien
gttgtgctcctgtagcaccacctac

SEQ ID NO: 655582 - DNA, 25 bp, Homo sapien
ttgtgctcctgtagcaccacctaca

SEQ ID NO: 655583 - DNA, 25 bp, Homo sapien
agtggtgttctctgggtagtgggga

SEQ ID NO: 655584 - DNA, 25 bp, Homo sapien
gtgttctctgggtagtggggattgt

SEQ ID NO: 655585 - DNA, 25 bp, Homo sapien
gggattgtgatggaaggcttcttgt

SEQ ID NO: 655586 - DNA, 25 bp, Homo sapien
tgtgatggaaggcttcttgtttcta

SEQ ID NO: 655587 - DNA, 25 bp, Homo sapien
gtgatggaaggcttcttgtttctac

SEQ ID NO: 655588 - DNA, 25 bp, Homo sapien
agctacttaggagcctaaggtcgaa

SEQ ID NO: 655589 - DNA, 25 bp, Homo sapien
ctacttaggagcctaaggtcgaaga

SEQ ID NO: 655590 - DNA, 25 bp, Homo sapien
tacttaggagcctaaggtcgaagat

SEQ ID NO: 655591 - DNA, 25 bp, Homo sapien
acttaggagcctaaggtcgaagatc

SEQ ID NO: 655592 - DNA, 25 bp, Homo sapien
cttaggagcctaaggtcgaagatcg

SEQ ID NO: 655593 - DNA, 25 bp, Homo sapien
ttaggagcctaaggtcgaagatcgc

SEQ ID NO: 655594 - DNA, 25 bp, Homo sapien
taggagcctaaggtcgaagatcgct

SEQ ID NO: 655595 - DNA, 25 bp, Homo sapien
aggagcctaaggtcgaagatcgctt

SEQ ID NO: 655596 - DNA, 25 bp, Homo sapien
gagcctaaggtcgaagatcgcttga

SEQ ID NO: 655597 - DNA, 25 bp, Homo sapien
agcctaaggtcgaagatcgcttgag

SEQ ID NO: 655598 - DNA, 25 bp, Homo sapien
gcctaaggtcgaagatcgcttgagt

SEQ ID NO: 655599 - DNA, 25 bp, Homo sapien
gtgtgaccttagtctgtctagtgac

SEQ ID NO: 655600 - DNA, 25 bp, Homo sapien
gaccttagtctgtctagtgactggt

SEQ ID NO: 655601 - DNA, 25 bp, Homo sapien
gtctgtctagtgactggtgttgtca

SEQ ID NO: 655602 - DNA, 25 bp, Homo sapien
gtctagtgactggtgttgtcataag

SEQ ID NO: 655603 - DNA, 25 bp, Homo sapien
gcagttatgctgctgcaaactaagg

SEQ ID NO: 655604 - DNA, 25 bp, Homo sapien
aaactaaggaatggctctggccctc

SEQ ID NO: 655605 - DNA, 25 bp, Homo sapien
tctggccctccaaggattgctgata

SEQ ID NO: 655606 - DNA, 25 bp, Homo sapien
gccctccaaggattgctgataacca

SEQ ID NO: 655607 - DNA, 25 bp, Homo sapien
ggattgctgataaccaccagaaact

SEQ ID NO: 655608 - DNA, 25 bp, Homo sapien
ctggatttcaaacttgtagcttcct

SEQ ID NO: 655609 - DNA, 25 bp, Homo sapien
ttcaaacttgtagcttcctaaactg

SEQ ID NO: 655610 - DNA, 25 bp, Homo sapien
gcaatcccactcctgagtaaatacc

SEQ ID NO: 655611 - DNA, 25 bp, Homo sapien
gtacatcagagtggtatctgccctc

SEQ ID NO: 655612 - DNA, 25 bp, Homo sapien
atcagagtggtatctgccctctcac

SEQ ID NO: 655613 - DNA, 25 bp, Homo sapien
gcaagattcacaattgtcaagatat

SEQ ID NO: 655614 - DNA, 25 bp, Homo sapien
cacaattgtcaagatatggtatcaa

SEQ ID NO: 655615 - DNA, 25 bp, Homo sapien
ggtatcaacgtaagtgtccatcagt

SEQ ID NO: 655616 - DNA, 25 bp, Homo sapien
gtatcaacgtaagtgtccatcagtg

SEQ ID NO: 655617 - DNA, 25 bp, Homo sapien
aaaaaagtcctttcatttgctgcaa

SEQ ID NO: 655618 - DNA, 25 bp, Homo sapien
aaaagtcctttcatttgctgcaaca

SEQ ID NO: 655619 - DNA, 25 bp, Homo sapien
tgcaacatggatagaactggaagac

SEQ ID NO: 655620 - DNA, 25 bp, Homo sapien
aaagacattagtgtgaatgttcaca

SEQ ID NO: 655621 - DNA, 25 bp, Homo sapien
tagtgaggccccacctctacctaga

SEQ ID NO: 655622 - DNA, 25 bp, Homo sapien
agtgaggccccacctctacctagaa

SEQ ID NO: 655623 - DNA, 25 bp, Homo sapien
gtgaggccccacctctacctagaat

SEQ ID NO: 655624 - DNA, 25 bp, Homo sapien
tgaggccccacctctacctagaata

SEQ ID NO: 655625 - DNA, 25 bp, Homo sapien
gaggccccacctctacctagaatac

SEQ ID NO: 655626 - DNA, 25 bp, Homo sapien
aggccccacctctacctagaataca

SEQ ID NO: 655627 - DNA, 25 bp, Homo sapien
ggccccacctctacctagaatacaa

SEQ ID NO: 655628 - DNA, 25 bp, Homo sapien
ccacctctacctagaatacaaaaat

SEQ ID NO: 655629 - DNA, 25 bp, Homo sapien
taaactgcactcacggtcatccccc

SEQ ID NO: 655630 - DNA, 25 bp, Homo sapien
aaactgcactcacggtcatcccccc

SEQ ID NO: 655631 - DNA, 25 bp, Homo sapien
actgcactcacggtcatccccccaa

SEQ ID NO: 655632 - DNA, 25 bp, Homo sapien
tgcactcacggtcatccccccaaag

SEQ ID NO: 655633 - DNA, 25 bp, Homo sapien
aggatgagggtttcttaagttatgt

SEQ ID NO: 655634 - DNA, 25 bp, Homo sapien
ttgaaaattcaaaccttgagtccgg

SEQ ID NO: 655635 - DNA, 25 bp, Homo sapien
tgaaaattcaaaccttgagtccggg

SEQ ID NO: 655636 - DNA, 25 bp, Homo sapien
aaattcaaaccttgagtccgggcat

SEQ ID NO: 655637 - DNA, 25 bp, Homo sapien
aattcaaaccttgagtccgggcatg

SEQ ID NO: 655638 - DNA, 25 bp, Homo sapien
attcaaaccttgagtccgggcatgg

SEQ ID NO: 655639 - DNA, 25 bp, Homo sapien
ttcaaaccttgagtccgggcatggt

SEQ ID NO: 655640 - DNA, 25 bp, Homo sapien
atattcccagagttgtgcagtcatc

SEQ ID NO: 655641 - DNA, 25 bp, Homo sapien
tgcagtcatcactacaatccagtta

SEQ ID NO: 655642 - DNA, 25 bp, Homo sapien
tccagttatggagcatttctgtcac

SEQ ID NO: 655643 - DNA, 25 bp, Homo sapien
aaggagatcccacgtgtctgcttgc

SEQ ID NO: 655644 - DNA, 25 bp, Homo sapien
gtctgcttgcagacagttctcattc

SEQ ID NO: 655645 - DNA, 25 bp, Homo sapien
atctgccttctgtctctctagattt

SEQ ID NO: 655646 - DNA, 25 bp, Homo sapien
atacaatcgcacaatagttagtctt

SEQ ID NO: 655647 - DNA, 25 bp, Homo sapien
tagttagtcttttgcactggcttct

SEQ ID NO: 655648 - DNA, 25 bp, Homo sapien
agtcttttgcactggcttctgtcac

SEQ ID NO: 655649 - DNA, 25 bp, Homo sapien
ttagaaaccagcttccatacaccaa

SEQ ID NO: 655650 - DNA, 25 bp, Homo sapien
cagcttccatacaccaaattacaac

SEQ ID NO: 655651 - DNA, 25 bp, Homo sapien
ggaatggggtctcccctcacattgg

SEQ ID NO: 655652 - DNA, 25 bp, Homo sapien
ctcacattggggagcttgcccttta

SEQ ID NO: 655653 - DNA, 25 bp, Homo sapien
ctgggtatctgggaccccagatcag

SEQ ID NO: 655654 - DNA, 25 bp, Homo sapien
atctgggaccccagatcaggctctg

SEQ ID NO: 655655 - DNA, 25 bp, Homo sapien
tgggaccccagatcaggctctggag

SEQ ID NO: 655656 - DNA, 25 bp, Homo sapien
gaccccagatcaggctctggagacg

SEQ ID NO: 655657 - DNA, 25 bp, Homo sapien
agatcaggctctggagacgctgcta

SEQ ID NO: 655658 - DNA, 25 bp, Homo sapien
atcaggctctggagacgctgctacc

SEQ ID NO: 655659 - DNA, 25 bp, Homo sapien
aggctctggagacgctgctacctga

SEQ ID NO: 655660 - DNA, 25 bp, Homo sapien
ctctggagacgctgctacctgaggg

SEQ ID NO: 655661 - DNA, 25 bp, Homo sapien
gcctccaggatgagctatcccatct

SEQ ID NO: 655662 - DNA, 25 bp, Homo sapien
agaagtcacaccttatctctgacca

SEQ ID NO: 655663 - DNA, 25 bp, Homo sapien
tatctctgaccaaaggacacactca

SEQ ID NO: 655664 - DNA, 25 bp, Homo sapien
agaagccctgcatttgcgatgaatg

SEQ ID NO: 655665 - DNA, 25 bp, Homo sapien
ctgcatttgcgatgaatgtgggcgc

SEQ ID NO: 655666 - DNA, 25 bp, Homo sapien
aatgtgggcgcggctttggctttaa

SEQ ID NO: 655667 - DNA, 25 bp, Homo sapien
tttggctttaagtctgccctcatcc

SEQ ID NO: 655668 - DNA, 25 bp, Homo sapien
taagtctgccctcatccgacatcag

SEQ ID NO: 655669 - DNA, 25 bp, Homo sapien
ctttagccagaagtctcacttgcat

SEQ ID NO: 655670 - DNA, 25 bp, Homo sapien
gaagtctcacttgcatagacacagg

SEQ ID NO: 655671 - DNA, 25 bp, Homo sapien
tgacctttcctttccccgtgagtgt

SEQ ID NO: 655672 - DNA, 25 bp, Homo sapien
tttccccgtgagtgtgaagctggca

SEQ ID NO: 655673 - DNA, 25 bp, Homo sapien
tctgtggcctttcctaactcggcct

SEQ ID NO: 655674 - DNA, 25 bp, Homo sapien
taactcggcctcacgtcacagagcg

SEQ ID NO: 655675 - DNA, 25 bp, Homo sapien
gtcacagagcgtcacctttcctgca

SEQ ID NO: 655676 - DNA, 25 bp, Homo sapien
ttcctgcactccacggcagcagtga

SEQ ID NO: 655677 - DNA, 25 bp, Homo sapien
acgtggcagggaatgtgagacaaca

SEQ ID NO: 655678 - DNA, 25 bp, Homo sapien
gtgagacaacacaatattgctgtgg

SEQ ID NO: 655679 - DNA, 25 bp, Homo sapien
ttgctgtggccattcatgaacagtc

SEQ ID NO: 655680 - DNA, 25 bp, Homo sapien
attcatgaacagtcagtcagcccca

SEQ ID NO: 655681 - DNA, 25 bp, Homo sapien
gaggtggcctgacctgttttccgat

SEQ ID NO: 655682 - DNA, 25 bp, Homo sapien
tgttttccgatttccttcatcttct

SEQ ID NO: 655683 - DNA, 25 bp, Homo sapien
atcttctgcaaaaggttaaccgctg

SEQ ID NO: 655684 - DNA, 25 bp, Homo sapien
tcaagtaccctatccttcccagatt

SEQ ID NO: 655685 - DNA, 25 bp, Homo sapien
agattcaatcaccttacccagcagc

SEQ ID NO: 655686 - DNA, 25 bp, Homo sapien
cagcagcaatctaggaaacccctca

SEQ ID NO: 655687 - DNA, 25 bp, Homo sapien
ctttaactcaactaggatggtcctt

SEQ ID NO: 655688 - DNA, 25 bp, Homo sapien
taggatggtccttctgtgcaaactt

SEQ ID NO: 655689 - DNA, 25 bp, Homo sapien
ttctgtgcaaacttggttcctgcct

SEQ ID NO: 655690 - DNA, 25 bp, Homo sapien
tcctgcctcctttaataggtcacag

SEQ ID NO: 655691 - DNA, 25 bp, Homo sapien
tgaacttagcccctatagtccaaac

SEQ ID NO: 655692 - DNA, 25 bp, Homo sapien
aacaaaacctgcattcaggccctga

SEQ ID NO: 655693 - DNA, 25 bp, Homo sapien
ctcctccatccatgacagtattcat

SEQ ID NO: 655694 - DNA, 25 bp, Homo sapien
cagtattcatgtgggctcaagagat

SEQ ID NO: 655695 - DNA, 25 bp, Homo sapien
attcgaggctccctagccagacagt

SEQ ID NO: 655696 - DNA, 25 bp, Homo sapien
cctagccagacagtggaggtgccag

SEQ ID NO: 655697 - DNA, 25 bp, Homo sapien
ggctgtggatcaagtgagctgacta

SEQ ID NO: 655698 - DNA, 25 bp, Homo sapien
gagctgactacagtggttgcgttca

SEQ ID NO: 655699 - DNA, 25 bp, Homo sapien
agtggttgcgttcataagccctgtc

SEQ ID NO: 655700 - DNA, 25 bp, Homo sapien
aggaggtagttcacatccctggtgg

SEQ ID NO: 655701 - DNA, 25 bp, Homo sapien
aaattggaaccagctcatcggtgct

SEQ ID NO: 655702 - DNA, 25 bp, Homo sapien
agctcatcggtgctgtgatttcaca

SEQ ID NO: 655703 - DNA, 25 bp, Homo sapien
tgatttcacaggtattagggcacag

SEQ ID NO: 655704 - DNA, 25 bp, Homo sapien
gtattagggcacagggccacaccaa

SEQ ID NO: 655705 - DNA, 25 bp, Homo sapien
acagggccacaccaacacaagtctt

SEQ ID NO: 655706 - DNA, 25 bp, Homo sapien
tctcttcctactgagcacctgtgaa

SEQ ID NO: 655707 - DNA, 25 bp, Homo sapien
gagcacctgtgaacagtgacctgca

SEQ ID NO: 655708 - DNA, 25 bp, Homo sapien
tgtgaacagtgacctgcagtttgtg

SEQ ID NO: 655709 - DNA, 25 bp, Homo sapien
gtggctgcagccagtcctcttgcag

SEQ ID NO: 655710 - DNA, 25 bp, Homo sapien
agtcctcttgcagcctggtgttctt

SEQ ID NO: 655711 - DNA, 25 bp, Homo sapien
gcagcctggtgttcttacatttcat

SEQ ID NO: 655712 - DNA, 25 bp, Homo sapien
ggtgttcttacatttcattctgagg

SEQ ID NO: 655713 - DNA, 25 bp, Homo sapien
tcttacatttcattctgaggctcac

SEQ ID NO: 655714 - DNA, 25 bp, Homo sapien
tgaggctcacattctcagtcaccat

SEQ ID NO: 655715 - DNA, 25 bp, Homo sapien
tcacattctcagtcaccatgcagaa

SEQ ID NO: 655716 - DNA, 25 bp, Homo sapien
tctcagtcaccatgcagaagaacac

SEQ ID NO: 655717 - DNA, 25 bp, Homo sapien
ttccccaagcaccttatctaagatt

SEQ ID NO: 655718 - DNA, 25 bp, Homo sapien
ttatctaagattcctctgtacccct

SEQ ID NO: 655719 - DNA, 25 bp, Homo sapien
ttcttcctagttactttcacccatg

SEQ ID NO: 655720 - DNA, 25 bp, Homo sapien
ttactttcacccatgtttactgcct

SEQ ID NO: 655721 - DNA, 25 bp, Homo sapien
gtttactgcctgttcacaatctgta

SEQ ID NO: 655722 - DNA, 25 bp, Homo sapien
gcctgttcacaatctgtaagctatt

SEQ ID NO: 655723 - DNA, 25 bp, Homo sapien
agctattaccttgttctttaacaca

SEQ ID NO: 655724 - DNA, 25 bp, Homo sapien
gtctatctctcatgctagcatataa

SEQ ID NO: 655725 - DNA, 25 bp, Homo sapien
tataatctccatgatctctttcctg

SEQ ID NO: 655726 - DNA, 25 bp, Homo sapien
atctctttcctgcttactgctgtgt

SEQ ID NO: 655727 - DNA, 25 bp, Homo sapien
actgctgtgtcttctgtaccaaaca

SEQ ID NO: 655728 - DNA, 25 bp, Homo sapien
gaagcgccctggtgaggcgtccctc

SEQ ID NO: 655729 - DNA, 25 bp, Homo sapien
aagcgccctggtgaggcgtccctcc

SEQ ID NO: 655730 - DNA, 25 bp, Homo sapien
gcgccctggtgaggcgtccctccat

SEQ ID NO: 655731 - DNA, 25 bp, Homo sapien
cgcgcgcctgtgtaggagcctcgag

SEQ ID NO: 655732 - DNA, 25 bp, Homo sapien
gcgcgcctgtgtaggagcctcgagg

SEQ ID NO: 655733 - DNA, 25 bp, Homo sapien
cgcgcctgtgtaggagcctcgaggc

SEQ ID NO: 655734 - DNA, 25 bp, Homo sapien
gcgcctgtgtaggagcctcgaggcg

SEQ ID NO: 655735 - DNA, 25 bp, Homo sapien
ctgtgtaggagcctcgaggcgggcg

SEQ ID NO: 655736 - DNA, 25 bp, Homo sapien
tgtgtaggagcctcgaggcgggcgg

SEQ ID NO: 655737 - DNA, 25 bp, Homo sapien
gtgtaggagcctcgaggcgggcggg

SEQ ID NO: 655738 - DNA, 25 bp, Homo sapien
aggcgggcggggttccagcgcgcag

SEQ ID NO: 655739 - DNA, 25 bp, Homo sapien
aagggactcagagctaggccctctt

SEQ ID NO: 655740 - DNA, 25 bp, Homo sapien
agggactcagagctaggccctctta

SEQ ID NO: 655741 - DNA, 25 bp, Homo sapien
ggactcagagctaggccctcttacc

SEQ ID NO: 655742 - DNA, 25 bp, Homo sapien
tcttaggaccccaatcgcaggcggg

SEQ ID NO: 655743 - DNA, 25 bp, Homo sapien
gaggcacccatcgagaggcgagtac

SEQ ID NO: 655744 - DNA, 25 bp, Homo sapien
gcacccatcgagaggcgagtacaga

SEQ ID NO: 655745 - DNA, 25 bp, Homo sapien
aggcgagtacagagagccagcccct

SEQ ID NO: 655746 - DNA, 25 bp, Homo sapien
gcgagtacagagagccagcccctct

SEQ ID NO: 655747 - DNA, 25 bp, Homo sapien
ttgggacccccatcgcagggcggga

SEQ ID NO: 655748 - DNA, 25 bp, Homo sapien
cggcgactgagagcgagcccgtctt

SEQ ID NO: 655749 - DNA, 25 bp, Homo sapien
ttaggagccccatcgcagaggcggg

SEQ ID NO: 655750 - DNA, 25 bp, Homo sapien
cagttagaaatcgtaagagtcaaat

SEQ ID NO: 655751 - DNA, 25 bp, Homo sapien
aaatcgtaagagtcaaatattttct

SEQ ID NO: 655752 - DNA, 25 bp, Homo sapien
tttctttgcttcatgttacctaaat

SEQ ID NO: 655753 - DNA, 25 bp, Homo sapien
ttctttgcttcatgttacctaaata

SEQ ID NO: 655754 - DNA, 25 bp, Homo sapien
tctttgcttcatgttacctaaatat

SEQ ID NO: 655755 - DNA, 25 bp, Homo sapien
ctttgcttcatgttacctaaatatt

SEQ ID NO: 655756 - DNA, 25 bp, Homo sapien
tttgcttcatgttacctaaatattg

SEQ ID NO: 655757 - DNA, 25 bp, Homo sapien
ttgcttcatgttacctaaatattgt

SEQ ID NO: 655758 - DNA, 25 bp, Homo sapien
gcttcatgttacctaaatattgtat

SEQ ID NO: 655759 - DNA, 25 bp, Homo sapien
tgttacctaaatattgtattctcta

SEQ ID NO: 655760 - DNA, 25 bp, Homo sapien
ttgtattctctagtaataaatttgt

SEQ ID NO: 655761 - DNA, 25 bp, Homo sapien
tcaaagcagtagagtatgaactaat

SEQ ID NO: 655762 - DNA, 25 bp, Homo sapien
gtagagtatgaactaatgggtgata

SEQ ID NO: 655763 - DNA, 25 bp, Homo sapien
gaattctctcctaatgtgttactat

SEQ ID NO: 655764 - DNA, 25 bp, Homo sapien
attctctcctaatgtgttactatga

SEQ ID NO: 655765 - DNA, 25 bp, Homo sapien
tctctcctaatgtgttactatgata

SEQ ID NO: 655766 - DNA, 25 bp, Homo sapien
ctcctaatgtgttactatgatagtg

SEQ ID NO: 655767 - DNA, 25 bp, Homo sapien
atagtgattatagtgctcatggaat

SEQ ID NO: 655768 - DNA, 25 bp, Homo sapien
tatagtgctcatggaatacagtcat

SEQ ID NO: 655769 - DNA, 25 bp, Homo sapien
tacagtcatgcgtcaccgaacaaca

SEQ ID NO: 655770 - DNA, 25 bp, Homo sapien
tcatgcgtcaccgaacaacaggata

SEQ ID NO: 655771 - DNA, 25 bp, Homo sapien
tgcgtcaccgaacaacaggatacat

SEQ ID NO: 655772 - DNA, 25 bp, Homo sapien
tcactgtccttctcactatgttgtg

SEQ ID NO: 655773 - DNA, 25 bp, Homo sapien
cactgtccttctcactatgttgtgc

SEQ ID NO: 655774 - DNA, 25 bp, Homo sapien
actatgttgtgctcctgtagcacca

SEQ ID NO: 655775 - DNA, 25 bp, Homo sapien
tgtagcaccacctacatgtgtctct

SEQ ID NO: 655776 - DNA, 25 bp, Homo sapien
atgtgtctctcatacttatcagatt

SEQ ID NO: 655777 - DNA, 25 bp, Homo sapien
gggaaggatacataccaaactaaat

SEQ ID NO: 655778 - DNA, 25 bp, Homo sapien
gatggaaggcttcttgtttctactt

SEQ ID NO: 655779 - DNA, 25 bp, Homo sapien
gtattattttttgcagtcaaaacaa

SEQ ID NO: 655780 - DNA, 25 bp, Homo sapien
tataaacggtaacttaatggcaact

SEQ ID NO: 655781 - DNA, 25 bp, Homo sapien
cggtaacttaatggcaactaagtat

SEQ ID NO: 655782 - DNA, 25 bp, Homo sapien
ggcaactaagtatgtcctttatttt

SEQ ID NO: 655783 - DNA, 25 bp, Homo sapien
ggaacttctctatggaatccttaga

SEQ ID NO: 655784 - DNA, 25 bp, Homo sapien
ctatggaatccttagaatatgagaa

SEQ ID NO: 655785 - DNA, 25 bp, Homo sapien
agaaaccccttgacattcctatatt

SEQ ID NO: 655786 - DNA, 25 bp, Homo sapien
aaaccccttgacattcctatattgg

SEQ ID NO: 655787 - DNA, 25 bp, Homo sapien
gacattcctatattgggtttaggtc

SEQ ID NO: 655788 - DNA, 25 bp, Homo sapien
ggtttaggtctaatttcactcagta

SEQ ID NO: 655789 - DNA, 25 bp, Homo sapien
aaatgttactccttgtagacagatg

SEQ ID NO: 655790 - DNA, 25 bp, Homo sapien
tgtagacagatgatgagacgccaaa

SEQ ID NO: 655791 - DNA, 25 bp, Homo sapien
gagacgccaaagtacagctgagtga

SEQ ID NO: 655792 - DNA, 25 bp, Homo sapien
caaggctgtggatcatgttgtttca

SEQ ID NO: 655793 - DNA, 25 bp, Homo sapien
tggatcatgttgtttcagttcttta

SEQ ID NO: 655794 - DNA, 25 bp, Homo sapien
tagacctgcgctcctgacatcacag

SEQ ID NO: 655795 - DNA, 25 bp, Homo sapien
ccaacgaggagagcaggacaccaat

SEQ ID NO: 655796 - DNA, 25 bp, Homo sapien
ggagagcaggacaccaatgcagtgt

SEQ ID NO: 655797 - DNA, 25 bp, Homo sapien
ggacaccaatgcagtgtcggtttag

SEQ ID NO: 655798 - DNA, 25 bp, Homo sapien
ccaatgcagtgtcggtttagagaga

SEQ ID NO: 655799 - DNA, 25 bp, Homo sapien
gtgtcggtttagagagagaacctta

SEQ ID NO: 655800 - DNA, 25 bp, Homo sapien
gcaaggaggtacgagacccagccag

SEQ ID NO: 655801 - DNA, 25 bp, Homo sapien
aggaggtacgagacccagccaggtt

SEQ ID NO: 655802 - DNA, 25 bp, Homo sapien
ggtacgagacccagccaggttggca

SEQ ID NO: 655803 - DNA, 25 bp, Homo sapien
tgccttccatccctgcagttgatgg

SEQ ID NO: 655804 - DNA, 25 bp, Homo sapien
aagaagagctggttgccgtcctgga

SEQ ID NO: 655805 - DNA, 25 bp, Homo sapien
tctttttcgtttcgtccttgagaag

SEQ ID NO: 655806 - DNA, 25 bp, Homo sapien
tttcgtttcgtccttgagaagtaca

SEQ ID NO: 655807 - DNA, 25 bp, Homo sapien
gtttcgtccttgagaagtacaactt

SEQ ID NO: 655808 - DNA, 25 bp, Homo sapien
gtccttgagaagtacaacttgcatt

SEQ ID NO: 655809 - DNA, 25 bp, Homo sapien
gtacaacttgcatttacagatggta

SEQ ID NO: 655810 - DNA, 25 bp, Homo sapien
cagatggtaattcctagtgttgttc

SEQ ID NO: 655811 - DNA, 25 bp, Homo sapien
gtaattcctagtgttgttctctgct

SEQ ID NO: 655812 - DNA, 25 bp, Homo sapien
attcctagtgttgttctctgctatc

SEQ ID NO: 655813 - DNA, 25 bp, Homo sapien
agtgttgttctctgctatctttttt

SEQ ID NO: 655814 - DNA, 25 bp, Homo sapien
ttttttggtatgaaattgctgtatt

SEQ ID NO: 655815 - DNA, 25 bp, Homo sapien
caaatgtgtggtgttgacaatatat

SEQ ID NO: 655816 - DNA, 25 bp, Homo sapien
tgtactgtcctgaaccggctttcat

SEQ ID NO: 655817 - DNA, 25 bp, Homo sapien
gtcctgaaccggctttcattcctaa

SEQ ID NO: 655818 - DNA, 25 bp, Homo sapien
tgaaccggctttcattcctaacttt

SEQ ID NO: 655819 - DNA, 25 bp, Homo sapien
aatggtgtgtgccttgtaagtagaa

SEQ ID NO: 655820 - DNA, 25 bp, Homo sapien
ggtgtgtgccttgtaagtagaaatg

SEQ ID NO: 655821 - DNA, 25 bp, Homo sapien
ggaattttactaatgtgtcactcaa

SEQ ID NO: 655822 - DNA, 25 bp, Homo sapien
gtgtcactcaattgtttgagctcct

SEQ ID NO: 655823 - DNA, 25 bp, Homo sapien
caattgtttgagctccttctgtttt

SEQ ID NO: 655824 - DNA, 25 bp, Homo sapien
ggaaaaatgtatcattctatcatga

SEQ ID NO: 655825 - DNA, 25 bp, Homo sapien
ctatcatgattttatggtgctctaa

SEQ ID NO: 655826 - DNA, 25 bp, Homo sapien
atggtgctctaattaaaggtgtctt

SEQ ID NO: 655827 - DNA, 25 bp, Homo sapien
gaacttttcagacaagtggcacctg

SEQ ID NO: 655828 - DNA, 25 bp, Homo sapien
agacaagtggcacctgcaagtgtct

SEQ ID NO: 655829 - DNA, 25 bp, Homo sapien
gcaagtgtcttcgagcaaggcctca

SEQ ID NO: 655830 - DNA, 25 bp, Homo sapien
gtgtcttcgagcaaggcctcaacct

SEQ ID NO: 655831 - DNA, 25 bp, Homo sapien
gccacctgcaaacaccagggaagag

SEQ ID NO: 655832 - DNA, 25 bp, Homo sapien
agagcaagattgagttacatggctt

SEQ ID NO: 655833 - DNA, 25 bp, Homo sapien
gattgagttacatggcttggaagaa

SEQ ID NO: 655834 - DNA, 25 bp, Homo sapien
gaagagtgaaacacctcgcaagacc

SEQ ID NO: 655835 - DNA, 25 bp, Homo sapien
agtgaaacacctcgcaagacccaga

SEQ ID NO: 655836 - DNA, 25 bp, Homo sapien
actccacatccatttgcagctaatt

SEQ ID NO: 655837 - DNA, 25 bp, Homo sapien
ttgcagctaattttaaagcccaaat

SEQ ID NO: 655838 - DNA, 25 bp, Homo sapien
ttaaagttgagatggccggctgcct

SEQ ID NO: 655839 - DNA, 25 bp, Homo sapien
ctgcctcatacctctgattcaaaag

SEQ ID NO: 655840 - DNA, 25 bp, Homo sapien
agttgctgtactggttagggcgatt

SEQ ID NO: 655841 - DNA, 25 bp, Homo sapien
ggttagggcgattgttcctgacaac

SEQ ID NO: 655842 - DNA, 25 bp, Homo sapien
gggaaactggactgctacacaagga

SEQ ID NO: 655843 - DNA, 25 bp, Homo sapien
ggactgctacacaaggaggactgaa

SEQ ID NO: 655844 - DNA, 25 bp, Homo sapien
gaggactgaacagagctgaggcttc

SEQ ID NO: 655845 - DNA, 25 bp, Homo sapien
gagctgaggcttccctaatgaagac

SEQ ID NO: 655846 - DNA, 25 bp, Homo sapien
gaaagccttccctatctgtggataa

SEQ ID NO: 655847 - DNA, 25 bp, Homo sapien
gataatgggcttgccttgccaactt

SEQ ID NO: 655848 - DNA, 25 bp, Homo sapien
gccaacttccacaattgcataaaac

SEQ ID NO: 655849 - DNA, 25 bp, Homo sapien
catgcccagctcaagatccaattca

SEQ ID NO: 655850 - DNA, 25 bp, Homo sapien
gatccaattcacaaacttcttcact

SEQ ID NO: 655851 - DNA, 25 bp, Homo sapien
acttcttcactcatactgtttcaca

SEQ ID NO: 655852 - DNA, 25 bp, Homo sapien
actgtttcacagtaacacctcaata

SEQ ID NO: 655853 - DNA, 25 bp, Homo sapien
cacctcaataattcaggctggctga

SEQ ID NO: 655854 - DNA, 25 bp, Homo sapien
ggctggctgacagattagccttgat

SEQ ID NO: 655855 - DNA, 25 bp, Homo sapien
tggattacctaatatgtgctacaaa

SEQ ID NO: 655856 - DNA, 25 bp, Homo sapien
tgtgctacaaatttgtttcttgcag

SEQ ID NO: 655857 - DNA, 25 bp, Homo sapien
gtttcttgcagtaagcaggacacaa

SEQ ID NO: 655858 - DNA, 25 bp, Homo sapien
aaccctgcttacattcaactgttgg

SEQ ID NO: 655859 - DNA, 25 bp, Homo sapien
gggaactgcatatgactggaaataa

SEQ ID NO: 655860 - DNA, 25 bp, Homo sapien
aaagctcttttaaagtctgaagcca

SEQ ID NO: 655861 - DNA, 25 bp, Homo sapien
catgtgtccttcatttcatttctag

SEQ ID NO: 655862 - DNA, 25 bp, Homo sapien
cttcatttcatttctaggctgttcc

SEQ ID NO: 655863 - DNA, 25 bp, Homo sapien
taggctgttcccatgctttcggcac

SEQ ID NO: 655864 - DNA, 25 bp, Homo sapien
atgctttcggcacagagtcatccac

SEQ ID NO: 655865 - DNA, 25 bp, Homo sapien
gtcatccacatgaagaacaaccctg

SEQ ID NO: 655866 - DNA, 25 bp, Homo sapien
aagaacaaccctgtttcctaagctg

SEQ ID NO: 655867 - DNA, 25 bp, Homo sapien
tttactatcagctcaccactggatt

SEQ ID NO: 655868 - DNA, 25 bp, Homo sapien
ttgcaccagccaacagagacctggt

SEQ ID NO: 655869 - DNA, 25 bp, Homo sapien
gtggctgagggcaaaaccaagcctt

SEQ ID NO: 655870 - DNA, 25 bp, Homo sapien
accaagccttcacaaatctgacatg

SEQ ID NO: 655871 - DNA, 25 bp, Homo sapien
ccccatggcagtgtattggaagaag

SEQ ID NO: 655872 - DNA, 25 bp, Homo sapien
gaaggtttggacgattatttgactc

SEQ ID NO: 655873 - DNA, 25 bp, Homo sapien
gacgattatttgactcgcctgatag

SEQ ID NO: 655874 - DNA, 25 bp, Homo sapien
atttgactcgcctgatagaagaaag

SEQ ID NO: 655875 - DNA, 25 bp, Homo sapien
gatactttgatgagaacgggtgtgt

SEQ ID NO: 655876 - DNA, 25 bp, Homo sapien
acgggtgtgtataatcacgaggatc

SEQ ID NO: 655877 - DNA, 25 bp, Homo sapien
gaataataagtgaactcgaccgaca

SEQ ID NO: 655878 - DNA, 25 bp, Homo sapien
gtgaactcgaccgacagatcagaga

SEQ ID NO: 655879 - DNA, 25 bp, Homo sapien
gacagatcagagagattttggcaaa

SEQ ID NO: 655880 - DNA, 25 bp, Homo sapien
aaagcaatgccagtaattaataaca

SEQ ID NO: 655881 - DNA, 25 bp, Homo sapien
aagctttatagagactctaagtcta

SEQ ID NO: 655882 - DNA, 25 bp, Homo sapien
tagtgccctggtggactcaaaacaa

SEQ ID NO: 655883 - DNA, 25 bp, Homo sapien
gccctggtggactcaaaacaagaat

SEQ ID NO: 655884 - DNA, 25 bp, Homo sapien
acaagaatccaaactgtgctgtttt

SEQ ID NO: 655885 - DNA, 25 bp, Homo sapien
ccaaactgtgctgttttacagagag

SEQ ID NO: 655886 - DNA, 25 bp, Homo sapien
aagtgaaccccaagaagcatccttc

SEQ ID NO: 655887 - DNA, 25 bp, Homo sapien
agccaccgctggcaaaccagaatga

SEQ ID NO: 655888 - DNA, 25 bp, Homo sapien
gcaaaccagaatgagacggaggatg

SEQ ID NO: 655889 - DNA, 25 bp, Homo sapien
agattacattgccaactgcaccgtg

SEQ ID NO: 655890 - DNA, 25 bp, Homo sapien
acattgccaactgcaccgtgaaggt

SEQ ID NO: 655891 - DNA, 25 bp, Homo sapien
actgcaccgtgaaggtggaccagct

SEQ ID NO: 655892 - DNA, 25 bp, Homo sapien
aggtggaccagctgggcagtgacga

SEQ ID NO: 655893 - DNA, 25 bp, Homo sapien
atgtatatactcagcgcagacctct

SEQ ID NO: 655894 - DNA, 25 bp, Homo sapien
ctctcctctgaattctagactcata

SEQ ID NO: 655895 - DNA, 25 bp, Homo sapien
actcatatatccgaatgtcttcttg

SEQ ID NO: 655896 - DNA, 25 bp, Homo sapien
caaattcttttcaatgtctagtaat

SEQ ID NO: 655897 - DNA, 25 bp, Homo sapien
attcaaacttagctaatatgtccaa

SEQ ID NO: 655898 - DNA, 25 bp, Homo sapien
atatgtccaaaacctgagctttaac

SEQ ID NO: 655899 - DNA, 25 bp, Homo sapien
cagtaaataattccattcttccctt

SEQ ID NO: 655900 - DNA, 25 bp, Homo sapien
cttcccttacagttattgagcccaa

SEQ ID NO: 655901 - DNA, 25 bp, Homo sapien
ttgagcccaaaaaccttggagctat

SEQ ID NO: 655902 - DNA, 25 bp, Homo sapien
tggagctattcttgactccctaact

SEQ ID NO: 655903 - DNA, 25 bp, Homo sapien
ggccagtatgcgagcaaatcctgtt

SEQ ID NO: 655904 - DNA, 25 bp, Homo sapien
aacaagatcactggacctcagcttg

SEQ ID NO: 655905 - DNA, 25 bp, Homo sapien
actggacctcagcttgccttgtaga

SEQ ID NO: 655906 - DNA, 25 bp, Homo sapien
ggacctcagcttgccttgtagagct

SEQ ID NO: 655907 - DNA, 25 bp, Homo sapien
tgccttgtagagctatttacaaata

SEQ ID NO: 655908 - DNA, 25 bp, Homo sapien
tgtggaacatgggtacattttaatt

SEQ ID NO: 655909 - DNA, 25 bp, Homo sapien
tgatgtaatgtgcaatgggactcat

SEQ ID NO: 655910 - DNA, 25 bp, Homo sapien
gtgcaatgggactcatggaagtctt

SEQ ID NO: 655911 - DNA, 25 bp, Homo sapien
gaagtcttcaaaagaccctctgatt

SEQ ID NO: 655912 - DNA, 25 bp, Homo sapien
aagaccctctgattgggcaatgtgt

SEQ ID NO: 655913 - DNA, 25 bp, Homo sapien
ttgggcaatgtgttgggttgaatta

SEQ ID NO: 655914 - DNA, 25 bp, Homo sapien
tgggttgaattaagttctgccgtga

SEQ ID NO: 655915 - DNA, 25 bp, Homo sapien
gtgtttgagcccagatgagtcatgg

SEQ ID NO: 655916 - DNA, 25 bp, Homo sapien
gatgagtcatggctggacgacccct

SEQ ID NO: 655917 - DNA, 25 bp, Homo sapien
tggacgacccctccgcataggagat

SEQ ID NO: 655918 - DNA, 25 bp, Homo sapien
tccgcataggagatcagctggttct

SEQ ID NO: 655919 - DNA, 25 bp, Homo sapien
gattatgatgagacctacattccta

SEQ ID NO: 655920 - DNA, 25 bp, Homo sapien
gagacctacattcctagtgagcaag

SEQ ID NO: 655921 - DNA, 25 bp, Homo sapien
gaaattcttgaatttgcccgggaga

SEQ ID NO: 655922 - DNA, 25 bp, Homo sapien
aatttgcccgggagattggtattga

SEQ ID NO: 655923 - DNA, 25 bp, Homo sapien
ggagattggtattgatcccatcaag

SEQ ID NO: 655924 - DNA, 25 bp, Homo sapien
gatcccatcaaggaaccagaactga

SEQ ID NO: 655925 - DNA, 25 bp, Homo sapien
cactgcctggagagtggaaaccatg

SEQ ID NO: 655926 - DNA, 25 bp, Homo sapien
agactgccaggctccaggaataagt

SEQ ID NO: 655927 - DNA, 25 bp, Homo sapien
tgccaggctccaggaataagtagct

SEQ ID NO: 655928 - DNA, 25 bp, Homo sapien
caggctccaggaataagtagctcta

SEQ ID NO: 655929 - DNA, 25 bp, Homo sapien
ctccaggaataagtagctctaagaa

SEQ ID NO: 655930 - DNA, 25 bp, Homo sapien
agtagctctaagaaatacagtattt

SEQ ID NO: 655931 - DNA, 25 bp, Homo sapien
gaaatacagtatttcagtgtgagcc

SEQ ID NO: 655932 - DNA, 25 bp, Homo sapien
gtgtgagccacaccccactattgca

SEQ ID NO: 655933 - DNA, 25 bp, Homo sapien
ccacaccccactattgcaaattgga

SEQ ID NO: 655934 - DNA, 25 bp, Homo sapien
accccactattgcaaattggagagg

SEQ ID NO: 655935 - DNA, 25 bp, Homo sapien
attggagaggagaaggacaaactta

SEQ ID NO: 655936 - DNA, 25 bp, Homo sapien
gatttaacagaacaacagggtgaaa

SEQ ID NO: 655937 - DNA, 25 bp, Homo sapien
gggttcttgataatctgacatgata

SEQ ID NO: 655938 - DNA, 25 bp, Homo sapien
gttcttgataatctgacatgataag

SEQ ID NO: 655939 - DNA, 25 bp, Homo sapien
gataatctgacatgataagtggtgt

SEQ ID NO: 655940 - DNA, 25 bp, Homo sapien
atctgacatgataagtggtgttgga

SEQ ID NO: 655941 - DNA, 25 bp, Homo sapien
catgataagtggtgttggaattggc

SEQ ID NO: 655942 - DNA, 25 bp, Homo sapien
aagtggtgttggaattggcattaaa

SEQ ID NO: 655943 - DNA, 25 bp, Homo sapien
tggtgttggaattggcattaaaatc

SEQ ID NO: 655944 - DNA, 25 bp, Homo sapien
tggaattggcattaaaatccaccat

SEQ ID NO: 655945 - DNA, 25 bp, Homo sapien
aacacttcatccttcttcggcaggc

SEQ ID NO: 655946 - DNA, 25 bp, Homo sapien
acacttcatccttcttcggcaggca

SEQ ID NO: 655947 - DNA, 25 bp, Homo sapien
ttcatccttcttcggcaggcaccaa

SEQ ID NO: 655948 - DNA, 25 bp, Homo sapien
gcaattgactgctacacaaaaggca

SEQ ID NO: 655949 - DNA, 25 bp, Homo sapien
acaaaaggcatggatgccgatccat

SEQ ID NO: 655950 - DNA, 25 bp, Homo sapien
gatgccgatccatataatcccgtgt

SEQ ID NO: 655951 - DNA, 25 bp, Homo sapien
tgccgatccatataatcccgtgttg

SEQ ID NO: 655952 - DNA, 25 bp, Homo sapien
gatccatataatcccgtgttgccaa

SEQ ID NO: 655953 - DNA, 25 bp, Homo sapien
atataatcccgtgttgccaacgaac

SEQ ID NO: 655954 - DNA, 25 bp, Homo sapien
taatcccgtgttgccaacgaacaga

SEQ ID NO: 655955 - DNA, 25 bp, Homo sapien
gtgttgccaacgaacagagcgtcag

SEQ ID NO: 655956 - DNA, 25 bp, Homo sapien
ttgccaacgaacagagcgtcagcat

SEQ ID NO: 655957 - DNA, 25 bp, Homo sapien
gaacagagcgtcagcatattttaga

SEQ ID NO: 655958 - DNA, 25 bp, Homo sapien
gagcgtcagcatattttagactgaa

SEQ ID NO: 655959 - DNA, 25 bp, Homo sapien
gtgccttctggatggtagtgatctg

SEQ ID NO: 655960 - DNA, 25 bp, Homo sapien
atggtagtgatctgctgtgccacca

SEQ ID NO: 655961 - DNA, 25 bp, Homo sapien
tagcacctcaatgtcgatccgatta

SEQ ID NO: 655962 - DNA, 25 bp, Homo sapien
attaaactcatcaaagcaggcccag

SEQ ID NO: 655963 - DNA, 25 bp, Homo sapien
gctggccagacccttgaagaacttt

SEQ ID NO: 655964 - DNA, 25 bp, Homo sapien
agacccttgaagaactttcccatgg

SEQ ID NO: 655965 - DNA, 25 bp, Homo sapien
tttcccatggccatgaagtcgagca

SEQ ID NO: 655966 - DNA, 25 bp, Homo sapien
gaagtcgagcaggtcagaacagttg

SEQ ID NO: 655967 - DNA, 25 bp, Homo sapien
acaactgtctgtatggctaaggcct

SEQ ID NO: 655968 - DNA, 25 bp, Homo sapien
caggtcctttgtcgtttccgtcttg

SEQ ID NO: 655969 - DNA, 25 bp, Homo sapien
acaccctcaaacatgaagcgttcca

SEQ ID NO: 655970 - DNA, 25 bp, Homo sapien
atatctaactattcaatgccctgac

SEQ ID NO: 655971 - DNA, 25 bp, Homo sapien
attcaatgccctgacattgatgaac

SEQ ID NO: 655972 - DNA, 25 bp, Homo sapien
gacattgatgaacacccacaagctt

SEQ ID NO: 655973 - DNA, 25 bp, Homo sapien
tgaacacccacaagcttcaagacca

SEQ ID NO: 655974 - DNA, 25 bp, Homo sapien
atgacttctccaaataaactaaata

SEQ ID NO: 655975 - DNA, 25 bp, Homo sapien
aataaggcaccagtgaccaattctg

SEQ ID NO: 655976 - DNA, 25 bp, Homo sapien
gcaccagtgaccaattctggagtaa

SEQ ID NO: 655977 - DNA, 25 bp, Homo sapien
aatatgtgatctttcaagcggtgaa

SEQ ID NO: 655978 - DNA, 25 bp, Homo sapien
gtgatctttcaagcggtgaattcaa

SEQ ID NO: 655979 - DNA, 25 bp, Homo sapien
gcggtgaattcaaagtaactgtttt

SEQ ID NO: 655980 - DNA, 25 bp, Homo sapien
gaagctcagtgaaatccaaggtaag

SEQ ID NO: 655981 - DNA, 25 bp, Homo sapien
ttctgtgtagatcaagagtgtctta

SEQ ID NO: 655982 - DNA, 25 bp, Homo sapien
tctgtgtagatcaagagtgtcttag

SEQ ID NO: 655983 - DNA, 25 bp, Homo sapien
ctgtgtagatcaagagtgtcttagg

SEQ ID NO: 655984 - DNA, 25 bp, Homo sapien
tgtgtagatcaagagtgtcttaggc

SEQ ID NO: 655985 - DNA, 25 bp, Homo sapien
gtgtagatcaagagtgtcttaggcc

SEQ ID NO: 655986 - DNA, 25 bp, Homo sapien
tgtagatcaagagtgtcttaggccg

SEQ ID NO: 655987 - DNA, 25 bp, Homo sapien
gtagatcaagagtgtcttaggccgg

SEQ ID NO: 655988 - DNA, 25 bp, Homo sapien
tagatcaagagtgtcttaggccggg

SEQ ID NO: 655989 - DNA, 25 bp, Homo sapien
agatcaagagtgtcttaggccgggc

SEQ ID NO: 655990 - DNA, 25 bp, Homo sapien
gatcaagagtgtcttaggccgggcg

SEQ ID NO: 655991 - DNA, 25 bp, Homo sapien
atcaagagtgtcttaggccgggcgc

SEQ ID NO: 655992 - DNA, 25 bp, Homo sapien
tcctcttctgcattgtttttccctg

SEQ ID NO: 655993 - DNA, 25 bp, Homo sapien
ttctgcattgtttttccctgctcat

SEQ ID NO: 655994 - DNA, 25 bp, Homo sapien
attgtttttccctgctcatcctgtt

SEQ ID NO: 655995 - DNA, 25 bp, Homo sapien
ttttccctgctcatcctgttctttt

SEQ ID NO: 655996 - DNA, 25 bp, Homo sapien
tttttgttctagaggtcctttgaag

SEQ ID NO: 655997 - DNA, 25 bp, Homo sapien
ctagaggtcctttgaagaatggaat

SEQ ID NO: 655998 - DNA, 25 bp, Homo sapien
aaaagagttcctcataccgtcttgg

SEQ ID NO: 655999 - DNA, 25 bp, Homo sapien
ctcataccgtcttggatagacagta

SEQ ID NO: 656000 - DNA, 25 bp, Homo sapien
gatatgtagctagattcattgttgt

SEQ ID NO: 656001 - DNA, 25 bp, Homo sapien
agctagattcattgttgtgtttgtt

SEQ ID NO: 656002 - DNA, 25 bp, Homo sapien
tttgttttacctgatattatcttgg

SEQ ID NO: 656003 - DNA, 25 bp, Homo sapien
actccttaatctagtggctggaaga

SEQ ID NO: 656004 - DNA, 25 bp, Homo sapien
atctagtggctggaagaacggtctc

SEQ ID NO: 656005 - DNA, 25 bp, Homo sapien
gaacggtctcagaatcatgtttgtg

SEQ ID NO: 656006 - DNA, 25 bp, Homo sapien
catgtttgtgttctaatctggccat

SEQ ID NO: 656007 - DNA, 25 bp, Homo sapien
gtttgtgttctaatctggccattta

SEQ ID NO: 656008 - DNA, 25 bp, Homo sapien
gtgttctaatctggccatttaaacc

SEQ ID NO: 656009 - DNA, 25 bp, Homo sapien
ctaatctggccatttaaaccattta

SEQ ID NO: 656010 - DNA, 25 bp, Homo sapien
gaatgtatttgtggaccacttgtta

SEQ ID NO: 656011 - DNA, 25 bp, Homo sapien
tgtggaccacttgttagttttctgt

SEQ ID NO: 656012 - DNA, 25 bp, Homo sapien
cttgttagttttctgtgtggcgtgt

SEQ ID NO: 656013 - DNA, 25 bp, Homo sapien
ttagttttctgtgtggcgtgtggca

SEQ ID NO: 656014 - DNA, 25 bp, Homo sapien
agtatttagatactttcataatgat

SEQ ID NO: 656015 - DNA, 25 bp, Homo sapien
ataatgatgcttttattatgttttc

SEQ ID NO: 656016 - DNA, 25 bp, Homo sapien
atgcttttattatgttttctcctga

SEQ ID NO: 656017 - DNA, 25 bp, Homo sapien
ttattatgttttctcctgatatttt

SEQ ID NO: 656018 - DNA, 25 bp, Homo sapien
atgttttctcctgatattttaaact

SEQ ID NO: 656019 - DNA, 25 bp, Homo sapien
tgttttctcctgatattttaaactt

SEQ ID NO: 656020 - DNA, 25 bp, Homo sapien
gagaattattctctcttcttataaa

SEQ ID NO: 656021 - DNA, 25 bp, Homo sapien
taaatatgaaatcttcgggccaggc

SEQ ID NO: 656022 - DNA, 25 bp, Homo sapien
aatatgaaatcttcgggccaggcac

SEQ ID NO: 656023 - DNA, 25 bp, Homo sapien
aacactttaaccaccagcctcacat

SEQ ID NO: 656024 - DNA, 25 bp, Homo sapien
ccaccagcctcacatcaacttccag

SEQ ID NO: 656025 - DNA, 25 bp, Homo sapien
acttgtcttttatttgacagtgttt

SEQ ID NO: 656026 - DNA, 25 bp, Homo sapien
aatgtcatgtctctagaactcacag

SEQ ID NO: 656027 - DNA, 25 bp, Homo sapien
gtctctagaactcacagtcatcttg

SEQ ID NO: 656028 - DNA, 25 bp, Homo sapien
catcaattatttggtaaggctttct

SEQ ID NO: 656029 - DNA, 25 bp, Homo sapien
cttaaaatttgattgcagtactgca

SEQ ID NO: 656030 - DNA, 25 bp, Homo sapien
tactgcaaacaaaatctttctgagg

SEQ ID NO: 656031 - DNA, 25 bp, Homo sapien
caaaatctttctgaggaccaactaa

SEQ ID NO: 656032 - DNA, 25 bp, Homo sapien
tctgaggaccaactaatatttgaat

SEQ ID NO: 656033 - DNA, 25 bp, Homo sapien
gcacattcaagtagtgattagcttt

SEQ ID NO: 656034 - DNA, 25 bp, Homo sapien
attagctttgaaatggttagagtac

SEQ ID NO: 656035 - DNA, 25 bp, Homo sapien
acaagacatttgatttgacttgtct

SEQ ID NO: 656036 - DNA, 25 bp, Homo sapien
ggatgatgaagtattcatggctttt

SEQ ID NO: 656037 - DNA, 25 bp, Homo sapien
agtactgcaactgcattctatagat

SEQ ID NO: 656038 - DNA, 25 bp, Homo sapien
tactgcaactgcattctatagattg

SEQ ID NO: 656039 - DNA, 25 bp, Homo sapien
ctgcaactgcattctatagattgac

SEQ ID NO: 656040 - DNA, 25 bp, Homo sapien
gcaactgcattctatagattgacaa

SEQ ID NO: 656041 - DNA, 25 bp, Homo sapien
aactgcattctatagattgacaaga

SEQ ID NO: 656042 - DNA, 25 bp, Homo sapien
gattgacaagaaaggtttttgccaa

SEQ ID NO: 656043 - DNA, 25 bp, Homo sapien
ttgacaagaaaggtttttgccaatc

SEQ ID NO: 656044 - DNA, 25 bp, Homo sapien
acagatgacagagtagaacgtgtac

SEQ ID NO: 656045 - DNA, 25 bp, Homo sapien
gatgacagagtagaacgtgtacgca

SEQ ID NO: 656046 - DNA, 25 bp, Homo sapien
tgacagagtagaacgtgtacgcaga

SEQ ID NO: 656047 - DNA, 25 bp, Homo sapien
acacactattatttcttcactgcta

SEQ ID NO: 656048 - DNA, 25 bp, Homo sapien
atttcttcactgctatgacatgact

SEQ ID NO: 656049 - DNA, 25 bp, Homo sapien
ttcactgctatgacatgactagatt

SEQ ID NO: 656050 - DNA, 25 bp, Homo sapien
tgacatgactagattacaatttttt

SEQ ID NO: 656051 - DNA, 25 bp, Homo sapien
agatgactttcggtcttgtttccca

SEQ ID NO: 656052 - DNA, 25 bp, Homo sapien
atgactttcggtcttgtttcccagg

SEQ ID NO: 656053 - DNA, 25 bp, Homo sapien
gaaaggccagctgtaatgaacttgc

SEQ ID NO: 656054 - DNA, 25 bp, Homo sapien
gctgtaatgaacttgctggttttgg

SEQ ID NO: 656055 - DNA, 25 bp, Homo sapien
atgaacttgctggttttggtaaatt

SEQ ID NO: 656056 - DNA, 25 bp, Homo sapien
taaattcattgccttacccttggac

SEQ ID NO: 656057 - DNA, 25 bp, Homo sapien
ttcattgccttacccttggacctgg

SEQ ID NO: 656058 - DNA, 25 bp, Homo sapien
aggacccaggacaggctcaagaatg

SEQ ID NO: 656059 - DNA, 25 bp, Homo sapien
ccagcagtatcagcaagtatcacag

SEQ ID NO: 656060 - DNA, 25 bp, Homo sapien
gcagagtgtagaacctcacagttga

SEQ ID NO: 656061 - DNA, 25 bp, Homo sapien
gaatatagtgacctttctgaagagc

SEQ ID NO: 656062 - DNA, 25 bp, Homo sapien
tctgaagagcactgaggcttggata

SEQ ID NO: 656063 - DNA, 25 bp, Homo sapien
aaaataccagtcatttgctggccaa

SEQ ID NO: 656064 - DNA, 25 bp, Homo sapien
tgctggccaatcctgctgactatga

SEQ ID NO: 656065 - DNA, 25 bp, Homo sapien
atcctgctgactatgactctttgag

SEQ ID NO: 656066 - DNA, 25 bp, Homo sapien
gactatgactctttgaggacactga

SEQ ID NO: 656067 - DNA, 25 bp, Homo sapien
aggacactgagtcaccatgctagct

SEQ ID NO: 656068 - DNA, 25 bp, Homo sapien
atgctagctctgtgcagatggcttt

SEQ ID NO: 656069 - DNA, 25 bp, Homo sapien
actgaaagaagttccactttaattg

SEQ ID NO: 656070 - DNA, 25 bp, Homo sapien
gaaagaagttccactttaattgact

SEQ ID NO: 656071 - DNA, 25 bp, Homo sapien
aagaagttccactttaattgactag

SEQ ID NO: 656072 - DNA, 25 bp, Homo sapien
agaagttccactttaattgactagg

SEQ ID NO: 656073 - DNA, 25 bp, Homo sapien
gaagttccactttaattgactaggt

SEQ ID NO: 656074 - DNA, 25 bp, Homo sapien
tccactttaattgactaggttaaat

SEQ ID NO: 656075 - DNA, 25 bp, Homo sapien
aattgactaggttaaatacatttgc

SEQ ID NO: 656076 - DNA, 25 bp, Homo sapien
ggttaaatacatttgcagccttttt

SEQ ID NO: 656077 - DNA, 25 bp, Homo sapien
taaatacatttgcagccttttttta

SEQ ID NO: 656078 - DNA, 25 bp, Homo sapien
tgttttactagcagtagtttccctt

SEQ ID NO: 656079 - DNA, 25 bp, Homo sapien
tactagcagtagtttccctttaaat

SEQ ID NO: 656080 - DNA, 25 bp, Homo sapien
aaccaatatgtccacgcagagtatg

SEQ ID NO: 656081 - DNA, 25 bp, Homo sapien
gtccacgcagagtatgctgtacaat

SEQ ID NO: 656082 - DNA, 25 bp, Homo sapien
tttacatcaagccatgcatataaaa

SEQ ID NO: 656083 - DNA, 25 bp, Homo sapien
caagccatgcatataaaatttagat

SEQ ID NO: 656084 - DNA, 25 bp, Homo sapien
gataaattccattcagatctgatgt

SEQ ID NO: 656085 - DNA, 25 bp, Homo sapien
tccattcagatctgatgttgcctga

SEQ ID NO: 656086 - DNA, 25 bp, Homo sapien
tgatgttgcctgacacacaatgtat

SEQ ID NO: 656087 - DNA, 25 bp, Homo sapien
gcctgacacacaatgtatgcaaaca

SEQ ID NO: 656088 - DNA, 25 bp, Homo sapien
caatgtatgcaaacagatgtctgtg

SEQ ID NO: 656089 - DNA, 25 bp, Homo sapien
gctttttctgtgctttagaaaacaa

SEQ ID NO: 656090 - DNA, 25 bp, Homo sapien
gggtcttaataatttctcagttctc

SEQ ID NO: 656091 - DNA, 25 bp, Homo sapien
ccttacagaatgagtcatgtggcca

SEQ ID NO: 656092 - DNA, 25 bp, Homo sapien
cagaatgagtcatgtggccagacct

SEQ ID NO: 656093 - DNA, 25 bp, Homo sapien
aatgagtcatgtggccagaccttca

SEQ ID NO: 656094 - DNA, 25 bp, Homo sapien
gccagaccttcaagtccaaggcctt

SEQ ID NO: 656095 - DNA, 25 bp, Homo sapien
agaccttcaagtccaaggccttcag

SEQ ID NO: 656096 - DNA, 25 bp, Homo sapien
accttcaagtccaaggccttcagac

SEQ ID NO: 656097 - DNA, 25 bp, Homo sapien
aagtccaaggccttcagacactaag

SEQ ID NO: 656098 - DNA, 25 bp, Homo sapien
gtccaaggccttcagacactaagga

SEQ ID NO: 656099 - DNA, 25 bp, Homo sapien
caaggccttcagacactaaggatgg

SEQ ID NO: 656100 - DNA, 25 bp, Homo sapien
ggccttcagacactaaggatgggaa

SEQ ID NO: 656101 - DNA, 25 bp, Homo sapien
cttccactagttgaattttcatgca

SEQ ID NO: 656102 - DNA, 25 bp, Homo sapien
agtggttttaccatctcgaggtgag

SEQ ID NO: 656103 - DNA, 25 bp, Homo sapien
taccatctcgaggtgagtaatgttt

SEQ ID NO: 656104 - DNA, 25 bp, Homo sapien
tcccctcttctgtgctgagggaaag

SEQ ID NO: 656105 - DNA, 25 bp, Homo sapien
gggaaagaaaagctgcctctccttt

SEQ ID NO: 656106 - DNA, 25 bp, Homo sapien
cctctcctttcttggttttgtagca

SEQ ID NO: 656107 - DNA, 25 bp, Homo sapien
ttcttggttttgtagcatggcttcc

SEQ ID NO: 656108 - DNA, 25 bp, Homo sapien
gtagcatggcttccagtacctgtta

SEQ ID NO: 656109 - DNA, 25 bp, Homo sapien
atggcttccagtacctgttagtcat

SEQ ID NO: 656110 - DNA, 25 bp, Homo sapien
agtacctgttagtcatctccttgct

SEQ ID NO: 656111 - DNA, 25 bp, Homo sapien
gtcatctccttgctccttttttatt

SEQ ID NO: 656112 - DNA, 25 bp, Homo sapien
tgttgccaggctgcattccagactg

SEQ ID NO: 656113 - DNA, 25 bp, Homo sapien
gcccatgtgtcgcacagcaagagcg

SEQ ID NO: 656114 - DNA, 25 bp, Homo sapien
gaagatgccacagactgtttcccag

SEQ ID NO: 656115 - DNA, 25 bp, Homo sapien
agactgtttcccagctctctcgaga

SEQ ID NO: 656116 - DNA, 25 bp, Homo sapien
tctctcgagagctcactgactatca

SEQ ID NO: 656117 - DNA, 25 bp, Homo sapien
gagagctcactgactatcacaagga

SEQ ID NO: 656118 - DNA, 25 bp, Homo sapien
ggactacatccccacatgagaccag

SEQ ID NO: 656119 - DNA, 25 bp, Homo sapien
catgagaccagagcgggacatccaa

SEQ ID NO: 656120 - DNA, 25 bp, Homo sapien
ggacatccaagctatattgccctct

SEQ ID NO: 656121 - DNA, 25 bp, Homo sapien
gctatattgccctcttcaacaggga

SEQ ID NO: 656122 - DNA, 25 bp, Homo sapien
tcttcaacagggaggagcagaggct

SEQ ID NO: 656123 - DNA, 25 bp, Homo sapien
tcagagcagccagagaccaacagca

SEQ ID NO: 656124 - DNA, 25 bp, Homo sapien
gtatacagcaattaactgggttata

SEQ ID NO: 656125 - DNA, 25 bp, Homo sapien
gtgaactgtgtacaatggtggcttt

SEQ ID NO: 656126 - DNA, 25 bp, Homo sapien
tggtggctttatgttttccagaaac

SEQ ID NO: 656127 - DNA, 25 bp, Homo sapien
ttatgttttccagaaacaggagaca

SEQ ID NO: 656128 - DNA, 25 bp, Homo sapien
caagctaaaaaactggacaatccaa

SEQ ID NO: 656129 - DNA, 25 bp, Homo sapien
gctgagggaacagggcattccagat

SEQ ID NO: 656130 - DNA, 25 bp, Homo sapien
gaacagggcattccagataacttag

SEQ ID NO: 656131 - DNA, 25 bp, Homo sapien
attccagataacttagcctccccaa

SEQ ID NO: 656132 - DNA, 25 bp, Homo sapien
ttaccaaacacatgttcaaactgag

SEQ ID NO: 656133 - DNA, 25 bp, Homo sapien
gcagttttaatagcacacacacaca

SEQ ID NO: 656134 - DNA, 25 bp, Homo sapien
ttcataggactttaacaagatgtag

SEQ ID NO: 656135 - DNA, 25 bp, Homo sapien
gactgccaggcgacagttcctccgt

SEQ ID NO: 656136 - DNA, 25 bp, Homo sapien
actgccaggcgacagttcctccgtt

SEQ ID NO: 656137 - DNA, 25 bp, Homo sapien
ctgccaggcgacagttcctccgttt

SEQ ID NO: 656138 - DNA, 25 bp, Homo sapien
tgccaggcgacagttcctccgtttg

SEQ ID NO: 656139 - DNA, 25 bp, Homo sapien
gccaggcgacagttcctccgtttga

SEQ ID NO: 656140 - DNA, 25 bp, Homo sapien
ccaggcgacagttcctccgtttgaa

SEQ ID NO: 656141 - DNA, 25 bp, Homo sapien
caggcgacagttcctccgtttgaaa

SEQ ID NO: 656142 - DNA, 25 bp, Homo sapien
aggcgacagttcctccgtttgaaat

SEQ ID NO: 656143 - DNA, 25 bp, Homo sapien
aatcacgtatatatgttatgaagca

SEQ ID NO: 656144 - DNA, 25 bp, Homo sapien
aaaatacctatgaatctattaccca

SEQ ID NO: 656145 - DNA, 25 bp, Homo sapien
acttgtaaacttttctcccattcat

SEQ ID NO: 656146 - DNA, 25 bp, Homo sapien
ttgtaaacttttctcccattcatct

SEQ ID NO: 656147 - DNA, 25 bp, Homo sapien
tgtaaacttttctcccattcatctt

SEQ ID NO: 656148 - DNA, 25 bp, Homo sapien
gtaaacttttctcccattcatcttc

SEQ ID NO: 656149 - DNA, 25 bp, Homo sapien
aaacttttctcccattcatcttcct

SEQ ID NO: 656150 - DNA, 25 bp, Homo sapien
tcccagaggtaacctctacccttgt

SEQ ID NO: 656151 - DNA, 25 bp, Homo sapien
tatgtgtatccctcagtaatatatt

SEQ ID NO: 656152 - DNA, 25 bp, Homo sapien
gtgtatccctcagtaatatattttt

SEQ ID NO: 656153 - DNA, 25 bp, Homo sapien
tatccctcagtaatatatttttgct

SEQ ID NO: 656154 - DNA, 25 bp, Homo sapien
gtcagtcttagataataccatgcaa

SEQ ID NO: 656155 - DNA, 25 bp, Homo sapien
ttagataataccatgcaaggcaatt

SEQ ID NO: 656156 - DNA, 25 bp, Homo sapien
aaggcaattaaatcactgtgacagc

SEQ ID NO: 656157 - DNA, 25 bp, Homo sapien
gagttccgtcattttgcattacttg

SEQ ID NO: 656158 - DNA, 25 bp, Homo sapien
gcattacttgtatccactcatgttt

SEQ ID NO: 656159 - DNA, 25 bp, Homo sapien
gagttgtcagtcattgcatctgccc

SEQ ID NO: 656160 - DNA, 25 bp, Homo sapien
atctgcccatacatcttctgagaga

SEQ ID NO: 656161 - DNA, 25 bp, Homo sapien
atcttctgagagaacctgcttcctt

SEQ ID NO: 656162 - DNA, 25 bp, Homo sapien
tgagagaacctgcttccttccatca

SEQ ID NO: 656163 - DNA, 25 bp, Homo sapien
catacctaagacctgcacctaagtg

SEQ ID NO: 656164 - DNA, 25 bp, Homo sapien
ctgcacctaagtggccatgtttgct

SEQ ID NO: 656165 - DNA, 25 bp, Homo sapien
ttaaccattttcccactttatcgtg

SEQ ID NO: 656166 - DNA, 25 bp, Homo sapien
taaccattttcccactttatcgtga

SEQ ID NO: 656167 - DNA, 25 bp, Homo sapien
ccattttcccactttatcgtgaaat

SEQ ID NO: 656168 - DNA, 25 bp, Homo sapien
cattttcccactttatcgtgaaata

SEQ ID NO: 656169 - DNA, 25 bp, Homo sapien
attttcccactttatcgtgaaatat

SEQ ID NO: 656170 - DNA, 25 bp, Homo sapien
ttttcccactttatcgtgaaatatt

SEQ ID NO: 656171 - DNA, 25 bp, Homo sapien
tttcccactttatcgtgaaatattt

SEQ ID NO: 656172 - DNA, 25 bp, Homo sapien
ttcccactttatcgtgaaatatttt

SEQ ID NO: 656173 - DNA, 25 bp, Homo sapien
tcccactttatcgtgaaatatttta

SEQ ID NO: 656174 - DNA, 25 bp, Homo sapien
cccaagctggagagctgtggtatga

SEQ ID NO: 656175 - DNA, 25 bp, Homo sapien
ccaagctggagagctgtggtatgat

SEQ ID NO: 656176 - DNA, 25 bp, Homo sapien
aagctggagagctgtggtatgatca

SEQ ID NO: 656177 - DNA, 25 bp, Homo sapien
agctggagagctgtggtatgatcac

SEQ ID NO: 656178 - DNA, 25 bp, Homo sapien
gctggagagctgtggtatgatcact

SEQ ID NO: 656179 - DNA, 25 bp, Homo sapien
ctggagagctgtggtatgatcactg

SEQ ID NO: 656180 - DNA, 25 bp, Homo sapien
tggagagctgtggtatgatcactgc

SEQ ID NO: 656181 - DNA, 25 bp, Homo sapien
agagctgtggtatgatcactgcagc

SEQ ID NO: 656182 - DNA, 25 bp, Homo sapien
gagctgtggtatgatcactgcagcc

SEQ ID NO: 656183 - DNA, 25 bp, Homo sapien
agctgtggtatgatcactgcagcct

SEQ ID NO: 656184 - DNA, 25 bp, Homo sapien
tgtggtatgatcactgcagcctcaa

SEQ ID NO: 656185 - DNA, 25 bp, Homo sapien
gatacagggtctaattgttctataa

SEQ ID NO: 656186 - DNA, 25 bp, Homo sapien
aatactcatacccattttatctaga

SEQ ID NO: 656187 - DNA, 25 bp, Homo sapien
gttcaatggatctataaatctcccc

SEQ ID NO: 656188 - DNA, 25 bp, Homo sapien
cccctgggattcatcatagtaactg

SEQ ID NO: 656189 - DNA, 25 bp, Homo sapien
acggaacctttgaccccaatggcag

SEQ ID NO: 656190 - DNA, 25 bp, Homo sapien
acaaagagattactaggatccgcta

SEQ ID NO: 656191 - DNA, 25 bp, Homo sapien
ggatccgctagatatttactgatga

SEQ ID NO: 656192 - DNA, 25 bp, Homo sapien
tcagagctccaaccagtacaggaat

SEQ ID NO: 656193 - DNA, 25 bp, Homo sapien
ggaataatggtaaactcatccttat

SEQ ID NO: 656194 - DNA, 25 bp, Homo sapien
atccttatggctttccatggcttta

SEQ ID NO: 656195 - DNA, 25 bp, Homo sapien
ggctttccatggctttagctgtata

SEQ ID NO: 656196 - DNA, 25 bp, Homo sapien
cagcatttgaactcacattctcagt

SEQ ID NO: 656197 - DNA, 25 bp, Homo sapien
tgaactcacattctcagtggcagag

SEQ ID NO: 656198 - DNA, 25 bp, Homo sapien
ggcagagtcatggtctgtggcacca

SEQ ID NO: 656199 - DNA, 25 bp, Homo sapien
gtcatggtctgtggcaccatttcaa

SEQ ID NO: 656200 - DNA, 25 bp, Homo sapien
gtctgtggcaccatttcaaggccaa

SEQ ID NO: 656201 - DNA, 25 bp, Homo sapien
tcaaggccaaaaatcccatccaatt

SEQ ID NO: 656202 - DNA, 25 bp, Homo sapien
atccaatttcccttcacatagatga

SEQ ID NO: 656203 - DNA, 25 bp, Homo sapien
atttcccttcacatagatgacagaa

SEQ ID NO: 656204 - DNA, 25 bp, Homo sapien
gaaagtagctgccttaactcgaaca

SEQ ID NO: 656205 - DNA, 25 bp, Homo sapien
gctgccttaactcgaacagttctgg

SEQ ID NO: 656206 - DNA, 25 bp, Homo sapien
gccttaactcgaacagttctgggaa

SEQ ID NO: 656207 - DNA, 25 bp, Homo sapien
atgtgcaaatgtgcctggcttaaac

SEQ ID NO: 656208 - DNA, 25 bp, Homo sapien
gtgcctggcttaaactggtattatt

SEQ ID NO: 656209 - DNA, 25 bp, Homo sapien
gaaaaatctgtcaatgcgctatgca

SEQ ID NO: 656210 - DNA, 25 bp, Homo sapien
tgcgctatgcaaaatgtttggccta

SEQ ID NO: 656211 - DNA, 25 bp, Homo sapien
aatgtttggcctagcaattctactt

SEQ ID NO: 656212 - DNA, 25 bp, Homo sapien
aaataagtacataaggctgggcatg

SEQ ID NO: 656213 - DNA, 25 bp, Homo sapien
ctgggcatgggcataatggctatgc

SEQ ID NO: 656214 - DNA, 25 bp, Homo sapien
cataatggctatgcccagcactttg

SEQ ID NO: 656215 - DNA, 25 bp, Homo sapien
gcactttgggagaatcgtgtaagtc

SEQ ID NO: 656216 - DNA, 25 bp, Homo sapien
gaatcgtgtaagtcgaggagttcaa

SEQ ID NO: 656217 - DNA, 25 bp, Homo sapien
cctgagtaggaggagcctggaacta

SEQ ID NO: 656218 - DNA, 25 bp, Homo sapien
tagtgaggccccacctctacctaga

SEQ ID NO: 656219 - DNA, 25 bp, Homo sapien
agtgaggccccacctctacctagaa

SEQ ID NO: 656220 - DNA, 25 bp, Homo sapien
gtgaggccccacctctacctagaat

SEQ ID NO: 656221 - DNA, 25 bp, Homo sapien
tgaggccccacctctacctagaata

SEQ ID NO: 656222 - DNA, 25 bp, Homo sapien
ggccccacctctacctagaatacaa

SEQ ID NO: 656223 - DNA, 25 bp, Homo sapien
ccacctctacctagaatacaaaaat

SEQ ID NO: 656224 - DNA, 25 bp, Homo sapien
aatcagctggttgtggtgttaccct

SEQ ID NO: 656225 - DNA, 25 bp, Homo sapien
agctggttgtggtgttaccctcctg

SEQ ID NO: 656226 - DNA, 25 bp, Homo sapien
ggttgtggtgttaccctcctgtggt

SEQ ID NO: 656227 - DNA, 25 bp, Homo sapien
aagatctcaaatcagtcacctaact

SEQ ID NO: 656228 - DNA, 25 bp, Homo sapien
gaactaaacccaagctagcagaata

SEQ ID NO: 656229 - DNA, 25 bp, Homo sapien
aagtgacacacttatggcttgatca

SEQ ID NO: 656230 - DNA, 25 bp, Homo sapien
tatggcttgatcaggaatttgtttg

SEQ ID NO: 656231 - DNA, 25 bp, Homo sapien
gtaaccatcataagttttagtactg

SEQ ID NO: 656232 - DNA, 25 bp, Homo sapien
gattataagaaactcaaggacacag

SEQ ID NO: 656233 - DNA, 25 bp, Homo sapien
tttgtaaacctagcatatagcacag

SEQ ID NO: 656234 - DNA, 25 bp, Homo sapien
tagcatatagcacaggacctggcat

SEQ ID NO: 656235 - DNA, 25 bp, Homo sapien
ggacctggcatgaacttgtcactca

SEQ ID NO: 656236 - DNA, 25 bp, Homo sapien
tggcatgaacttgtcactcagtaga

SEQ ID NO: 656237 - DNA, 25 bp, Homo sapien
gtcactcagtagacatttttggaat

SEQ ID NO: 656238 - DNA, 25 bp, Homo sapien
gagcatctgaaatgtagtgcaactt

SEQ ID NO: 656239 - DNA, 25 bp, Homo sapien
caagattttgtctgggtgatgttcc

SEQ ID NO: 656240 - DNA, 25 bp, Homo sapien
tcatgtgctgctgacagcatcgcat

SEQ ID NO: 656241 - DNA, 25 bp, Homo sapien
tgacagcatcgcattcgcccgtgct

SEQ ID NO: 656242 - DNA, 25 bp, Homo sapien
tgtactgcctctcaccatttcattc

SEQ ID NO: 656243 - DNA, 25 bp, Homo sapien
gggatgcttttacagtctggaaaga

SEQ ID NO: 656244 - DNA, 25 bp, Homo sapien
taatctgttgtgacaatgcactttt

SEQ ID NO: 656245 - DNA, 25 bp, Homo sapien
tatagtactgtacatttttggcatg

SEQ ID NO: 656246 - DNA, 25 bp, Homo sapien
ttttggcatgtaccattacaggctt

SEQ ID NO: 656247 - DNA, 25 bp, Homo sapien
taccattacaggcttcagtatacag

SEQ ID NO: 656248 - DNA, 25 bp, Homo sapien
tacagtcaggtttgttcttcacggt

SEQ ID NO: 656249 - DNA, 25 bp, Homo sapien
tcaggtttgttcttcacggtgtatc

SEQ ID NO: 656250 - DNA, 25 bp, Homo sapien
ttcttcacggtgtatctttataata

SEQ ID NO: 656251 - DNA, 25 bp, Homo sapien
tctcatccccaggtgatcagtttga

SEQ ID NO: 656252 - DNA, 25 bp, Homo sapien
tccccaggtgatcagtttgaaattc

SEQ ID NO: 656253 - DNA, 25 bp, Homo sapien
tttgaaattccgctaacccatcaac

SEQ ID NO: 656254 - DNA, 25 bp, Homo sapien
taacccatcaactacagtccgtcat

SEQ ID NO: 656255 - DNA, 25 bp, Homo sapien
tccccaacaacgatgtgagaagctt

SEQ ID NO: 656256 - DNA, 25 bp, Homo sapien
tgttatctggaccttaagacggact

SEQ ID NO: 656257 - DNA, 25 bp, Homo sapien
atctggaccttaagacggactgctc

SEQ ID NO: 656258 - DNA, 25 bp, Homo sapien
ttaagacggactgctccagacctat

SEQ ID NO: 656259 - DNA, 25 bp, Homo sapien
agacggactgctccagacctatgtg

SEQ ID NO: 656260 - DNA, 25 bp, Homo sapien
ctgaggcagattcccactaggactg

SEQ ID NO: 656261 - DNA, 25 bp, Homo sapien
attcccactaggactgcattcaact

SEQ ID NO: 656262 - DNA, 25 bp, Homo sapien
ggatggccaaatgaactccagacca

SEQ ID NO: 656263 - DNA, 25 bp, Homo sapien
ggccaaatgaactccagaccactgg

SEQ ID NO: 656264 - DNA, 25 bp, Homo sapien
tgaactccagaccactggattgtat

SEQ ID NO: 656265 - DNA, 25 bp, Homo sapien
gaccactggattgtataacaggaca

SEQ ID NO: 656266 - DNA, 25 bp, Homo sapien
attgtataacaggacagcaagaggc

SEQ ID NO: 656267 - DNA, 25 bp, Homo sapien
aagaggcagcacagagccgtggaaa

SEQ ID NO: 656268 - DNA, 25 bp, Homo sapien
agccgtggaaagaacctgtagccat

SEQ ID NO: 656269 - DNA, 25 bp, Homo sapien
gaacctgtagccataacatttgatg

SEQ ID NO: 656270 - DNA, 25 bp, Homo sapien
cctgtagccataacatttgatgaat

SEQ ID NO: 656271 - DNA, 25 bp, Homo sapien
gaatcagacatgtgacattagttct

SEQ ID NO: 656272 - DNA, 25 bp, Homo sapien
atgtgacattagttctgtttcttct

SEQ ID NO: 656273 - DNA, 25 bp, Homo sapien
ggacaaattgtctgacacgcgggag

SEQ ID NO: 656274 - DNA, 25 bp, Homo sapien
gacaaattgtctgacacgcgggagc

SEQ ID NO: 656275 - DNA, 25 bp, Homo sapien
acaaattgtctgacacgcgggagct

SEQ ID NO: 656276 - DNA, 25 bp, Homo sapien
aaattgtctgacacgcgggagctac

SEQ ID NO: 656277 - DNA, 25 bp, Homo sapien
aattgtctgacacgcgggagctaca

SEQ ID NO: 656278 - DNA, 25 bp, Homo sapien
tctgacacgcgggagctacagggag

SEQ ID NO: 656279 - DNA, 25 bp, Homo sapien
tcgtgcccatcaagtagagtcggcc

SEQ ID NO: 656280 - DNA, 25 bp, Homo sapien
gtgcccatcaagtagagtcggcccc

SEQ ID NO: 656281 - DNA, 25 bp, Homo sapien
tgcccatcaagtagagtcggcccct

SEQ ID NO: 656282 - DNA, 25 bp, Homo sapien
atcaagtagagtcggcccctcccag

SEQ ID NO: 656283 - DNA, 25 bp, Homo sapien
acgaggtctcaggtcgcccctgtgg

SEQ ID NO: 656284 - DNA, 25 bp, Homo sapien
taaactgcactcacggtcatccccc

SEQ ID NO: 656285 - DNA, 25 bp, Homo sapien
aggatgagggtttcttaagttatgt

SEQ ID NO: 656286 - DNA, 25 bp, Homo sapien
atgagggtttcttaagttatgttga

SEQ ID NO: 656287 - DNA, 25 bp, Homo sapien
ttgaaaattcaaaccttgagtccgg

SEQ ID NO: 656288 - DNA, 25 bp, Homo sapien
tgaaaattcaaaccttgagtccggg

SEQ ID NO: 656289 - DNA, 25 bp, Homo sapien
aaattcaaaccttgagtccgggcat

SEQ ID NO: 656290 - DNA, 25 bp, Homo sapien
aattcaaaccttgagtccgggcatg

SEQ ID NO: 656291 - DNA, 25 bp, Homo sapien
attcaaaccttgagtccgggcatgg

SEQ ID NO: 656292 - DNA, 25 bp, Homo sapien
ttcaaaccttgagtccgggcatggt

SEQ ID NO: 656293 - DNA, 25 bp, Homo sapien
tcaaaccttgagtccgggcatggtg

SEQ ID NO: 656294 - DNA, 25 bp, Homo sapien
gtgaacccaggaagcctgggcgaca

SEQ ID NO: 656295 - DNA, 25 bp, Homo sapien
gaacaagttgttcatcttttctgga

SEQ ID NO: 656296 - DNA, 25 bp, Homo sapien
gttcatcttttctggatagttctct

SEQ ID NO: 656297 - DNA, 25 bp, Homo sapien
aaaaatggtggctatcaggttgtta

SEQ ID NO: 656298 - DNA, 25 bp, Homo sapien
agagaactatgtgaaggaccctgca

SEQ ID NO: 656299 - DNA, 25 bp, Homo sapien
gaaggaccctgcacagtgctagcaa

SEQ ID NO: 656300 - DNA, 25 bp, Homo sapien
gcacagtgctagcaacaaagttgtt

SEQ ID NO: 656301 - DNA, 25 bp, Homo sapien
gtttagtaagtgctatttcaattta

SEQ ID NO: 656302 - DNA, 25 bp, Homo sapien
aagctcatgtgagctccctcagtgt

SEQ ID NO: 656303 - DNA, 25 bp, Homo sapien
atgtgagctccctcagtgtgtacca

SEQ ID NO: 656304 - DNA, 25 bp, Homo sapien
gtgtgtaccaccaaatcacatgatg

SEQ ID NO: 656305 - DNA, 25 bp, Homo sapien
acatgatgtgtatcccagtcaaatc

SEQ ID NO: 656306 - DNA, 25 bp, Homo sapien
taaatacggagcacctcatggccag

SEQ ID NO: 656307 - DNA, 25 bp, Homo sapien
agggcctggaggattcccaccatac

SEQ ID NO: 656308 - DNA, 25 bp, Homo sapien
ccagcgccaataacagagggaccct

SEQ ID NO: 656309 - DNA, 25 bp, Homo sapien
agcagttcagtgcttgcacacatac

SEQ ID NO: 656310 - DNA, 25 bp, Homo sapien
gtgcttgcacacatactagttgaga

SEQ ID NO: 656311 - DNA, 25 bp, Homo sapien
atcagggctaatgaaacagctcaac

SEQ ID NO: 656312 - DNA, 25 bp, Homo sapien
acagctcaactgtctggcagagcca

SEQ ID NO: 656313 - DNA, 25 bp, Homo sapien
cagagccaggctccttctgccatga

SEQ ID NO: 656314 - DNA, 25 bp, Homo sapien
ggatgtttgtccctttctaatctta

SEQ ID NO: 656315 - DNA, 25 bp, Homo sapien
gtttgtccctttctaatcttatatg

SEQ ID NO: 656316 - DNA, 25 bp, Homo sapien
atcttatatggaaatttgatcccca

SEQ ID NO: 656317 - DNA, 25 bp, Homo sapien
gggctgggggtctggcgggtgtttg

SEQ ID NO: 656318 - DNA, 25 bp, Homo sapien
tcctccgtttgaaatctcgccggct

SEQ ID NO: 656319 - DNA, 25 bp, Homo sapien
tccgtttgaaatctcgccggctcct

SEQ ID NO: 656320 - DNA, 25 bp, Homo sapien
ccgtttgaaatctcgccggctcctg

SEQ ID NO: 656321 - DNA, 25 bp, Homo sapien
cgtttgaaatctcgccggctcctga

SEQ ID NO: 656322 - DNA, 25 bp, Homo sapien
gtttgaaatctcgccggctcctgag

SEQ ID NO: 656323 - DNA, 25 bp, Homo sapien
tttgaaatctcgccggctcctgagc

SEQ ID NO: 656324 - DNA, 25 bp, Homo sapien
ttgaaatctcgccggctcctgagcg

SEQ ID NO: 656325 - DNA, 25 bp, Homo sapien
aaatctcgccggctcctgagcgggc

SEQ ID NO: 656326 - DNA, 25 bp, Homo sapien
atctcgccggctcctgagcgggcca

SEQ ID NO: 656327 - DNA, 25 bp, Homo sapien
tcgccggctcctgagcgggccaccg

SEQ ID NO: 656328 - DNA, 25 bp, Homo sapien
atcacaaaagacaatcatgcagtag

SEQ ID NO: 656329 - DNA, 25 bp, Homo sapien
aaagacaatcatgcagtagataatt

SEQ ID NO: 656330 - DNA, 25 bp, Homo sapien
gacaatcatgcagtagataattaag

SEQ ID NO: 656331 - DNA, 25 bp, Homo sapien
gtataatggaagcattcaaatgttt

SEQ ID NO: 656332 - DNA, 25 bp, Homo sapien
ttatttgtacagatcaagacttact

SEQ ID NO: 656333 - DNA, 25 bp, Homo sapien
atttgtacagatcaagacttactaa

SEQ ID NO: 656334 - DNA, 25 bp, Homo sapien
gtacagatcaagacttactaatatg

SEQ ID NO: 656335 - DNA, 25 bp, Homo sapien
acagatcaagacttactaatatgct

SEQ ID NO: 656336 - DNA, 25 bp, Homo sapien
gatcaagacttactaatatgctaaa

SEQ ID NO: 656337 - DNA, 25 bp, Homo sapien
agacttactaatatgctaaaaagga

SEQ ID NO: 656338 - DNA, 25 bp, Homo sapien
ctaatatgctaaaaaggaacagtta

SEQ ID NO: 656339 - DNA, 25 bp, Homo sapien
ctgcagtaggatgggagggaaggtt

SEQ ID NO: 656340 - DNA, 25 bp, Homo sapien
gaccaccgagaggaggctgaatttc

SEQ ID NO: 656341 - DNA, 25 bp, Homo sapien
accaccgagaggaggctgaatttct

SEQ ID NO: 656342 - DNA, 25 bp, Homo sapien
ccaccgagaggaggctgaatttctc

SEQ ID NO: 656343 - DNA, 25 bp, Homo sapien
accgagaggaggctgaatttctcaa

SEQ ID NO: 656344 - DNA, 25 bp, Homo sapien
ccgagaggaggctgaatttctcaag

SEQ ID NO: 656345 - DNA, 25 bp, Homo sapien
cgagaggaggctgaatttctcaagc

SEQ ID NO: 656346 - DNA, 25 bp, Homo sapien
gagaggaggctgaatttctcaagcc

SEQ ID NO: 656347 - DNA, 25 bp, Homo sapien
accctctccctgaatctacccacat

SEQ ID NO: 656348 - DNA, 25 bp, Homo sapien
tctccctgaatctacccacatcccc

SEQ ID NO: 656349 - DNA, 25 bp, Homo sapien
cacatcccccttccctgtctgtgtc

SEQ ID NO: 656350 - DNA, 25 bp, Homo sapien
attcgggtggtgttattttatatat

SEQ ID NO: 656351 - DNA, 25 bp, Homo sapien
tttaaatttttctcttgccaagtat

SEQ ID NO: 656352 - DNA, 25 bp, Homo sapien
attaatccatagttttgcatttcag

SEQ ID NO: 656353 - DNA, 25 bp, Homo sapien
gcatttcagaagctcatttctctct

SEQ ID NO: 656354 - DNA, 25 bp, Homo sapien
gaagctcatttctctctattgctga

SEQ ID NO: 656355 - DNA, 25 bp, Homo sapien
ttctctctattgctgagtactccca

SEQ ID NO: 656356 - DNA, 25 bp, Homo sapien
tgagtactcccatcctatgaagttc

SEQ ID NO: 656357 - DNA, 25 bp, Homo sapien
actcccatcctatgaagttctctat

SEQ ID NO: 656358 - DNA, 25 bp, Homo sapien
tgaagttctctattcatctgttttt

SEQ ID NO: 656359 - DNA, 25 bp, Homo sapien
taaggtattacgaacaaggtgttat

SEQ ID NO: 656360 - DNA, 25 bp, Homo sapien
atacttagattgctgagtcatataa

SEQ ID NO: 656361 - DNA, 25 bp, Homo sapien
ggaaaaactgaatatcaccgagata

SEQ ID NO: 656362 - DNA, 25 bp, Homo sapien
tgaatatcaccgagatacacacaca

SEQ ID NO: 656363 - DNA, 25 bp, Homo sapien
acaccccttactgcctttggataag

SEQ ID NO: 656364 - DNA, 25 bp, Homo sapien
aggctgtggatgttgttgttgtcat

SEQ ID NO: 656365 - DNA, 25 bp, Homo sapien
ttcattcatatgtagctccacacca

SEQ ID NO: 656366 - DNA, 25 bp, Homo sapien
attcatatgtagctccacaccaggc

SEQ ID NO: 656367 - DNA, 25 bp, Homo sapien
acaccaggccccttgtgtcttgttt

SEQ ID NO: 656368 - DNA, 25 bp, Homo sapien
gccccttgtgtcttgtttggataga

SEQ ID NO: 656369 - DNA, 25 bp, Homo sapien
tttttctcttgatttctacctccct

SEQ ID NO: 656370 - DNA, 25 bp, Homo sapien
tcttgatttctacctccctgttaaa

SEQ ID NO: 656371 - DNA, 25 bp, Homo sapien
tctacctccctgttaaaattgacca

SEQ ID NO: 656372 - DNA, 25 bp, Homo sapien
tattcttctataccacttgcccttt

SEQ ID NO: 656373 - DNA, 25 bp, Homo sapien
ttgccctttgaaaccctcaacttga

SEQ ID NO: 656374 - DNA, 25 bp, Homo sapien
ctcaacttgaggtaatgtgcagtct

SEQ ID NO: 656375 - DNA, 25 bp, Homo sapien
atgcacagagttgagttttaaccaa

SEQ ID NO: 656376 - DNA, 25 bp, Homo sapien
aatatttcgaaccaccacattcttc

SEQ ID NO: 656377 - DNA, 25 bp, Homo sapien
cacattcttcatggtcattttagtt

SEQ ID NO: 656378 - DNA, 25 bp, Homo sapien
acatagtcattgagtggccagccac

SEQ ID NO: 656379 - DNA, 25 bp, Homo sapien
aatctcccagcatccaagattggag

SEQ ID NO: 656380 - DNA, 25 bp, Homo sapien
ggagattcctggtctgtgtagagta

SEQ ID NO: 656381 - DNA, 25 bp, Homo sapien
gagtatatggttttgcacgaaatct

SEQ ID NO: 656382 - DNA, 25 bp, Homo sapien
gttttgcacgaaatctttctagtct

SEQ ID NO: 656383 - DNA, 25 bp, Homo sapien
aggcagaaacaccagttgacgctta

SEQ ID NO: 656384 - DNA, 25 bp, Homo sapien
gttgacgcttactccaatgggcaag

SEQ ID NO: 656385 - DNA, 25 bp, Homo sapien
ggcaagcagctctcatgggtgagaa

SEQ ID NO: 656386 - DNA, 25 bp, Homo sapien
atggaggtcggtactggaagttcat

SEQ ID NO: 656387 - DNA, 25 bp, Homo sapien
gttcatagactggttttgtggcttt

SEQ ID NO: 656388 - DNA, 25 bp, Homo sapien
gctttaaaagtaagagcctcagcaa

SEQ ID NO: 656389 - DNA, 25 bp, Homo sapien
tcagcaagaggagtctcagagacct

SEQ ID NO: 656390 - DNA, 25 bp, Homo sapien
ttacagatgctagaagagactcggc

SEQ ID NO: 656391 - DNA, 25 bp, Homo sapien
gagactcggcaagttaaagtaatac

SEQ ID NO: 656392 - DNA, 25 bp, Homo sapien
attggactttttgctgtgtgttcac

SEQ ID NO: 656393 - DNA, 25 bp, Homo sapien
gtgtgttcacttggaattttcatgt

SEQ ID NO: 656394 - DNA, 25 bp, Homo sapien
gtccacctaaagtcttcaaattgaa

SEQ ID NO: 656395 - DNA, 25 bp, Homo sapien
tcactcttttttcttcataggtttg

SEQ ID NO: 656396 - DNA, 25 bp, Homo sapien
ttcttcataggtttgacagtgtagc

SEQ ID NO: 656397 - DNA, 25 bp, Homo sapien
gaaaccctgtataccaatctgttat

SEQ ID NO: 656398 - DNA, 25 bp, Homo sapien
aagctcttaagaaacactggtcatt

SEQ ID NO: 656399 - DNA, 25 bp, Homo sapien
agaaacactggtcattcaaaagctg

SEQ ID NO: 656400 - DNA, 25 bp, Homo sapien
aaaacagccatttgtaggagaggat

SEQ ID NO: 656401 - DNA, 25 bp, Homo sapien
aaatttcagtgctaagtcagattca

SEQ ID NO: 656402 - DNA, 25 bp, Homo sapien
cagtgctaagtcagattcaggaatc

SEQ ID NO: 656403 - DNA, 25 bp, Homo sapien
gctgtttctcattgtccacctaaag

SEQ ID NO: 656404 - DNA, 25 bp, Homo sapien
ctcattgtccacctaaagtcttcaa

SEQ ID NO: 656405 - DNA, 25 bp, Homo sapien
aggccctggtcagtgcttgtcctgt

SEQ ID NO: 656406 - DNA, 25 bp, Homo sapien
ctggtcagtgcttgtcctgtcgaaa

SEQ ID NO: 656407 - DNA, 25 bp, Homo sapien
gtcagtgcttgtcctgtcgaaatta

SEQ ID NO: 656408 - DNA, 25 bp, Homo sapien
agtgcttgtcctgtcgaaattatag

SEQ ID NO: 656409 - DNA, 25 bp, Homo sapien
gcttgtcctgtcgaaattatagccg

SEQ ID NO: 656410 - DNA, 25 bp, Homo sapien
attatagccgaggaggtgtctgtgt

SEQ ID NO: 656411 - DNA, 25 bp, Homo sapien
cgaggaggtgtctgtgtgacccact

SEQ ID NO: 656412 - DNA, 25 bp, Homo sapien
tgtgtgacccactgcaactttctga

SEQ ID NO: 656413 - DNA, 25 bp, Homo sapien
tgtgacccactgcaactttctgaat

SEQ ID NO: 656414 - DNA, 25 bp, Homo sapien
gtgacccactgcaactttctgaatg

SEQ ID NO: 656415 - DNA, 25 bp, Homo sapien
gacccactgcaactttctgaatggg

SEQ ID NO: 656416 - DNA, 25 bp, Homo sapien
atgtattctctagccaaaaattttg

SEQ ID NO: 656417 - DNA, 25 bp, Homo sapien
gccaaaaattttgcagcaccagtgt

SEQ ID NO: 656418 - DNA, 25 bp, Homo sapien
gcagcaccagtgtagagattgttaa

SEQ ID NO: 656419 - DNA, 25 bp, Homo sapien
taattctaacttactctctaccacc

SEQ ID NO: 656420 - DNA, 25 bp, Homo sapien
tactctctaccacccttgtggaata

SEQ ID NO: 656421 - DNA, 25 bp, Homo sapien
accacccttgtggaatattccgtca

SEQ ID NO: 656422 - DNA, 25 bp, Homo sapien
gaatattccgtcagtctttatttag

SEQ ID NO: 656423 - DNA, 25 bp, Homo sapien
attctctcacctctgtcactgtaaa

SEQ ID NO: 656424 - DNA, 25 bp, Homo sapien
gtaaaacacagttgctactcattgc

SEQ ID NO: 656425 - DNA, 25 bp, Homo sapien
agttgctactcattgctttctgaaa

SEQ ID NO: 656426 - DNA, 25 bp, Homo sapien
aaagttactgtttgcaaatctataa

SEQ ID NO: 656427 - DNA, 25 bp, Homo sapien
caaagacaagagctaatgatttaag

SEQ ID NO: 656428 - DNA, 25 bp, Homo sapien
gttgaaaaataaagtccatgatcct

SEQ ID NO: 656429 - DNA, 25 bp, Homo sapien
taaagtccatgatccttagaattag

SEQ ID NO: 656430 - DNA, 25 bp, Homo sapien
gtccatgatccttagaattagaaaa

SEQ ID NO: 656431 - DNA, 25 bp, Homo sapien
gaacgcggcttctcggaaaggaaga

SEQ ID NO: 656432 - DNA, 25 bp, Homo sapien
gggcgccgcagaggcacaaagccaa

SEQ ID NO: 656433 - DNA, 25 bp, Homo sapien
gctgttcttggctgtaaattagact

SEQ ID NO: 656434 - DNA, 25 bp, Homo sapien
tcttggctgtaaattagactttgaa

SEQ ID NO: 656435 - DNA, 25 bp, Homo sapien
cataaaaacagtaacctcttcccat

SEQ ID NO: 656436 - DNA, 25 bp, Homo sapien
ttaagtaggcaggaagtaagcagac

SEQ ID NO: 656437 - DNA, 25 bp, Homo sapien
gcaggaagtaagcagacagtaaaat

SEQ ID NO: 656438 - DNA, 25 bp, Homo sapien
aaagagcaggtgactgaacccgctg

SEQ ID NO: 656439 - DNA, 25 bp, Homo sapien
caggtgactgaacccgctgctaaag

SEQ ID NO: 656440 - DNA, 25 bp, Homo sapien
acccgctgctaaagtgcccatgaag

SEQ ID NO: 656441 - DNA, 25 bp, Homo sapien
catgaagcccaagagggttgtcgca

SEQ ID NO: 656442 - DNA, 25 bp, Homo sapien
cccaagagggttgtcgcagaagaaa

SEQ ID NO: 656443 - DNA, 25 bp, Homo sapien
gtacctgtccctagaaaagaagtag

SEQ ID NO: 656444 - DNA, 25 bp, Homo sapien
aagaagtagcaccacctgttagagt

SEQ ID NO: 656445 - DNA, 25 bp, Homo sapien
caccacctgttagagtgccagaagt

SEQ ID NO: 656446 - DNA, 25 bp, Homo sapien
agagtgccagaagtgcctaaagaac

SEQ ID NO: 656447 - DNA, 25 bp, Homo sapien
cagaagtgcctaaagaacttgaacc

SEQ ID NO: 656448 - DNA, 25 bp, Homo sapien
gcagtgatacagtcaaagtgctgag

SEQ ID NO: 656449 - DNA, 25 bp, Homo sapien
taagtctacctcctaacttctctaa

SEQ ID NO: 656450 - DNA, 25 bp, Homo sapien
taacttctctaagtgttcagacagt

SEQ ID NO: 656451 - DNA, 25 bp, Homo sapien
tttctgcagcaccaacaagcctaaa

SEQ ID NO: 656452 - DNA, 25 bp, Homo sapien
ttaccaacccattactccacagtgg

SEQ ID NO: 656453 - DNA, 25 bp, Homo sapien
aaacgtggagcacagcacttgctgt

SEQ ID NO: 656454 - DNA, 25 bp, Homo sapien
gtccagtccctggtctctaagttgg

SEQ ID NO: 656455 - DNA, 25 bp, Homo sapien
taagttgggcccctagcatagccag

SEQ ID NO: 656456 - DNA, 25 bp, Homo sapien
gcatagccaggagattgcttgggaa

SEQ ID NO: 656457 - DNA, 25 bp, Homo sapien
agcacagaccagagcaaggagactt

SEQ ID NO: 656458 - DNA, 25 bp, Homo sapien
aagaaaggtttctcagccaccatcg

SEQ ID NO: 656459 - DNA, 25 bp, Homo sapien
agccaccatcgttcgaggtttcctt

SEQ ID NO: 656460 - DNA, 25 bp, Homo sapien
gagaatggaaacgaccctagggcaa

SEQ ID NO: 656461 - DNA, 25 bp, Homo sapien
cgaccctagggcaaaatatcaaagt

SEQ ID NO: 656462 - DNA, 25 bp, Homo sapien
taaatttgccaaaagcctctcagaa

SEQ ID NO: 656463 - DNA, 25 bp, Homo sapien
agcctctcagaaaatcactgttatc

SEQ ID NO: 656464 - DNA, 25 bp, Homo sapien
aatcactgttatctgggttccttat

SEQ ID NO: 656465 - DNA, 25 bp, Homo sapien
actgttatctgggttccttatagga

SEQ ID NO: 656466 - DNA, 25 bp, Homo sapien
atctgggttccttataggattatta

SEQ ID NO: 656467 - DNA, 25 bp, Homo sapien
aaaataggcctttcatagataagtg

SEQ ID NO: 656468 - DNA, 25 bp, Homo sapien
tagcatttgtgaaaagaacccattt

SEQ ID NO: 656469 - DNA, 25 bp, Homo sapien
gaacccattttcattcataagcaat

SEQ ID NO: 656470 - DNA, 25 bp, Homo sapien
tttcattcataagcaatatagccaa

SEQ ID NO: 656471 - DNA, 25 bp, Homo sapien
accgccaggaccaggatgcacacaa

SEQ ID NO: 656472 - DNA, 25 bp, Homo sapien
aggatgcacacaatcacagccacga

SEQ ID NO: 656473 - DNA, 25 bp, Homo sapien
gatgcacacaatcacagccacgatg

SEQ ID NO: 656474 - DNA, 25 bp, Homo sapien
tgcacacaatcacagccacgatgac

SEQ ID NO: 656475 - DNA, 25 bp, Homo sapien
ttccctgagctcctgcacggcagct

SEQ ID NO: 656476 - DNA, 25 bp, Homo sapien
ggcagcttgcccttcttatagagga

SEQ ID NO: 656477 - DNA, 25 bp, Homo sapien
gcagcttgcccttcttatagaggaa

SEQ ID NO: 656478 - DNA, 25 bp, Homo sapien
agcttgcccttcttatagaggaaat

SEQ ID NO: 656479 - DNA, 25 bp, Homo sapien
ttgcccttcttatagaggaaataga

SEQ ID NO: 656480 - DNA, 25 bp, Homo sapien
aggaaatagaggacagcgcccagca

SEQ ID NO: 656481 - DNA, 25 bp, Homo sapien
aaatagaggacagcgcccagcaccg

SEQ ID NO: 656482 - DNA, 25 bp, Homo sapien
taaccattttcccactttatcgtga

SEQ ID NO: 656483 - DNA, 25 bp, Homo sapien
ccattttcccactttatcgtgaaat

SEQ ID NO: 656484 - DNA, 25 bp, Homo sapien
cattttcccactttatcgtgaaata

SEQ ID NO: 656485 - DNA, 25 bp, Homo sapien
attttcccactttatcgtgaaatat

SEQ ID NO: 656486 - DNA, 25 bp, Homo sapien
ttttcccactttatcgtgaaatatt

SEQ ID NO: 656487 - DNA, 25 bp, Homo sapien
tttcccactttatcgtgaaatattt

SEQ ID NO: 656488 - DNA, 25 bp, Homo sapien
tcccactttatcgtgaaatatttta

SEQ ID NO: 656489 - DNA, 25 bp, Homo sapien
ttaaacacagagaccagtagagagt

SEQ ID NO: 656490 - DNA, 25 bp, Homo sapien
tacctatatattcactactcaactt

SEQ ID NO: 656491 - DNA, 25 bp, Homo sapien
gttaacatttgccagacttatgtcg

SEQ ID NO: 656492 - DNA, 25 bp, Homo sapien
gccagacttatgtcgaatttttcaa

SEQ ID NO: 656493 - DNA, 25 bp, Homo sapien
gggtgcacactgtatgatctcttca

SEQ ID NO: 656494 - DNA, 25 bp, Homo sapien
tgatctcttcatccccaggtgatag

SEQ ID NO: 656495 - DNA, 25 bp, Homo sapien
attagcgtgacggaaacagtggccc

SEQ ID NO: 656496 - DNA, 25 bp, Homo sapien
caggccggtgtctggaatcggcaca

SEQ ID NO: 656497 - DNA, 25 bp, Homo sapien
gaatcggcacatgggcacgttggca

SEQ ID NO: 656498 - DNA, 25 bp, Homo sapien
gcacgttggcacgtcacgtgggcat

SEQ ID NO: 656499 - DNA, 25 bp, Homo sapien
tgaactgcccgtggtgcacacctga

SEQ ID NO: 656500 - DNA, 25 bp, Homo sapien
cacctgagggagttgtgtggcacca

SEQ ID NO: 656501 - DNA, 25 bp, Homo sapien
tgtggcaccagctcggtttggacag

SEQ ID NO: 656502 - DNA, 25 bp, Homo sapien
tggacagtgccctttgttaggtacg

SEQ ID NO: 656503 - DNA, 25 bp, Homo sapien
tgttaggtacggttttctcattggg

SEQ ID NO: 656504 - DNA, 25 bp, Homo sapien
ttctgtgtagatcaagagtgtctta

SEQ ID NO: 656505 - DNA, 25 bp, Homo sapien
tctgtgtagatcaagagtgtcttag

SEQ ID NO: 656506 - DNA, 25 bp, Homo sapien
ctgtgtagatcaagagtgtcttagg

SEQ ID NO: 656507 - DNA, 25 bp, Homo sapien
tgtgtagatcaagagtgtcttaggc

SEQ ID NO: 656508 - DNA, 25 bp, Homo sapien
gtgtagatcaagagtgtcttaggcc

SEQ ID NO: 656509 - DNA, 25 bp, Homo sapien
tgtagatcaagagtgtcttaggccg

SEQ ID NO: 656510 - DNA, 25 bp, Homo sapien
gtagatcaagagtgtcttaggccgg

SEQ ID NO: 656511 - DNA, 25 bp, Homo sapien
tagatcaagagtgtcttaggccggg

SEQ ID NO: 656512 - DNA, 25 bp, Homo sapien
agatcaagagtgtcttaggccgggc

SEQ ID NO: 656513 - DNA, 25 bp, Homo sapien
atcaagagtgtcttaggccgggcgc

SEQ ID NO: 656514 - DNA, 25 bp, Homo sapien
tcaagagtgtcttaggccgggcgcg

SEQ ID NO: 656515 - DNA, 25 bp, Homo sapien
agacctgcgctcctgacatcacagc

SEQ ID NO: 656516 - DNA, 25 bp, Homo sapien
ccaacgaggagagcaggacaccaat

SEQ ID NO: 656517 - DNA, 25 bp, Homo sapien
gaggagagcaggacaccaatgcagt

SEQ ID NO: 656518 - DNA, 25 bp, Homo sapien
ggagagcaggacaccaatgcagtgt

SEQ ID NO: 656519 - DNA, 25 bp, Homo sapien
ggacaccaatgcagtgtcggtttag

SEQ ID NO: 656520 - DNA, 25 bp, Homo sapien
ccaatgcagtgtcggtttagagaga

SEQ ID NO: 656521 - DNA, 25 bp, Homo sapien
tgcagtgtcggtttagagagagaac

SEQ ID NO: 656522 - DNA, 25 bp, Homo sapien
gtgtcggtttagagagagaacctta

SEQ ID NO: 656523 - DNA, 25 bp, Homo sapien
gcaaggaggtacgagacccagccag

SEQ ID NO: 656524 - DNA, 25 bp, Homo sapien
aggaggtacgagacccagccaggtt

SEQ ID NO: 656525 - DNA, 25 bp, Homo sapien
ggtacgagacccagccaggttggca

SEQ ID NO: 656526 - DNA, 25 bp, Homo sapien
aaccatcaagtttaaagactgcttt

SEQ ID NO: 656527 - DNA, 25 bp, Homo sapien
accatcaagtttaaagactgctttg

SEQ ID NO: 656528 - DNA, 25 bp, Homo sapien
ccatcaagtttaaagactgctttgt

SEQ ID NO: 656529 - DNA, 25 bp, Homo sapien
tcaagtttaaagactgctttgtggc

SEQ ID NO: 656530 - DNA, 25 bp, Homo sapien
cacagatataagcccagacgcctgg

SEQ ID NO: 656531 - DNA, 25 bp, Homo sapien
cagatataagcccagacgcctgggc

SEQ ID NO: 656532 - DNA, 25 bp, Homo sapien
agatataagcccagacgcctgggcg

SEQ ID NO: 656533 - DNA, 25 bp, Homo sapien
gatataagcccagacgcctgggcga

SEQ ID NO: 656534 - DNA, 25 bp, Homo sapien
atataagcccagacgcctgggcgag

SEQ ID NO: 656535 - DNA, 25 bp, Homo sapien
tataagcccagacgcctgggcgaga

SEQ ID NO: 656536 - DNA, 25 bp, Homo sapien
aagcccagacgcctgggcgagagtg

SEQ ID NO: 656537 - DNA, 25 bp, Homo sapien
ttccttgggcttcagttatttaaag

SEQ ID NO: 656538 - DNA, 25 bp, Homo sapien
tccttgggcttcagttatttaaagt

SEQ ID NO: 656539 - DNA, 25 bp, Homo sapien
tgggcttcagttatttaaagtaaat

SEQ ID NO: 656540 - DNA, 25 bp, Homo sapien
ggtgtaatatagaaaactgtccctt

SEQ ID NO: 656541 - DNA, 25 bp, Homo sapien
atatagaaaactgtccctttccagg

SEQ ID NO: 656542 - DNA, 25 bp, Homo sapien
atagaaaactgtccctttccaggtg

SEQ ID NO: 656543 - DNA, 25 bp, Homo sapien
aactgtccctttccaggtgggagct

SEQ ID NO: 656544 - DNA, 25 bp, Homo sapien
tgtccctttccaggtgggagcttaa

SEQ ID NO: 656545 - DNA, 25 bp, Homo sapien
tccctttccaggtgggagcttaaca

SEQ ID NO: 656546 - DNA, 25 bp, Homo sapien
ctttccaggtgggagcttaacacct

SEQ ID NO: 656547 - DNA, 25 bp, Homo sapien
aggtgggagcttaacacctgtataa

SEQ ID NO: 656548 - DNA, 25 bp, Homo sapien
tcaaccacctggtacaacagcaggc

SEQ ID NO: 656549 - DNA, 25 bp, Homo sapien
acctggtacaacagcaggctctgaa

SEQ ID NO: 656550 - DNA, 25 bp, Homo sapien
gaacctagaggtacaagcaatgtct

SEQ ID NO: 656551 - DNA, 25 bp, Homo sapien
cctagaggtacaagcaatgtctccc

SEQ ID NO: 656552 - DNA, 25 bp, Homo sapien
agcctcaatgagaatcaccacccat

SEQ ID NO: 656553 - DNA, 25 bp, Homo sapien
gaatcaccacccataaataagctaa

SEQ ID NO: 656554 - DNA, 25 bp, Homo sapien
gattataatctttcgaatatgttca

SEQ ID NO: 656555 - DNA, 25 bp, Homo sapien
tatgttcaaaacaggtctgactagt

SEQ ID NO: 656556 - DNA, 25 bp, Homo sapien
aacaggtctgactagtgactatgag

SEQ ID NO: 656557 - DNA, 25 bp, Homo sapien
gaatggagctatttagagttgattt

SEQ ID NO: 656558 - DNA, 25 bp, Homo sapien
gaaaacactttattgttcagcaatt

SEQ ID NO: 656559 - DNA, 25 bp, Homo sapien
agaatagtagtataatgaacctcat

SEQ ID NO: 656560 - DNA, 25 bp, Homo sapien
tataatgaacctcatgtgtgtacca

SEQ ID NO: 656561 - DNA, 25 bp, Homo sapien
tagtcttattttcttccctcccata

SEQ ID NO: 656562 - DNA, 25 bp, Homo sapien
attttcttccctcccataaatgtgt

SEQ ID NO: 656563 - DNA, 25 bp, Homo sapien
tttcttccctcccataaatgtgtta

SEQ ID NO: 656564 - DNA, 25 bp, Homo sapien
tcttccctcccataaatgtgttaaa

SEQ ID NO: 656565 - DNA, 25 bp, Homo sapien
ttccctcccataaatgtgttaaaat

SEQ ID NO: 656566 - DNA, 25 bp, Homo sapien
tgtgttaaaatctctgtgtgtattg

SEQ ID NO: 656567 - DNA, 25 bp, Homo sapien
gtgttaaaatctctgtgtgtattgt

SEQ ID NO: 656568 - DNA, 25 bp, Homo sapien
gttaaaatctctgtgtgtattgttt

SEQ ID NO: 656569 - DNA, 25 bp, Homo sapien
ttaaaatctctgtgtgtattgtttt

SEQ ID NO: 656570 - DNA, 25 bp, Homo sapien
ggacaaattgtctgacacgcgggag

SEQ ID NO: 656571 - DNA, 25 bp, Homo sapien
aaattgtctgacacgcgggagctac

SEQ ID NO: 656572 - DNA, 25 bp, Homo sapien
aattgtctgacacgcgggagctaca

SEQ ID NO: 656573 - DNA, 25 bp, Homo sapien
gagctacagggagctcgtattctct

SEQ ID NO: 656574 - DNA, 25 bp, Homo sapien
gtattctcttgtgttcgtgttgccc

SEQ ID NO: 656575 - DNA, 25 bp, Homo sapien
tcgtgcccatcaagtagagtcggcc

SEQ ID NO: 656576 - DNA, 25 bp, Homo sapien
tgcccatcaagtagagtcggcccct

SEQ ID NO: 656577 - DNA, 25 bp, Homo sapien
atcaagtagagtcggcccctcccag

SEQ ID NO: 656578 - DNA, 25 bp, Homo sapien
acgaggtctcaggtcgcccctgtgg

SEQ ID NO: 656579 - DNA, 25 bp, Homo sapien
ggcttcctctagagtctcactggtg

SEQ ID NO: 656580 - DNA, 25 bp, Homo sapien
gtaatcacattccttaggaggactg

SEQ ID NO: 656581 - DNA, 25 bp, Homo sapien
tagtaccttagcacatggttgctga

SEQ ID NO: 656582 - DNA, 25 bp, Homo sapien
agcacatggttgctgaatacatgaa

SEQ ID NO: 656583 - DNA, 25 bp, Homo sapien
gagtgagaaaccagaagctctgata

SEQ ID NO: 656584 - DNA, 25 bp, Homo sapien
agctctgatatttaactgccgtgat

SEQ ID NO: 656585 - DNA, 25 bp, Homo sapien
atttaactgccgtgataatgaattc

SEQ ID NO: 656586 - DNA, 25 bp, Homo sapien
atgaattcaatgtgcaactatgggc

SEQ ID NO: 656587 - DNA, 25 bp, Homo sapien
atgtgcaactatgggcaaattgtat

SEQ ID NO: 656588 - DNA, 25 bp, Homo sapien
atttttcattcttattaacactgat

SEQ ID NO: 656589 - DNA, 25 bp, Homo sapien
gataaacttttcaacttatactgac

SEQ ID NO: 656590 - DNA, 25 bp, Homo sapien
actaggctattaacatgatattttg

SEQ ID NO: 656591 - DNA, 25 bp, Homo sapien
gatattttgtttcccattaaatgtg

SEQ ID NO: 656592 - DNA, 25 bp, Homo sapien
agctgaaagacacaaccttcgccca

SEQ ID NO: 656593 - DNA, 25 bp, Homo sapien
gaaagacacaaccttcgcccaggtg

SEQ ID NO: 656594 - DNA, 25 bp, Homo sapien
acaaccttcgcccaggtgctaaaag

SEQ ID NO: 656595 - DNA, 25 bp, Homo sapien
ttcgcccaggtgctaaaagatgaca

SEQ ID NO: 656596 - DNA, 25 bp, Homo sapien
aaaagatgacaccaccacgaaacgc

SEQ ID NO: 656597 - DNA, 25 bp, Homo sapien
agatgacaccaccacgaaacgctgg

SEQ ID NO: 656598 - DNA, 25 bp, Homo sapien
acgaaacgctggcttgcacaactgg

SEQ ID NO: 656599 - DNA, 25 bp, Homo sapien
aaacgctggcttgcacaactggtga

SEQ ID NO: 656600 - DNA, 25 bp, Homo sapien
acgctggcttgcacaactggtgaag

SEQ ID NO: 656601 - DNA, 25 bp, Homo sapien
gcttgcacaactggtgaagaacctg

SEQ ID NO: 656602 - DNA, 25 bp, Homo sapien
agaacctgcaagagggccaggtcac

SEQ ID NO: 656603 - DNA, 25 bp, Homo sapien
tgactagtgagagtgcttgggccct

SEQ ID NO: 656604 - DNA, 25 bp, Homo sapien
actagtgagagtgcttgggccctcc

SEQ ID NO: 656605 - DNA, 25 bp, Homo sapien
tagtgagagtgcttgggccctcccc

SEQ ID NO: 656606 - DNA, 25 bp, Homo sapien
gcacgggaggatggactgacttcca

SEQ ID NO: 656607 - DNA, 25 bp, Homo sapien
gaggatggactgacttccaggacct

SEQ ID NO: 656608 - DNA, 25 bp, Homo sapien
ggatggactgacttccaggacctgt

SEQ ID NO: 656609 - DNA, 25 bp, Homo sapien
atggactgacttccaggacctgttg

SEQ ID NO: 656610 - DNA, 25 bp, Homo sapien
tggactgacttccaggacctgttgt

SEQ ID NO: 656611 - DNA, 25 bp, Homo sapien
ggactgacttccaggacctgttgtg

SEQ ID NO: 656612 - DNA, 25 bp, Homo sapien
agctgatggatgtgctgactagtga

SEQ ID NO: 656613 - DNA, 25 bp, Homo sapien
gatgtgctgactagtgagagtgctt

SEQ ID NO: 656614 - DNA, 25 bp, Homo sapien
tactagctggctttcaacattaaat

SEQ ID NO: 656615 - DNA, 25 bp, Homo sapien
aattgtcttaatggttctaaggcca

SEQ ID NO: 656616 - DNA, 25 bp, Homo sapien
ggttctaaggccattatttgctcta

SEQ ID NO: 656617 - DNA, 25 bp, Homo sapien
ggccattatttgctctatatacctt

SEQ ID NO: 656618 - DNA, 25 bp, Homo sapien
acatattcttgatttgagctctcag

SEQ ID NO: 656619 - DNA, 25 bp, Homo sapien
atttgagctctcagttgccaaaatc

SEQ ID NO: 656620 - DNA, 25 bp, Homo sapien
gatgctgaacatcctctgcattttt

SEQ ID NO: 656621 - DNA, 25 bp, Homo sapien
ttttcctgtaatgatgagttctcca

SEQ ID NO: 656622 - DNA, 25 bp, Homo sapien
gagttctccagcttaagatcttcta

SEQ ID NO: 656623 - DNA, 25 bp, Homo sapien
ctatctcactggctgttaacgcttt

SEQ ID NO: 656624 - DNA, 25 bp, Homo sapien
gaactcttcaagaagtgtcattttt

SEQ ID NO: 656625 - DNA, 25 bp, Homo sapien
ctgcagtaggatgggagggaaggtt

SEQ ID NO: 656626 - DNA, 25 bp, Homo sapien
agttgccagcttgagtgatgtgctt

SEQ ID NO: 656627 - DNA, 25 bp, Homo sapien
gaccaccgagaggaggctgaatttc

SEQ ID NO: 656628 - DNA, 25 bp, Homo sapien
accaccgagaggaggctgaatttct

SEQ ID NO: 656629 - DNA, 25 bp, Homo sapien
ccaccgagaggaggctgaatttctc

SEQ ID NO: 656630 - DNA, 25 bp, Homo sapien
accgagaggaggctgaatttctcaa

SEQ ID NO: 656631 - DNA, 25 bp, Homo sapien
cgagaggaggctgaatttctcaagc

SEQ ID NO: 656632 - DNA, 25 bp, Homo sapien
gagaggaggctgaatttctcaagcc

SEQ ID NO: 656633 - DNA, 25 bp, Homo sapien
accctctccctgaatctacccacat

SEQ ID NO: 656634 - DNA, 25 bp, Homo sapien
ccctgtctgtgtctcaataaatggt

SEQ ID NO: 656635 - DNA, 25 bp, Homo sapien
gtgtctcaataaatggtgcaactgc

SEQ ID NO: 656636 - DNA, 25 bp, Homo sapien
aggattgattgagtccgggagattg

SEQ ID NO: 656637 - DNA, 25 bp, Homo sapien
ggattgattgagtccgggagattga

SEQ ID NO: 656638 - DNA, 25 bp, Homo sapien
gattgattgagtccgggagattgag

SEQ ID NO: 656639 - DNA, 25 bp, Homo sapien
attgattgagtccgggagattgagg

SEQ ID NO: 656640 - DNA, 25 bp, Homo sapien
ttgattgagtccgggagattgaggc

SEQ ID NO: 656641 - DNA, 25 bp, Homo sapien
gattgagtccgggagattgaggctg

SEQ ID NO: 656642 - DNA, 25 bp, Homo sapien
attgagtccgggagattgaggctgc

SEQ ID NO: 656643 - DNA, 25 bp, Homo sapien
tgagccatgatcactcattacactc

SEQ ID NO: 656644 - DNA, 25 bp, Homo sapien
gagccatgatcactcattacactcc

SEQ ID NO: 656645 - DNA, 25 bp, Homo sapien
agccatgatcactcattacactcca

SEQ ID NO: 656646 - DNA, 25 bp, Homo sapien
gccatgatcactcattacactccag

SEQ ID NO: 656647 - DNA, 25 bp, Homo sapien
tagccttggaactctcgccaaagaa

SEQ ID NO: 656648 - DNA, 25 bp, Homo sapien
tgcctgagagactcgcctccgagag

SEQ ID NO: 656649 - DNA, 25 bp, Homo sapien
gaggaagggacagaccaaagcagta

SEQ ID NO: 656650 - DNA, 25 bp, Homo sapien
agtaaatcggccatcctgcagagga

SEQ ID NO: 656651 - DNA, 25 bp, Homo sapien
cgccttctgctgtctgtgggtacag

SEQ ID NO: 656652 - DNA, 25 bp, Homo sapien
tgtgggtacagccagaactcccata

SEQ ID NO: 656653 - DNA, 25 bp, Homo sapien
atacgcgggcgctgaagtgccaaac

SEQ ID NO: 656654 - DNA, 25 bp, Homo sapien
aagtgccaaaccttcgtgcgtgttc

SEQ ID NO: 656655 - DNA, 25 bp, Homo sapien
cttcgtgcgtgttctctagtaatta

SEQ ID NO: 656656 - DNA, 25 bp, Homo sapien
tactccataggcagaacagcctcta

SEQ ID NO: 656657 - DNA, 25 bp, Homo sapien
gcagggtttcggtagccttggaact

SEQ ID NO: 656658 - DNA, 25 bp, Homo sapien
tgttgtgatgaaacgtctgccgctt

SEQ ID NO: 656659 - DNA, 25 bp, Homo sapien
aaacgtctgccgcttttctttctga

SEQ ID NO: 656660 - DNA, 25 bp, Homo sapien
tctttctgacgtttggtttagggca

SEQ ID NO: 656661 - DNA, 25 bp, Homo sapien
acgtttggtttagggcagattcact

SEQ ID NO: 656662 - DNA, 25 bp, Homo sapien
attcactgcagtgcaatcagaacca

SEQ ID NO: 656663 - DNA, 25 bp, Homo sapien
gtgcaatcagaaccagacacagccc

SEQ ID NO: 656664 - DNA, 25 bp, Homo sapien
gggctgagggtagctcgttttccta

SEQ ID NO: 656665 - DNA, 25 bp, Homo sapien
tgagggtagctcgttttcctaactt

SEQ ID NO: 656666 - DNA, 25 bp, Homo sapien
tttcctaactttgtggacaggcgtg

SEQ ID NO: 656667 - DNA, 25 bp, Homo sapien
ttgtggacaggcgtggttagctcat

SEQ ID NO: 656668 - DNA, 25 bp, Homo sapien
caggcgtggttagctcatgtgcagt

SEQ ID NO: 656669 - DNA, 25 bp, Homo sapien
tttcattgttctctccccgtggagt

SEQ ID NO: 656670 - DNA, 25 bp, Homo sapien
ctgttacctttccagcacatcgatg

SEQ ID NO: 656671 - DNA, 25 bp, Homo sapien
gcacatcgatgcgtgacaatgtata

SEQ ID NO: 656672 - DNA, 25 bp, Homo sapien
ttgccaaccagggacgtgctcctga

SEQ ID NO: 656673 - DNA, 25 bp, Homo sapien
gggcttccttgcataggtacgattg

SEQ ID NO: 656674 - DNA, 25 bp, Homo sapien
tgtgactcaaactttagcaccctca

SEQ ID NO: 656675 - DNA, 25 bp, Homo sapien
catttccccagaggtgatcttgtta

SEQ ID NO: 656676 - DNA, 25 bp, Homo sapien
gatcttgttagcatccactatctag

SEQ ID NO: 656677 - DNA, 25 bp, Homo sapien
actctgagtcaccttgttagcatca

SEQ ID NO: 656678 - DNA, 25 bp, Homo sapien
atcaacttagaggtgtgggcccgct

SEQ ID NO: 656679 - DNA, 25 bp, Homo sapien
gtgggcccgctatgataacaaagat

SEQ ID NO: 656680 - DNA, 25 bp, Homo sapien
gaatgagccttgcattcccaagaca

SEQ ID NO: 656681 - DNA, 25 bp, Homo sapien
ttcccaagacaaaccatactttgtt

SEQ ID NO: 656682 - DNA, 25 bp, Homo sapien
aatatactgttagacttgattcact

SEQ ID NO: 656683 - DNA, 25 bp, Homo sapien
tttacatttcagctcttgtggcatt

SEQ ID NO: 656684 - DNA, 25 bp, Homo sapien
atttcagctcttgtggcattttgtt

SEQ ID NO: 656685 - DNA, 25 bp, Homo sapien
attttgttacttgcagtcggccctc

SEQ ID NO: 656686 - DNA, 25 bp, Homo sapien
ctgtatccacaggttctatgtccac

SEQ ID NO: 656687 - DNA, 25 bp, Homo sapien
ggttctatgtccactgactcaatta

SEQ ID NO: 656688 - DNA, 25 bp, Homo sapien
gtccactgactcaattaactggaaa

SEQ ID NO: 656689 - DNA, 25 bp, Homo sapien
gaggtggttcacctagtcccaatga

SEQ ID NO: 656690 - DNA, 25 bp, Homo sapien
ggttcacctagtcccaatgacttaa

SEQ ID NO: 656691 - DNA, 25 bp, Homo sapien
tacagtaaggggagccagtcaagga

SEQ ID NO: 656692 - DNA, 25 bp, Homo sapien
acagtaaggggagccagtcaaggat

SEQ ID NO: 656693 - DNA, 25 bp, Homo sapien
cagtaaggggagccagtcaaggatg

SEQ ID NO: 656694 - DNA, 25 bp, Homo sapien
gggccctgcaatggaactgttcagg

SEQ ID NO: 656695 - DNA, 25 bp, Homo sapien
ggccctgcaatggaactgttcaggt

SEQ ID NO: 656696 - DNA, 25 bp, Homo sapien
gccctgcaatggaactgttcaggtg

SEQ ID NO: 656697 - DNA, 25 bp, Homo sapien
gaactgttcaggtggcatacaataa

SEQ ID NO: 656698 - DNA, 25 bp, Homo sapien
aactgttcaggtggcatacaataaa

SEQ ID NO: 656699 - DNA, 25 bp, Homo sapien
actgttcaggtggcatacaataaaa

SEQ ID NO: 656700 - DNA, 25 bp, Homo sapien
ctgttcaggtggcatacaataaaag

SEQ ID NO: 656701 - DNA, 25 bp, Homo sapien
tccattctgggcaagagctagactc

SEQ ID NO: 656702 - DNA, 25 bp, Homo sapien
ggaactgctatacctttgcttcttt

SEQ ID NO: 656703 - DNA, 25 bp, Homo sapien
aactgctatacctttgcttctttaa

SEQ ID NO: 656704 - DNA, 25 bp, Homo sapien
gctatacctttgcttctttaaaact

SEQ ID NO: 656705 - DNA, 25 bp, Homo sapien
tacctttgcttctttaaaacttgct

SEQ ID NO: 656706 - DNA, 25 bp, Homo sapien
agccgactctccatacctgtagaaa

SEQ ID NO: 656707 - DNA, 25 bp, Homo sapien
ccgactctccatacctgtagaaatt

SEQ ID NO: 656708 - DNA, 25 bp, Homo sapien
gactctccatacctgtagaaattta

SEQ ID NO: 656709 - DNA, 25 bp, Homo sapien
tacctgtagaaatttaatctccttt

SEQ ID NO: 656710 - DNA, 25 bp, Homo sapien
caataggtagtaataggtggatttc

SEQ ID NO: 656711 - DNA, 25 bp, Homo sapien
tggatttctaaaagatttcccaact

SEQ ID NO: 656712 - DNA, 25 bp, Homo sapien
ccatgccgagctgaggaggagtcct

SEQ ID NO: 656713 - DNA, 25 bp, Homo sapien
aggagtcctcttctagctgcacgat

SEQ ID NO: 656714 - DNA, 25 bp, Homo sapien
gtcctcttctagctgcacgatgtgg

SEQ ID NO: 656715 - DNA, 25 bp, Homo sapien
gctgcacgatgtggaaatgacacat

SEQ ID NO: 656716 - DNA, 25 bp, Homo sapien
tggaaatgacacatcatgtccatgg

SEQ ID NO: 656717 - DNA, 25 bp, Homo sapien
gagccaagggtgtgagcacatgact

SEQ ID NO: 656718 - DNA, 25 bp, Homo sapien
gggtgtgagcacatgacttaaattc

SEQ ID NO: 656719 - DNA, 25 bp, Homo sapien
gacttaaattcaagctactgcacag

SEQ ID NO: 656720 - DNA, 25 bp, Homo sapien
aagctactgcacagctttgagatct

SEQ ID NO: 656721 - DNA, 25 bp, Homo sapien
gctttgagatctgagtatcacatgg

SEQ ID NO: 656722 - DNA, 25 bp, Homo sapien
atctgagtatcacatggaagcatcc

SEQ ID NO: 656723 - DNA, 25 bp, Homo sapien
cgtgatagtgagtgaattctcataa

SEQ ID NO: 656724 - DNA, 25 bp, Homo sapien
attctcataagatctaatggttttg

SEQ ID NO: 656725 - DNA, 25 bp, Homo sapien
ttctcataagatctaatggttttgt

SEQ ID NO: 656726 - DNA, 25 bp, Homo sapien
taagatctaatggttttgtaaatgg

SEQ ID NO: 656727 - DNA, 25 bp, Homo sapien
ttgtaaatggtagtttttcctgtgc

SEQ ID NO: 656728 - DNA, 25 bp, Homo sapien
tgtaaatggtagtttttcctgtgct

SEQ ID NO: 656729 - DNA, 25 bp, Homo sapien
gtaaatggtagtttttcctgtgctg

SEQ ID NO: 656730 - DNA, 25 bp, Homo sapien
tttttcctgtgctgactcattctct

SEQ ID NO: 656731 - DNA, 25 bp, Homo sapien
ttttcctgtgctgactcattctctc

SEQ ID NO: 656732 - DNA, 25 bp, Homo sapien
tgaagaggtgccttctgtcatgact

SEQ ID NO: 656733 - DNA, 25 bp, Homo sapien
gaggtgccttctgtcatgactgtaa

SEQ ID NO: 656734 - DNA, 25 bp, Homo sapien
tgggttccaggttcccagctctgag

SEQ ID NO: 656735 - DNA, 25 bp, Homo sapien
gggttccaggttcccagctctgagc

SEQ ID NO: 656736 - DNA, 25 bp, Homo sapien
tggtgctgtgggatgtcttggtcag

SEQ ID NO: 656737 - DNA, 25 bp, Homo sapien
gatgtcttggtcaggtgatctgctt

SEQ ID NO: 656738 - DNA, 25 bp, Homo sapien
catgcccagccagtccctgtcttca

SEQ ID NO: 656739 - DNA, 25 bp, Homo sapien
tacagtcacactgggggttaaacaa

SEQ ID NO: 656740 - DNA, 25 bp, Homo sapien
aatttgggggcgatacaaacattca

SEQ ID NO: 656741 - DNA, 25 bp, Homo sapien
ccactaatctacatcttatctctac

SEQ ID NO: 656742 - DNA, 25 bp, Homo sapien
actaatctacatcttatctctacag

SEQ ID NO: 656743 - DNA, 25 bp, Homo sapien
taatctacatcttatctctacagat

SEQ ID NO: 656744 - DNA, 25 bp, Homo sapien
tacatcttatctctacagatgacct

SEQ ID NO: 656745 - DNA, 25 bp, Homo sapien
aagggactcagagctaggccctctt

SEQ ID NO: 656746 - DNA, 25 bp, Homo sapien
gggactcagagctaggccctcttac

SEQ ID NO: 656747 - DNA, 25 bp, Homo sapien
tcttaggaccccaatcgcaggcggg

SEQ ID NO: 656748 - DNA, 25 bp, Homo sapien
gaggcacccatcgagaggcgagtac

SEQ ID NO: 656749 - DNA, 25 bp, Homo sapien
gcacccatcgagaggcgagtacaga

SEQ ID NO: 656750 - DNA, 25 bp, Homo sapien
aggcgagtacagagagccagcccct

SEQ ID NO: 656751 - DNA, 25 bp, Homo sapien
gcgagtacagagagccagcccctct

SEQ ID NO: 656752 - DNA, 25 bp, Homo sapien
cggcgactgagagcgagcccgtctt

SEQ ID NO: 656753 - DNA, 25 bp, Homo sapien
tcttaggagccccatcgcagaggcg

SEQ ID NO: 656754 - DNA, 25 bp, Homo sapien
gggactgagagccagctcctcatcc

SEQ ID NO: 656755 - DNA, 25 bp, Homo sapien
tggctcttaggacccccatcgcagt

SEQ ID NO: 656756 - DNA, 25 bp, Homo sapien
tgaagagagggcttgctgggagtcc

SEQ ID NO: 656757 - DNA, 25 bp, Homo sapien
gaagagagggcttgctgggagtcct

SEQ ID NO: 656758 - DNA, 25 bp, Homo sapien
aagagagggcttgctgggagtcctc

SEQ ID NO: 656759 - DNA, 25 bp, Homo sapien
agagagggcttgctgggagtcctca

SEQ ID NO: 656760 - DNA, 25 bp, Homo sapien
gagagggcttgctgggagtcctcag

SEQ ID NO: 656761 - DNA, 25 bp, Homo sapien
agagggcttgctgggagtcctcaga

SEQ ID NO: 656762 - DNA, 25 bp, Homo sapien
gagggcttgctgggagtcctcagac

SEQ ID NO: 656763 - DNA, 25 bp, Homo sapien
agggcttgctgggagtcctcagact

SEQ ID NO: 656764 - DNA, 25 bp, Homo sapien
gggcttgctgggagtcctcagactc

SEQ ID NO: 656765 - DNA, 25 bp, Homo sapien
ggcttgctgggagtcctcagactcc

SEQ ID NO: 656766 - DNA, 25 bp, Homo sapien
cccttcctttccagtggcagagggc

SEQ ID NO: 656767 - DNA, 25 bp, Homo sapien
ggcgtgggccactgcgcctggccat

SEQ ID NO: 656768 - DNA, 25 bp, Homo sapien
gcgtgggccactgcgcctggccata

SEQ ID NO: 656769 - DNA, 25 bp, Homo sapien
cgtgggccactgcgcctggccataa

SEQ ID NO: 656770 - DNA, 25 bp, Homo sapien
gtgggccactgcgcctggccataaa

SEQ ID NO: 656771 - DNA, 25 bp, Homo sapien
tgggccactgcgcctggccataaac

SEQ ID NO: 656772 - DNA, 25 bp, Homo sapien
gggccactgcgcctggccataaact

SEQ ID NO: 656773 - DNA, 25 bp, Homo sapien
ggccactgcgcctggccataaactt

SEQ ID NO: 656774 - DNA, 25 bp, Homo sapien
gccactgcgcctggccataaacttt

SEQ ID NO: 656775 - DNA, 25 bp, Homo sapien
tcttcttcatcgatgacctgaacat

SEQ ID NO: 656776 - DNA, 25 bp, Homo sapien
tggtacgaccgcaagatcattggtg

SEQ ID NO: 656777 - DNA, 25 bp, Homo sapien
gtacgaccgcaagatcattggtgcc

SEQ ID NO: 656778 - DNA, 25 bp, Homo sapien
tacgaccgcaagatcattggtgcct

SEQ ID NO: 656779 - DNA, 25 bp, Homo sapien
acgaccgcaagatcattggtgcctt

SEQ ID NO: 656780 - DNA, 25 bp, Homo sapien
gaccgcaagatcattggtgccttca

SEQ ID NO: 656781 - DNA, 25 bp, Homo sapien
accgcaagatcattggtgccttcaa

SEQ ID NO: 656782 - DNA, 25 bp, Homo sapien
ccgcaagatcattggtgccttcaag

SEQ ID NO: 656783 - DNA, 25 bp, Homo sapien
cgcaagatcattggtgccttcaaga

SEQ ID NO: 656784 - DNA, 25 bp, Homo sapien
gcaagatcattggtgccttcaagaa

SEQ ID NO: 656785 - DNA, 25 bp, Homo sapien
caagatcattggtgccttcaagaac

SEQ ID NO: 656786 - DNA, 25 bp, Homo sapien
gtttcatttcaacttatgtttaagg

SEQ ID NO: 656787 - DNA, 25 bp, Homo sapien
gggttcttgataatctgacatgata

SEQ ID NO: 656788 - DNA, 25 bp, Homo sapien
taatctgacatgataagtggtgttg

SEQ ID NO: 656789 - DNA, 25 bp, Homo sapien
catgataagtggtgttggaattggc

SEQ ID NO: 656790 - DNA, 25 bp, Homo sapien
aagtggtgttggaattggcattaaa

SEQ ID NO: 656791 - DNA, 25 bp, Homo sapien
tggaattggcattaaaatccaccat

SEQ ID NO: 656792 - DNA, 25 bp, Homo sapien
aacacttcatccttcttcggcaggc

SEQ ID NO: 656793 - DNA, 25 bp, Homo sapien
ttcatccttcttcggcaggcaccaa

SEQ ID NO: 656794 - DNA, 25 bp, Homo sapien
ggcaccaatttgatcttctactact

SEQ ID NO: 656795 - DNA, 25 bp, Homo sapien
cttctactactttgcagacatctct

SEQ ID NO: 656796 - DNA, 25 bp, Homo sapien
agacatctcttctgcaaacaccaga

SEQ ID NO: 656797 - DNA, 25 bp, Homo sapien
agcatttgacatggtcgacccagcc

SEQ ID NO: 656798 - DNA, 25 bp, Homo sapien
tggttactgccacttattctcctgc

SEQ ID NO: 656799 - DNA, 25 bp, Homo sapien
acttattctcctgcccttgagtttc

SEQ ID NO: 656800 - DNA, 25 bp, Homo sapien
ttccagggtttcatcactggcctct

SEQ ID NO: 656801 - DNA, 25 bp, Homo sapien
atcactggcctcttctcatctgtga

SEQ ID NO: 656802 - DNA, 25 bp, Homo sapien
tgggagagctcatccatctgggctg

SEQ ID NO: 656803 - DNA, 25 bp, Homo sapien
gcctgtggatgctgattattcacaa

SEQ ID NO: 656804 - DNA, 25 bp, Homo sapien
tgattattcacaatgtcctgcccta

SEQ ID NO: 656805 - DNA, 25 bp, Homo sapien
tgatgcttctgtaccctgggccatt

SEQ ID NO: 656806 - DNA, 25 bp, Homo sapien
atttctccagctgcctactggacaa

SEQ ID NO: 656807 - DNA, 25 bp, Homo sapien
tactggacaattgactgccccacag

SEQ ID NO: 656808 - DNA, 25 bp, Homo sapien
agacccaggacttcattgacagcaa

SEQ ID NO: 656809 - DNA, 25 bp, Homo sapien
agcaagctggacaagaggcggaagg

SEQ ID NO: 656810 - DNA, 25 bp, Homo sapien
agggtgtgtttggaccacctctggg

SEQ ID NO: 656811 - DNA, 25 bp, Homo sapien
cggccctggagacctacggtgcaca

SEQ ID NO: 656812 - DNA, 25 bp, Homo sapien
cctggagacctacggtgcacagcca

SEQ ID NO: 656813 - DNA, 25 bp, Homo sapien
tgcacagccacccatcgagctgttg

SEQ ID NO: 656814 - DNA, 25 bp, Homo sapien
ccatcgagctgttgcgccagtggat

SEQ ID NO: 656815 - DNA, 25 bp, Homo sapien
agctgttgcgccagtggatggacca

SEQ ID NO: 656816 - DNA, 25 bp, Homo sapien
ggtgccttcaagaacctagtggaca

SEQ ID NO: 656817 - DNA, 25 bp, Homo sapien
gccttcaagaacctagtggacatca

SEQ ID NO: 656818 - DNA, 25 bp, Homo sapien
ttcaagaacctagtggacatcaact

SEQ ID NO: 656819 - DNA, 25 bp, Homo sapien
gagtcttaatctattagatcccatt

SEQ ID NO: 656820 - DNA, 25 bp, Homo sapien
aatctattagatcccattcagttct

SEQ ID NO: 656821 - DNA, 25 bp, Homo sapien
ctattagatcccattcagttctaat

SEQ ID NO: 656822 - DNA, 25 bp, Homo sapien
gttgtgattttgactttgtagcctc

SEQ ID NO: 656823 - DNA, 25 bp, Homo sapien
gattttgactttgtagcctcatgtt

SEQ ID NO: 656824 - DNA, 25 bp, Homo sapien
gactttgtagcctcatgtttatttt

SEQ ID NO: 656825 - DNA, 25 bp, Homo sapien
tttgtagcctcatgtttattttctc

SEQ ID NO: 656826 - DNA, 25 bp, Homo sapien
tttgctttttcaagttgtcaccagt

SEQ ID NO: 656827 - DNA, 25 bp, Homo sapien
gctttttcaagttgtcaccagttct

SEQ ID NO: 656828 - DNA, 25 bp, Homo sapien
tttcaagttgtcaccagttctttgt

SEQ ID NO: 656829 - DNA, 25 bp, Homo sapien
aatgctaatacaatactactgctaa

SEQ ID NO: 656830 - DNA, 25 bp, Homo sapien
tcttggcttacaaaatctgctctat

SEQ ID NO: 656831 - DNA, 25 bp, Homo sapien
ggcttacaaaatctgctctatgctt

SEQ ID NO: 656832 - DNA, 25 bp, Homo sapien
tacaaaatctgctctatgcttgctg

SEQ ID NO: 656833 - DNA, 25 bp, Homo sapien
aaaatctgctctatgcttgctgact

SEQ ID NO: 656834 - DNA, 25 bp, Homo sapien
aatctgctctatgcttgctgactgc

SEQ ID NO: 656835 - DNA, 25 bp, Homo sapien
tgctctatgcttgctgactgctgaa

SEQ ID NO: 656836 - DNA, 25 bp, Homo sapien
tctatgcttgctgactgctgaatga

SEQ ID NO: 656837 - DNA, 25 bp, Homo sapien
atgcttgctgactgctgaatgaatg

SEQ ID NO: 656838 - DNA, 25 bp, Homo sapien
cacaacgaaacattatttccgtttg

SEQ ID NO: 656839 - DNA, 25 bp, Homo sapien
tatatgaactctaggcatcatgcat

SEQ ID NO: 656840 - DNA, 25 bp, Homo sapien
tgaactctaggcatcatgcatatat

SEQ ID NO: 656841 - DNA, 25 bp, Homo sapien
gagatctcggcgttgtgcatgtcgg

SEQ ID NO: 656842 - DNA, 25 bp, Homo sapien
tgcatgtcgggcgactgctccatga

SEQ ID NO: 656843 - DNA, 25 bp, Homo sapien
gggcgactgctccatgatcttgcgc

SEQ ID NO: 656844 - DNA, 25 bp, Homo sapien
tgctccatgatcttgcgccgctcga

SEQ ID NO: 656845 - DNA, 25 bp, Homo sapien
ctccgcctctcgaatgaaagggatc

SEQ ID NO: 656846 - DNA, 25 bp, Homo sapien
atgaaagggatcttgtcgctgtctt

SEQ ID NO: 656847 - DNA, 25 bp, Homo sapien
aagggatcttgtcgctgtctttgag

SEQ ID NO: 656848 - DNA, 25 bp, Homo sapien
tcttgtcgctgtctttgagcagctt

SEQ ID NO: 656849 - DNA, 25 bp, Homo sapien
ttgagcagcttccagcgtttgccca

SEQ ID NO: 656850 - DNA, 25 bp, Homo sapien
agcgtttgcccagccgcttggagat

SEQ ID NO: 656851 - DNA, 25 bp, Homo sapien
tttgcccagccgcttggagatctcg

SEQ ID NO: 656852 - DNA, 25 bp, Homo sapien
acagcaaatatgagaaacacagcca

SEQ ID NO: 656853 - DNA, 25 bp, Homo sapien
cagcaaatatgagaaacacagccag

SEQ ID NO: 656854 - DNA, 25 bp, Homo sapien
agcaaatatgagaaacacagccagg

SEQ ID NO: 656855 - DNA, 25 bp, Homo sapien
gcaaatatgagaaacacagccaggc

SEQ ID NO: 656856 - DNA, 25 bp, Homo sapien
caaatatgagaaacacagccaggca

SEQ ID NO: 656857 - DNA, 25 bp, Homo sapien
aaatatgagaaacacagccaggcac

SEQ ID NO: 656858 - DNA, 25 bp, Homo sapien
aatatgagaaacacagccaggcact

SEQ ID NO: 656859 - DNA, 25 bp, Homo sapien
atatgagaaacacagccaggcactg

SEQ ID NO: 656860 - DNA, 25 bp, Homo sapien
atgagaaacacagccaggcactgtg

SEQ ID NO: 656861 - DNA, 25 bp, Homo sapien
gtaaccccagcatttaggaaggctg

SEQ ID NO: 656862 - DNA, 25 bp, Homo sapien
agagggcgccattgcgctccaggct

SEQ ID NO: 656863 - DNA, 25 bp, Homo sapien
ctgtgcctggctaatgattaatgtt

SEQ ID NO: 656864 - DNA, 25 bp, Homo sapien
gtgcctggctaatgattaatgttat

SEQ ID NO: 656865 - DNA, 25 bp, Homo sapien
gcctggctaatgattaatgttatta

SEQ ID NO: 656866 - DNA, 25 bp, Homo sapien
taaatggtgaagtccatgtctcaag

SEQ ID NO: 656867 - DNA, 25 bp, Homo sapien
aatggtgaagtccatgtctcaagga

SEQ ID NO: 656868 - DNA, 25 bp, Homo sapien
ggtgaagtccatgtctcaaggatgt

SEQ ID NO: 656869 - DNA, 25 bp, Homo sapien
gaagtccatgtctcaaggatgtcca

SEQ ID NO: 656870 - DNA, 25 bp, Homo sapien
agtccatgtctcaaggatgtccaga

SEQ ID NO: 656871 - DNA, 25 bp, Homo sapien
atgtccagactaaacatccaaaaga

SEQ ID NO: 656872 - DNA, 25 bp, Homo sapien
gtccagactaaacatccaaaagaga

SEQ ID NO: 656873 - DNA, 25 bp, Homo sapien
taagaactatttgatgtagattttc

SEQ ID NO: 656874 - DNA, 25 bp, Homo sapien
tcacgtgtcaccttctagttcctta

SEQ ID NO: 656875 - DNA, 25 bp, Homo sapien
acgtgtcaccttctagttccttatc

SEQ ID NO: 656876 - DNA, 25 bp, Homo sapien
gtgtcaccttctagttccttatctg

SEQ ID NO: 656877 - DNA, 25 bp, Homo sapien
tgtcaccttctagttccttatctga

SEQ ID NO: 656878 - DNA, 25 bp, Homo sapien
gtcaccttctagttccttatctgaa

SEQ ID NO: 656879 - DNA, 25 bp, Homo sapien
tcaccttctagttccttatctgaaa

SEQ ID NO: 656880 - DNA, 25 bp, Homo sapien
caccttctagttccttatctgaaat

SEQ ID NO: 656881 - DNA, 25 bp, Homo sapien
ccttctagttccttatctgaaattg

SEQ ID NO: 656882 - DNA, 25 bp, Homo sapien
ttctagttccttatctgaaattgaa

SEQ ID NO: 656883 - DNA, 25 bp, Homo sapien
gctgaggagggcatatcattgaggt

SEQ ID NO: 656884 - DNA, 25 bp, Homo sapien
ggcatatcattgaggtcaggtgttt

SEQ ID NO: 656885 - DNA, 25 bp, Homo sapien
taaatccatgacactgtactctccg

SEQ ID NO: 656886 - DNA, 25 bp, Homo sapien
attccgactgccctaatatcctttc

SEQ ID NO: 656887 - DNA, 25 bp, Homo sapien
tctctcttctagtattgctctcaga

SEQ ID NO: 656888 - DNA, 25 bp, Homo sapien
gtattgctctcagatcatgctggat

SEQ ID NO: 656889 - DNA, 25 bp, Homo sapien
gatcatgctggatatgcttaatata

SEQ ID NO: 656890 - DNA, 25 bp, Homo sapien
gaatttatcatcttctagagattcc

SEQ ID NO: 656891 - DNA, 25 bp, Homo sapien
gagattccaatatcgactttatgtc

SEQ ID NO: 656892 - DNA, 25 bp, Homo sapien
tatgtcaataacctcccaaatgcct

SEQ ID NO: 656893 - DNA, 25 bp, Homo sapien
ataacctcccaaatgcctgtatttt

SEQ ID NO: 656894 - DNA, 25 bp, Homo sapien
tattttgttctgaagtttcctcggg

SEQ ID NO: 656895 - DNA, 25 bp, Homo sapien
tctctattggccataccacttggat

SEQ ID NO: 656896 - DNA, 25 bp, Homo sapien
ggggcccaggcacagctatttttta

SEQ ID NO: 656897 - DNA, 25 bp, Homo sapien
gggcccaggcacagctattttttaa

SEQ ID NO: 656898 - DNA, 25 bp, Homo sapien
ggcccaggcacagctattttttaaa

SEQ ID NO: 656899 - DNA, 25 bp, Homo sapien
gcccaggcacagctattttttaaaa

SEQ ID NO: 656900 - DNA, 25 bp, Homo sapien
cccaggcacagctattttttaaaag

SEQ ID NO: 656901 - DNA, 25 bp, Homo sapien
caggcacagctattttttaaaagcc

SEQ ID NO: 656902 - DNA, 25 bp, Homo sapien
tttaaaagccacaggaggccaggtg

SEQ ID NO: 656903 - DNA, 25 bp, Homo sapien
ttaaaagccacaggaggccaggtgt

SEQ ID NO: 656904 - DNA, 25 bp, Homo sapien
aaagccacaggaggccaggtgtgat

SEQ ID NO: 656905 - DNA, 25 bp, Homo sapien
aagccacaggaggccaggtgtgatg

SEQ ID NO: 656906 - DNA, 25 bp, Homo sapien
ttttaaaaattagcacatgcctgta

SEQ ID NO: 656907 - DNA, 25 bp, Homo sapien
ctacaggatttgatcttagcttgaa

SEQ ID NO: 656908 - DNA, 25 bp, Homo sapien
tagcttgaagactattgatgctgat

SEQ ID NO: 656909 - DNA, 25 bp, Homo sapien
tgatgctgatggttcccagggcagt

SEQ ID NO: 656910 - DNA, 25 bp, Homo sapien
ttcccagggcagttgtttgaaggct

SEQ ID NO: 656911 - DNA, 25 bp, Homo sapien
ggtcatcatgacaaactacactact

SEQ ID NO: 656912 - DNA, 25 bp, Homo sapien
actactgaactaattgaaactggac

SEQ ID NO: 656913 - DNA, 25 bp, Homo sapien
gaaactggactcaggagacctcatc

SEQ ID NO: 656914 - DNA, 25 bp, Homo sapien
caggagacctcatctaatgtgtaga

SEQ ID NO: 656915 - DNA, 25 bp, Homo sapien
gtagaattctcattgattacaactt

SEQ ID NO: 656916 - DNA, 25 bp, Homo sapien
tttcctgtttaaacctaggcctgtg

SEQ ID NO: 656917 - DNA, 25 bp, Homo sapien
tgtttaaacctaggcctgtgatact

SEQ ID NO: 656918 - DNA, 25 bp, Homo sapien
agtgaacaaagcacagatctctgtc

SEQ ID NO: 656919 - DNA, 25 bp, Homo sapien
atctctgtccttttggtgcttacat

SEQ ID NO: 656920 - DNA, 25 bp, Homo sapien
aaactttcctgactgggagtcctgg

SEQ ID NO: 656921 - DNA, 25 bp, Homo sapien
gagtcctggcaaaggcatcctgagc

SEQ ID NO: 656922 - DNA, 25 bp, Homo sapien
atggaactttctactgcaggacgtg

SEQ ID NO: 656923 - DNA, 25 bp, Homo sapien
tttctactgcaggacgtgacaggtg

SEQ ID NO: 656924 - DNA, 25 bp, Homo sapien
acaggtgctagactgtcagtaaaga

SEQ ID NO: 656925 - DNA, 25 bp, Homo sapien
gagacttgctttagtaattgtcaac

SEQ ID NO: 656926 - DNA, 25 bp, Homo sapien
gtcaactcttcacttattcaacaaa

SEQ ID NO: 656927 - DNA, 25 bp, Homo sapien
gggtgtttcatgtgcgaagtaccat

SEQ ID NO: 656928 - DNA, 25 bp, Homo sapien
gtgcgaagtaccattctgtgtgttc

SEQ ID NO: 656929 - DNA, 25 bp, Homo sapien
ctgccttggcttttcaaagcgctga

SEQ ID NO: 656930 - DNA, 25 bp, Homo sapien
cttggcttttcaaagcgctgagatt

SEQ ID NO: 656931 - DNA, 25 bp, Homo sapien
gaattataattctaggtgtcatgtt

SEQ ID NO: 656932 - DNA, 25 bp, Homo sapien
aattctaggtgtcatgttaccgtca

SEQ ID NO: 656933 - DNA, 25 bp, Homo sapien
ctaggtgtcatgttaccgtcaggct

SEQ ID NO: 656934 - DNA, 25 bp, Homo sapien
aggtgtcatgttaccgtcaggcttt

SEQ ID NO: 656935 - DNA, 25 bp, Homo sapien
tgtcatgttaccgtcaggcttttcc

SEQ ID NO: 656936 - DNA, 25 bp, Homo sapien
catgttaccgtcaggcttttcccta

SEQ ID NO: 656937 - DNA, 25 bp, Homo sapien
accgtcaggcttttccctaatacag

SEQ ID NO: 656938 - DNA, 25 bp, Homo sapien
ctaataaatggtaggcttttggcta

SEQ ID NO: 656939 - DNA, 25 bp, Homo sapien
atttttgtgcgtgaatgtatataca

SEQ ID NO: 656940 - DNA, 25 bp, Homo sapien
agcagctcggctcctgactgatgga

SEQ ID NO: 656941 - DNA, 25 bp, Homo sapien
ctcggctcctgactgatggattcag

SEQ ID NO: 656942 - DNA, 25 bp, Homo sapien
gtgatgggtgtgaagcagtttcccc

SEQ ID NO: 656943 - DNA, 25 bp, Homo sapien
agcagtttcccctgtcagatacccg

SEQ ID NO: 656944 - DNA, 25 bp, Homo sapien
agatacccgctgtgcatttttggga

SEQ ID NO: 656945 - DNA, 25 bp, Homo sapien
cgctgtgcatttttgggaggaccgt

SEQ ID NO: 656946 - DNA, 25 bp, Homo sapien
gtgcatttttgggaggaccgtaaca

SEQ ID NO: 656947 - DNA, 25 bp, Homo sapien
gaggaccgtaacagtggaactccag

SEQ ID NO: 656948 - DNA, 25 bp, Homo sapien
accgtaacagtggaactccagagct

SEQ ID NO: 656949 - DNA, 25 bp, Homo sapien
gtgagaggacactggccagttagaa

SEQ ID NO: 656950 - DNA, 25 bp, Homo sapien
gaggacactggccagttagaaaatg

SEQ ID NO: 656951 - DNA, 25 bp, Homo sapien
atttccatctgagactggtgaaaat

SEQ ID NO: 656952 - DNA, 25 bp, Homo sapien
catctgagactggtgaaaatatatt

SEQ ID NO: 656953 - DNA, 25 bp, Homo sapien
cttgggaatcactacttagaagata

SEQ ID NO: 656954 - DNA, 25 bp, Homo sapien
aatatgatcttcatttctaatcact

SEQ ID NO: 656955 - DNA, 25 bp, Homo sapien
gatcttcatttctaatcacttataa

SEQ ID NO: 656956 - DNA, 25 bp, Homo sapien
catttctaatcacttataactgttg

SEQ ID NO: 656957 - DNA, 25 bp, Homo sapien
tttctatctagagcttatgtttaaa

SEQ ID NO: 656958 - DNA, 25 bp, Homo sapien
ctagagcttatgtttaaatctgttt

SEQ ID NO: 656959 - DNA, 25 bp, Homo sapien
agtttcctccacattgaagaaaact

SEQ ID NO: 656960 - DNA, 25 bp, Homo sapien
cctaggacagccttttgggagagga

SEQ ID NO: 656961 - DNA, 25 bp, Homo sapien
acagccttttgggagaggagccaag

SEQ ID NO: 656962 - DNA, 25 bp, Homo sapien
gataatataaaaactgtggccaggc

SEQ ID NO: 656963 - DNA, 25 bp, Homo sapien
gccaggcacggtaattgtgggatca

SEQ ID NO: 656964 - DNA, 25 bp, Homo sapien
ccaggcacggtaattgtgggatcac

SEQ ID NO: 656965 - DNA, 25 bp, Homo sapien
caggcacggtaattgtgggatcacg

SEQ ID NO: 656966 - DNA, 25 bp, Homo sapien
aggcacggtaattgtgggatcacgc

SEQ ID NO: 656967 - DNA, 25 bp, Homo sapien
ggcacggtaattgtgggatcacgcc

SEQ ID NO: 656968 - DNA, 25 bp, Homo sapien
gcacggtaattgtgggatcacgcct

SEQ ID NO: 656969 - DNA, 25 bp, Homo sapien
cacggtaattgtgggatcacgcctg

SEQ ID NO: 656970 - DNA, 25 bp, Homo sapien
cggtaattgtgggatcacgcctgta

SEQ ID NO: 656971 - DNA, 25 bp, Homo sapien
ggtaattgtgggatcacgcctgtaa

SEQ ID NO: 656972 - DNA, 25 bp, Homo sapien
agaaggctgaggtaagataatcgct

SEQ ID NO: 656973 - DNA, 25 bp, Homo sapien
ggatagaactgatggctcatgggca

SEQ ID NO: 656974 - DNA, 25 bp, Homo sapien
gctcatgggcagaagctgtgcatca

SEQ ID NO: 656975 - DNA, 25 bp, Homo sapien
tggcattgttcagccatgaagccat

SEQ ID NO: 656976 - DNA, 25 bp, Homo sapien
gaagccatataatttcaacctgact

SEQ ID NO: 656977 - DNA, 25 bp, Homo sapien
tgactttccttctctattgtcctgt

SEQ ID NO: 656978 - DNA, 25 bp, Homo sapien
tattgtcctgtctcattgtctagct

SEQ ID NO: 656979 - DNA, 25 bp, Homo sapien
attgtctagcttgaaatgtggccgc

SEQ ID NO: 656980 - DNA, 25 bp, Homo sapien
aatgtggccgcagtcatgtcaagtg

SEQ ID NO: 656981 - DNA, 25 bp, Homo sapien
atgtcaagtggctaacttcctgcat

SEQ ID NO: 656982 - DNA, 25 bp, Homo sapien
acttcctgcatatttggtttcctca

SEQ ID NO: 656983 - DNA, 25 bp, Homo sapien
gtttcctcatgggagcttagtaatt

SEQ ID NO: 656984 - DNA, 25 bp, Homo sapien
acttcttacccgaaagcatcactgc

SEQ ID NO: 656985 - DNA, 25 bp, Homo sapien
ttacccgaaagcatcactgccttgg

SEQ ID NO: 656986 - DNA, 25 bp, Homo sapien
gaaagcatcactgccttggcccctc

SEQ ID NO: 656987 - DNA, 25 bp, Homo sapien
actgtctcctccctgggctaagcag

SEQ ID NO: 656988 - DNA, 25 bp, Homo sapien
gtagcctggatgtgggccaagtcca

SEQ ID NO: 656989 - DNA, 25 bp, Homo sapien
ggatgtgggccaagtccactgtcct

SEQ ID NO: 656990 - DNA, 25 bp, Homo sapien
tccactgtcctccttggcggcaaaa

SEQ ID NO: 656991 - DNA, 25 bp, Homo sapien
ccttggcggcaaaagcccattgaag

SEQ ID NO: 656992 - DNA, 25 bp, Homo sapien
gcggcaaaagcccattgaagaagaa

SEQ ID NO: 656993 - DNA, 25 bp, Homo sapien
tgaagaagaaccagcccagcctgcc

SEQ ID NO: 656994 - DNA, 25 bp, Homo sapien
cccctatcttgtcctggaatatttt

SEQ ID NO: 656995 - DNA, 25 bp, Homo sapien
cttttgaagttatttggctattgcc

SEQ ID NO: 656996 - DNA, 25 bp, Homo sapien
ggctattgccattggctacttttca

SEQ ID NO: 656997 - DNA, 25 bp, Homo sapien
gccattggctacttttcagcaagct

SEQ ID NO: 656998 - DNA, 25 bp, Homo sapien
ttttcagcaagctccaagcacattc

SEQ ID NO: 656999 - DNA, 25 bp, Homo sapien
gcaagctccaagcacattcaggaat

SEQ ID NO: 657000 - DNA, 25 bp, Homo sapien
cacattcaggaattctactgaaggg

SEQ ID NO: 657001 - DNA, 25 bp, Homo sapien
aaagctaatctacaaactttgaatc

SEQ ID NO: 657002 - DNA, 25 bp, Homo sapien
gattttgatgaacactaagcttaac

SEQ ID NO: 657003 - DNA, 25 bp, Homo sapien
aacagtaaagttgacatgacgtatt

SEQ ID NO: 657004 - DNA, 25 bp, Homo sapien
gttgacatgacgtattaaagatttg

SEQ ID NO: 657005 - DNA, 25 bp, Homo sapien
gagattatatgcataagccaccgtg

SEQ ID NO: 657006 - DNA, 25 bp, Homo sapien
gaaaactttgttattgacactggat

SEQ ID NO: 657007 - DNA, 25 bp, Homo sapien
ctttgttattgacactggattctcc

SEQ ID NO: 657008 - DNA, 25 bp, Homo sapien
actggattctcctagattttgcttt

SEQ ID NO: 657009 - DNA, 25 bp, Homo sapien
ggattctcctagattttgctttatt

SEQ ID NO: 657010 - DNA, 25 bp, Homo sapien
attctcctagattttgctttatttt

SEQ ID NO: 657011 - DNA, 25 bp, Homo sapien
cagaggccagaaaagactacttatt

SEQ ID NO: 657012 - DNA, 25 bp, Homo sapien
gaaaagactacttattctcagatgt

SEQ ID NO: 657013 - DNA, 25 bp, Homo sapien
aagactacttattctcagatgtgta

SEQ ID NO: 657014 - DNA, 25 bp, Homo sapien
gactacttattctcagatgtgtaaa

SEQ ID NO: 657015 - DNA, 25 bp, Homo sapien
gtgtaaatatagataagtccttctg

SEQ ID NO: 657016 - DNA, 25 bp, Homo sapien
aagtttttaaatgcatagcatggaa

SEQ ID NO: 657017 - DNA, 25 bp, Homo sapien
tttagaattaagaaacttaggccag

SEQ ID NO: 657018 - DNA, 25 bp, Homo sapien
ttagaattaagaaacttaggccagg

SEQ ID NO: 657019 - DNA, 25 bp, Homo sapien
tagaattaagaaacttaggccaggc

SEQ ID NO: 657020 - DNA, 25 bp, Homo sapien
agaattaagaaacttaggccaggca

SEQ ID NO: 657021 - DNA, 25 bp, Homo sapien
gaattaagaaacttaggccaggcac

SEQ ID NO: 657022 - DNA, 25 bp, Homo sapien
attaagaaacttaggccaggcacgg

SEQ ID NO: 657023 - DNA, 25 bp, Homo sapien
taaagatgcaaaaaattaggtaggc

SEQ ID NO: 657024 - DNA, 25 bp, Homo sapien
taggtaggcacggtggcacgcgcct

SEQ ID NO: 657025 - DNA, 25 bp, Homo sapien
aggtaggcacggtggcacgcgcctg

SEQ ID NO: 657026 - DNA, 25 bp, Homo sapien
gcagggagccaagattgcagcacca

SEQ ID NO: 657027 - DNA, 25 bp, Homo sapien
cagggagccaagattgcagcaccac

SEQ ID NO: 657028 - DNA, 25 bp, Homo sapien
gcaataagtaattcacacgaactgt

SEQ ID NO: 657029 - DNA, 25 bp, Homo sapien
tcacacgaactgtgaagtctggagg

SEQ ID NO: 657030 - DNA, 25 bp, Homo sapien
gtgaggcatgaaacagataggaatc

SEQ ID NO: 657031 - DNA, 25 bp, Homo sapien
aggaatcaccagaggatgaaccact

SEQ ID NO: 657032 - DNA, 25 bp, Homo sapien
gaggatgaaccactgcaaaaactaa

SEQ ID NO: 657033 - DNA, 25 bp, Homo sapien
aatatgttagaatcagtctggtcag

SEQ ID NO: 657034 - DNA, 25 bp, Homo sapien
tctggtcaggatggcactgctggca

SEQ ID NO: 657035 - DNA, 25 bp, Homo sapien
aggatggcactgctggcaccactgc

SEQ ID NO: 657036 - DNA, 25 bp, Homo sapien
tggcaccactgctatgggctttact

SEQ ID NO: 657037 - DNA, 25 bp, Homo sapien
tgctatgggctttactcttgctctt

SEQ ID NO: 657038 - DNA, 25 bp, Homo sapien
taatcctcctcctaagttcatgaca

SEQ ID NO: 657039 - DNA, 25 bp, Homo sapien
agacaagatctaaacttcagacaag

SEQ ID NO: 657040 - DNA, 25 bp, Homo sapien
gacaagctgatgagaaagcctgctt

SEQ ID NO: 657041 - DNA, 25 bp, Homo sapien
gcttcttccttcatttggacaggaa

SEQ ID NO: 657042 - DNA, 25 bp, Homo sapien
ggtcaaaccatgtaggaaccgtcat

SEQ ID NO: 657043 - DNA, 25 bp, Homo sapien
aggaaccgtcatcccagctgcaatc

SEQ ID NO: 657044 - DNA, 25 bp, Homo sapien
agctgcaatccctgaccatagaaac

SEQ ID NO: 657045 - DNA, 25 bp, Homo sapien
tgaccatagaaaccccaagccagtt

SEQ ID NO: 657046 - DNA, 25 bp, Homo sapien
tttctttccttgtttctcgagtcat

SEQ ID NO: 657047 - DNA, 25 bp, Homo sapien
agtcatctttggacttgcttgagat

SEQ ID NO: 657048 - DNA, 25 bp, Homo sapien
tttggacttgcttgagatttgcctt

SEQ ID NO: 657049 - DNA, 25 bp, Homo sapien
tttgccttgttctcccagaaaagct

SEQ ID NO: 657050 - DNA, 25 bp, Homo sapien
atcatgcctggcctgtgcacatcat

SEQ ID NO: 657051 - DNA, 25 bp, Homo sapien
ctggcctgtgcacatcatttcaata

SEQ ID NO: 657052 - DNA, 25 bp, Homo sapien
ggcctgtgcacatcatttcaataac

SEQ ID NO: 657053 - DNA, 25 bp, Homo sapien
gtgcacatcatttcaataactgata

SEQ ID NO: 657054 - DNA, 25 bp, Homo sapien
tgtattatttacaagtatgtctttc

SEQ ID NO: 657055 - DNA, 25 bp, Homo sapien
ttacaagtatgtctttcaataagtt

SEQ ID NO: 657056 - DNA, 25 bp, Homo sapien
tacagttatgtaaccaccatttctg

SEQ ID NO: 657057 - DNA, 25 bp, Homo sapien
cagttatgtaaccaccatttctggc

SEQ ID NO: 657058 - DNA, 25 bp, Homo sapien
ttctggcaaaccagaaagctgccat

SEQ ID NO: 657059 - DNA, 25 bp, Homo sapien
tgccatctgtccctttatagtcatg

SEQ ID NO: 657060 - DNA, 25 bp, Homo sapien
ccatctgtccctttatagtcatgta

SEQ ID NO: 657061 - DNA, 25 bp, Homo sapien
ttaaccattaatttgtggtacaggc

SEQ ID NO: 657062 - DNA, 25 bp, Homo sapien
taaccattaatttgtggtacaggct

SEQ ID NO: 657063 - DNA, 25 bp, Homo sapien
aaccattaatttgtggtacaggctg

SEQ ID NO: 657064 - DNA, 25 bp, Homo sapien
accattaatttgtggtacaggctgg

SEQ ID NO: 657065 - DNA, 25 bp, Homo sapien
ccattaatttgtggtacaggctggg

SEQ ID NO: 657066 - DNA, 25 bp, Homo sapien
cattaatttgtggtacaggctgggc

SEQ ID NO: 657067 - DNA, 25 bp, Homo sapien
attaatttgtggtacaggctgggcg

SEQ ID NO: 657068 - DNA, 25 bp, Homo sapien
ttaatttgtggtacaggctgggcgc

SEQ ID NO: 657069 - DNA, 25 bp, Homo sapien
taatttgtggtacaggctgggcgca

SEQ ID NO: 657070 - DNA, 25 bp, Homo sapien
aatttgtggtacaggctgggcgcag

SEQ ID NO: 657071 - DNA, 25 bp, Homo sapien
atttgtggtacaggctgggcgcagt

SEQ ID NO: 657072 - DNA, 25 bp, Homo sapien
tattaaatgggaaactcggccaggc

SEQ ID NO: 657073 - DNA, 25 bp, Homo sapien
attaaatgggaaactcggccaggca

SEQ ID NO: 657074 - DNA, 25 bp, Homo sapien
ggcaacataccgagaaccttgtttc

SEQ ID NO: 657075 - DNA, 25 bp, Homo sapien
gcaacataccgagaaccttgtttct

SEQ ID NO: 657076 - DNA, 25 bp, Homo sapien
acataccgagaaccttgtttctaca

SEQ ID NO: 657077 - DNA, 25 bp, Homo sapien
cataccgagaaccttgtttctacaa

SEQ ID NO: 657078 - DNA, 25 bp, Homo sapien
gtggtgggacgcacctgctgtccca

SEQ ID NO: 657079 - DNA, 25 bp, Homo sapien
tgggacgcacctgctgtcccagtaa

SEQ ID NO: 657080 - DNA, 25 bp, Homo sapien
ggacgcacctgctgtcccagtaact

SEQ ID NO: 657081 - DNA, 25 bp, Homo sapien
ctcaggagactgagctgtgaggatg

SEQ ID NO: 657082 - DNA, 25 bp, Homo sapien
gagctgtgaggatggattgagacta

SEQ ID NO: 657083 - DNA, 25 bp, Homo sapien
ggttacttttggtgaatgtgaggaa

SEQ ID NO: 657084 - DNA, 25 bp, Homo sapien
ggaatcaactgacacaaatagacaa

SEQ ID NO: 657085 - DNA, 25 bp, Homo sapien
aaaacctaaatctgcactttgaatg

SEQ ID NO: 657086 - DNA, 25 bp, Homo sapien
atctgcactttgaatgttttggaca

SEQ ID NO: 657087 - DNA, 25 bp, Homo sapien
agttgatcagtgcaagagaaacgat

SEQ ID NO: 657088 - DNA, 25 bp, Homo sapien
cgatgtaatgtctgtgatgtctcac

SEQ ID NO: 657089 - DNA, 25 bp, Homo sapien
atgtctgtgatgtctcaccttcaga

SEQ ID NO: 657090 - DNA, 25 bp, Homo sapien
gatgtctcaccttcagattgtggct

SEQ ID NO: 657091 - DNA, 25 bp, Homo sapien
cagattgtggcttcagtaccgtgat

SEQ ID NO: 657092 - DNA, 25 bp, Homo sapien
ggcttcagtaccgtgattatgcaat

SEQ ID NO: 657093 - DNA, 25 bp, Homo sapien
gtaccgtgattatgcaatattagtt

SEQ ID NO: 657094 - DNA, 25 bp, Homo sapien
aacagaggatgttaaacgtctgaat

SEQ ID NO: 657095 - DNA, 25 bp, Homo sapien
ggatgttaaacgtctgaatgaaaaa

SEQ ID NO: 657096 - DNA, 25 bp, Homo sapien
gtatcgagaaaaacgcttggagcaa

SEQ ID NO: 657097 - DNA, 25 bp, Homo sapien
agaaaaggaattgctacatagtcag

SEQ ID NO: 657098 - DNA, 25 bp, Homo sapien
ggaattgctacatagtcagaataca

SEQ ID NO: 657099 - DNA, 25 bp, Homo sapien
tgctacatagtcagaatacatggct

SEQ ID NO: 657100 - DNA, 25 bp, Homo sapien
cagaatacatggctgaatacagagt

SEQ ID NO: 657101 - DNA, 25 bp, Homo sapien
atacatggctgaatacagagttgaa

SEQ ID NO: 657102 - DNA, 25 bp, Homo sapien
gaaaaccaaaactgatgaacttctg

SEQ ID NO: 657103 - DNA, 25 bp, Homo sapien
aaccaaaactgatgaacttctggct

SEQ ID NO: 657104 - DNA, 25 bp, Homo sapien
aacttctggctcttggaagagaaaa

SEQ ID NO: 657105 - DNA, 25 bp, Homo sapien
gaagctattgctacaggaaatcttt

SEQ ID NO: 657106 - DNA, 25 bp, Homo sapien
tcttaagactttaatacctggtaat

SEQ ID NO: 657107 - DNA, 25 bp, Homo sapien
atacctggtaatcaaactactgtag

SEQ ID NO: 657108 - DNA, 25 bp, Homo sapien
caaactactgtagaattacttctct

SEQ ID NO: 657109 - DNA, 25 bp, Homo sapien
gaattacttctctataaggacctta

SEQ ID NO: 657110 - DNA, 25 bp, Homo sapien
tataaggaccttatcagtaggattt

SEQ ID NO: 657111 - DNA, 25 bp, Homo sapien
gtaggatttagtaggcaattcaaga

SEQ ID NO: 657112 - DNA, 25 bp, Homo sapien
gcaattcaagaagataacaagccat

SEQ ID NO: 657113 - DNA, 25 bp, Homo sapien
ttggaatttttctggctatgagata

SEQ ID NO: 657114 - DNA, 25 bp, Homo sapien
ggctatgagataatcaatgatgttc

SEQ ID NO: 657115 - DNA, 25 bp, Homo sapien
aatgatgttctataaaattctggga

SEQ ID NO: 657116 - DNA, 25 bp, Homo sapien
tctagtttggtaaaatgtcttatca

SEQ ID NO: 657117 - DNA, 25 bp, Homo sapien
atgtcttatcatgaatggattttga

SEQ ID NO: 657118 - DNA, 25 bp, Homo sapien
catttgctttggctgtaccagttga

SEQ ID NO: 657119 - DNA, 25 bp, Homo sapien
gctttggctgtaccagttgagtcat

SEQ ID NO: 657120 - DNA, 25 bp, Homo sapien
ggctgtaccagttgagtcatttaaa

SEQ ID NO: 657121 - DNA, 25 bp, Homo sapien
tttgtgaatgttggcccaaccatac

SEQ ID NO: 657122 - DNA, 25 bp, Homo sapien
tgttggcccaaccatacattactgg

SEQ ID NO: 657123 - DNA, 25 bp, Homo sapien
tgtgttcatgaggactgttcgtcta

SEQ ID NO: 657124 - DNA, 25 bp, Homo sapien
ggactgttcgtctataattctcttt

SEQ ID NO: 657125 - DNA, 25 bp, Homo sapien
gttcgtctataattctctttttctg

SEQ ID NO: 657126 - DNA, 25 bp, Homo sapien
atctttgattttactatcagtgtaa

SEQ ID NO: 657127 - DNA, 25 bp, Homo sapien
aaatatataagaaaccggctgggca

SEQ ID NO: 657128 - DNA, 25 bp, Homo sapien
atatataagaaaccggctgggcacg

SEQ ID NO: 657129 - DNA, 25 bp, Homo sapien
gtaatcttagcactgtggaagactg

SEQ ID NO: 657130 - DNA, 25 bp, Homo sapien
tcttagcactgtggaagactgaggg

SEQ ID NO: 657131 - DNA, 25 bp, Homo sapien
agcctaggcaatggagcgaaaccct

SEQ ID NO: 657132 - DNA, 25 bp, Homo sapien
gcctaggcaatggagcgaaaccctg

SEQ ID NO: 657133 - DNA, 25 bp, Homo sapien
tgaggtgggagaaggtacccaagcc

SEQ ID NO: 657134 - DNA, 25 bp, Homo sapien
gaaggtacccaagcctgggaagtca

SEQ ID NO: 657135 - DNA, 25 bp, Homo sapien
gtcaaggctgtagtcagctgtgttc

SEQ ID NO: 657136 - DNA, 25 bp, Homo sapien
aaggctgtagtcagctgtgttcatg

SEQ ID NO: 657137 - DNA, 25 bp, Homo sapien
gctgtgttcatgccattgagctcca

SEQ ID NO: 657138 - DNA, 25 bp, Homo sapien
aacacttcactattacccttgtagc

SEQ ID NO: 657139 - DNA, 25 bp, Homo sapien
tagctcttctctgtacattttcctt

SEQ ID NO: 657140 - DNA, 25 bp, Homo sapien
ttttcccactattttaccatctgca

SEQ ID NO: 657141 - DNA, 25 bp, Homo sapien
aggattctagaacgtgccatgcatt

SEQ ID NO: 657142 - DNA, 25 bp, Homo sapien
cgtgccatgcattttattatctcta

SEQ ID NO: 657143 - DNA, 25 bp, Homo sapien
ttatctctaagtttttgcccatgcc

SEQ ID NO: 657144 - DNA, 25 bp, Homo sapien
catgccatggcttcttccttgaatg

SEQ ID NO: 657145 - DNA, 25 bp, Homo sapien
ttcctcatcgggttaatcaaatctt

SEQ ID NO: 657146 - DNA, 25 bp, Homo sapien
tcaaatcttgcccattcacgaaagc

SEQ ID NO: 657147 - DNA, 25 bp, Homo sapien
ttcacgaaagcccatctttatgctc

SEQ ID NO: 657148 - DNA, 25 bp, Homo sapien
atctttatgctctctcttttgtgaa

SEQ ID NO: 657149 - DNA, 25 bp, Homo sapien
gcaatgtggtgaattcataaaggaa

SEQ ID NO: 657150 - DNA, 25 bp, Homo sapien
aaatcttgcaataaaaggccggagt

SEQ ID NO: 657151 - DNA, 25 bp, Homo sapien
aaggccggagttcaagttatagttg

SEQ ID NO: 657152 - DNA, 25 bp, Homo sapien
aagttatagttgacatttacagaac

SEQ ID NO: 657153 - DNA, 25 bp, Homo sapien
tattctttatgagtgattgtctctc

SEQ ID NO: 657154 - DNA, 25 bp, Homo sapien
atgagtgattgtctctctgagttgt

SEQ ID NO: 657155 - DNA, 25 bp, Homo sapien
tgattgtctctctgagttgtggtga

SEQ ID NO: 657156 - DNA, 25 bp, Homo sapien
aaaaatattaacagctactactatg

SEQ ID NO: 657157 - DNA, 25 bp, Homo sapien
gctactactatgttgattcggcact

SEQ ID NO: 657158 - DNA, 25 bp, Homo sapien
actatgttgattcggcactttgtgg

SEQ ID NO: 657159 - DNA, 25 bp, Homo sapien
tgattcggcactttgtggttactta

SEQ ID NO: 657160 - DNA, 25 bp, Homo sapien
agcagaggtgtggacgccacatact

SEQ ID NO: 657161 - DNA, 25 bp, Homo sapien
gtgtggacgccacatactggacggg

SEQ ID NO: 657162 - DNA, 25 bp, Homo sapien
ttcaccatctgctgggacgggacac

SEQ ID NO: 657163 - DNA, 25 bp, Homo sapien
ggacgggacaccctctcttcttgat

SEQ ID NO: 657164 - DNA, 25 bp, Homo sapien
ttcttgatctcactcccagaaaaga

SEQ ID NO: 657165 - DNA, 25 bp, Homo sapien
gatctcactcccagaaaagacactg

SEQ ID NO: 657166 - DNA, 25 bp, Homo sapien
gagcagaggtgtggacgcctcatac

SEQ ID NO: 657167 - DNA, 25 bp, Homo sapien
aggtgtggacgcctcatactgctag

SEQ ID NO: 657168 - DNA, 25 bp, Homo sapien
tgtggacgcctcatactgctagaga

SEQ ID NO: 657169 - DNA, 25 bp, Homo sapien
gacgcctcatactgctagagacggg

SEQ ID NO: 657170 - DNA, 25 bp, Homo sapien
ctgcacccggctgaaattgtatact

SEQ ID NO: 657171 - DNA, 25 bp, Homo sapien
gaagagagtggcttaaccccagcga

SEQ ID NO: 657172 - DNA, 25 bp, Homo sapien
ggcttaaccccagcgagcgggagaa

SEQ ID NO: 657173 - DNA, 25 bp, Homo sapien
taaccccagcgagcgggagaagagc

SEQ ID NO: 657174 - DNA, 25 bp, Homo sapien
gcgcgagctaagtgtttgtgagccc

SEQ ID NO: 657175 - DNA, 25 bp, Homo sapien
ctaagtgtttgtgagcccggtgaag

SEQ ID NO: 657176 - DNA, 25 bp, Homo sapien
tcttcttattgtttgtcattgtcgg

SEQ ID NO: 657177 - DNA, 25 bp, Homo sapien
gtttgtcattgtcggttaacaccac

SEQ ID NO: 657178 - DNA, 25 bp, Homo sapien
gtcggttaacaccactttacttgag

SEQ ID NO: 657179 - DNA, 25 bp, Homo sapien
gttaacaccactttacttgagcaga

SEQ ID NO: 657180 - DNA, 25 bp, Homo sapien
accactttacttgagcagacttgag

SEQ ID NO: 657181 - DNA, 25 bp, Homo sapien
cagacttgagtttctcatgcattcc

SEQ ID NO: 657182 - DNA, 25 bp, Homo sapien
gttcatttaacttgtactggctttc

SEQ ID NO: 657183 - DNA, 25 bp, Homo sapien
acttgtactggctttcagaaggaga

SEQ ID NO: 657184 - DNA, 25 bp, Homo sapien
gaaatcaggtccatcactcaatgaa

SEQ ID NO: 657185 - DNA, 25 bp, Homo sapien
gtccatcactcaatgaactcattcc

SEQ ID NO: 657186 - DNA, 25 bp, Homo sapien
agaacagttagaagctatattgtca

SEQ ID NO: 657187 - DNA, 25 bp, Homo sapien
agcaattcagactagttccctggga

SEQ ID NO: 657188 - DNA, 25 bp, Homo sapien
attcagactagttccctgggacttt

SEQ ID NO: 657189 - DNA, 25 bp, Homo sapien
ccctgggacttttgactggttatat

SEQ ID NO: 657190 - DNA, 25 bp, Homo sapien
ttgactggttatatccgaagatgga

SEQ ID NO: 657191 - DNA, 25 bp, Homo sapien
ttctgccactaatttgcgctttgtt

SEQ ID NO: 657192 - DNA, 25 bp, Homo sapien
ctgccactaatttgcgctttgttct

SEQ ID NO: 657193 - DNA, 25 bp, Homo sapien
catattttgccttattttgccactc

SEQ ID NO: 657194 - DNA, 25 bp, Homo sapien
cactcccctcaaaatatccatagta

SEQ ID NO: 657195 - DNA, 25 bp, Homo sapien
atatccatagtattgaatgcccagg

SEQ ID NO: 657196 - DNA, 25 bp, Homo sapien
gaatgcccaggtttcatgtttggaa

SEQ ID NO: 657197 - DNA, 25 bp, Homo sapien
gaaaagcccgaggatctgtgcacac

SEQ ID NO: 657198 - DNA, 25 bp, Homo sapien
aggatctgtgcacactctgggctac

SEQ ID NO: 657199 - DNA, 25 bp, Homo sapien
agctcctgactgaggcactggacct

SEQ ID NO: 657200 - DNA, 25 bp, Homo sapien
accggcaacactgtacccagttaat

SEQ ID NO: 657201 - DNA, 25 bp, Homo sapien
acccagttaatcattagggcccttg

SEQ ID NO: 657202 - DNA, 25 bp, Homo sapien
agggcccttgtctctgtacaattgc

SEQ ID NO: 657203 - DNA, 25 bp, Homo sapien
acaattgctctgtacaactcgataa

SEQ ID NO: 657204 - DNA, 25 bp, Homo sapien
gcagattacaaaacagtgtatagta

SEQ ID NO: 657205 - DNA, 25 bp, Homo sapien
acatatctatgttatgtgcacacga

SEQ ID NO: 657206 - DNA, 25 bp, Homo sapien
atatctatgttatgtgcacacgaag

SEQ ID NO: 657207 - DNA, 25 bp, Homo sapien
atctatgttatgtgcacacgaagca

SEQ ID NO: 657208 - DNA, 25 bp, Homo sapien
tatgttatgtgcacacgaagcaagt

SEQ ID NO: 657209 - DNA, 25 bp, Homo sapien
tgttatgtgcacacgaagcaagtaa

SEQ ID NO: 657210 - DNA, 25 bp, Homo sapien
tatgtgcacacgaagcaagtaagga

SEQ ID NO: 657211 - DNA, 25 bp, Homo sapien
gcacacgaagcaagtaaggaagatt

SEQ ID NO: 657212 - DNA, 25 bp, Homo sapien
gtcactcaagggtagaattatgcgt

SEQ ID NO: 657213 - DNA, 25 bp, Homo sapien
caagggtagaattatgcgtgatttt

SEQ ID NO: 657214 - DNA, 25 bp, Homo sapien
agaattatgcgtgatttttattttc

SEQ ID NO: 657215 - DNA, 25 bp, Homo sapien
ggttggtgctccgtgcggtccttcc

SEQ ID NO: 657216 - DNA, 25 bp, Homo sapien
caggctttagcggagagacagcatg

SEQ ID NO: 657217 - DNA, 25 bp, Homo sapien
agcggagagacagcatgataggcct

SEQ ID NO: 657218 - DNA, 25 bp, Homo sapien
gcatgataggcctggagttcttcaa

SEQ ID NO: 657219 - DNA, 25 bp, Homo sapien
tgataggcctggagttcttcaagag

SEQ ID NO: 657220 - DNA, 25 bp, Homo sapien
tggagttcttcaagaggcctcctcg

SEQ ID NO: 657221 - DNA, 25 bp, Homo sapien
gagttcttcaagaggcctcctcgca

SEQ ID NO: 657222 - DNA, 25 bp, Homo sapien
cttaccacccggagagcctcagttt

SEQ ID NO: 657223 - DNA, 25 bp, Homo sapien
tttggatttgaagccatcgcacccc

SEQ ID NO: 657224 - DNA, 25 bp, Homo sapien
gaagccatcgcaccccaaaggagat

SEQ ID NO: 657225 - DNA, 25 bp, Homo sapien
atcgcaccccaaaggagatgacaat

SEQ ID NO: 657226 - DNA, 25 bp, Homo sapien
ctggctgcctcctgtgagcaagagc

SEQ ID NO: 657227 - DNA, 25 bp, Homo sapien
cagggccttggagctgcacacagag

SEQ ID NO: 657228 - DNA, 25 bp, Homo sapien
agatattaagctcgtctgcagggaa

SEQ ID NO: 657229 - DNA, 25 bp, Homo sapien
catgcggcccgtgaggaagatcttt

SEQ ID NO: 657230 - DNA, 25 bp, Homo sapien
ggaagatctttgatgcacttgaaaa

SEQ ID NO: 657231 - DNA, 25 bp, Homo sapien
gaaaatcaccagtcagaaagcagcg

SEQ ID NO: 657232 - DNA, 25 bp, Homo sapien
agaaagcagcgacttacccaggatc

SEQ ID NO: 657233 - DNA, 25 bp, Homo sapien
gacttacccaggatccagttggata

SEQ ID NO: 657234 - DNA, 25 bp, Homo sapien
tggatgtgctaactcacaccaagcc

SEQ ID NO: 657235 - DNA, 25 bp, Homo sapien
ccctccgcaaagaatctggctcaga

SEQ ID NO: 657236 - DNA, 25 bp, Homo sapien
ggctcagagatactcagactggcaa

SEQ ID NO: 657237 - DNA, 25 bp, Homo sapien
cttgtatggcctgggattttcacag

SEQ ID NO: 657238 - DNA, 25 bp, Homo sapien
gagtcctaggagtgattgtccccag

SEQ ID NO: 657239 - DNA, 25 bp, Homo sapien
gcaaaagctctcatcagtcttctaa

SEQ ID NO: 657240 - DNA, 25 bp, Homo sapien
aagaggctgagctgacaatggacac

SEQ ID NO: 657241 - DNA, 25 bp, Homo sapien
tgacaatggacacagcaccactctg

SEQ ID NO: 657242 - DNA, 25 bp, Homo sapien
cactctgccatcatctatggcttaa

SEQ ID NO: 657243 - DNA, 25 bp, Homo sapien
gcttaagcattcacagggccaggct

SEQ ID NO: 657244 - DNA, 25 bp, Homo sapien
gggccaggctaaattcaggctgtcg

SEQ ID NO: 657245 - DNA, 25 bp, Homo sapien
ggaagataaactccacctctcaatg

SEQ ID NO: 657246 - DNA, 25 bp, Homo sapien
agcaactgtggccatctttacccca

SEQ ID NO: 657247 - DNA, 25 bp, Homo sapien
cccatcagctttcttgccaagaaat

SEQ ID NO: 657248 - DNA, 25 bp, Homo sapien
ctttcaaaggccgggtgcattggct

SEQ ID NO: 657249 - DNA, 25 bp, Homo sapien
tttcaaaggccgggtgcattggctc

SEQ ID NO: 657250 - DNA, 25 bp, Homo sapien
ttcaaaggccgggtgcattggctca

SEQ ID NO: 657251 - DNA, 25 bp, Homo sapien
tcaaaggccgggtgcattggctcat

SEQ ID NO: 657252 - DNA, 25 bp, Homo sapien
ccaggcgtggcagtgtgcgcctata

SEQ ID NO: 657253 - DNA, 25 bp, Homo sapien
caggcgtggcagtgtgcgcctatag

SEQ ID NO: 657254 - DNA, 25 bp, Homo sapien
aggcgtggcagtgtgcgcctatagt

SEQ ID NO: 657255 - DNA, 25 bp, Homo sapien
ggcgtggcagtgtgcgcctatagtc

SEQ ID NO: 657256 - DNA, 25 bp, Homo sapien
gcgtggcagtgtgcgcctatagtcc

SEQ ID NO: 657257 - DNA, 25 bp, Homo sapien
cgtggcagtgtgcgcctatagtccc

SEQ ID NO: 657258 - DNA, 25 bp, Homo sapien
gtggcagtgtgcgcctatagtccca

SEQ ID NO: 657259 - DNA, 25 bp, Homo sapien
cgcacccaaccaaatctatacattt

SEQ ID NO: 657260 - DNA, 25 bp, Homo sapien
gcacccaaccaaatctatacatttc

SEQ ID NO: 657261 - DNA, 25 bp, Homo sapien
cacccaaccaaatctatacatttca

SEQ ID NO: 657262 - DNA, 25 bp, Homo sapien
acccaaccaaatctatacatttcaa

SEQ ID NO: 657263 - DNA, 25 bp, Homo sapien
cccaaccaaatctatacatttcaat

SEQ ID NO: 657264 - DNA, 25 bp, Homo sapien
ccaaccaaatctatacatttcaatg

SEQ ID NO: 657265 - DNA, 25 bp, Homo sapien
caaccaaatctatacatttcaatga

SEQ ID NO: 657266 - DNA, 25 bp, Homo sapien
aaccaaatctatacatttcaatgaa

SEQ ID NO: 657267 - DNA, 25 bp, Homo sapien
tgtaaggttttgttactatcataat

SEQ ID NO: 657268 - DNA, 25 bp, Homo sapien
gtaaggttttgttactatcataatg

SEQ ID NO: 657269 - DNA, 25 bp, Homo sapien
gacctcgtgataccctcacctcacc

SEQ ID NO: 657270 - DNA, 25 bp, Homo sapien
gacattctcaatgaatgaaatctgg

SEQ ID NO: 657271 - DNA, 25 bp, Homo sapien
gacatgttccaaaatcaatactaaa

SEQ ID NO: 657272 - DNA, 25 bp, Homo sapien
tttcctcctaagatgcagaacaaag

SEQ ID NO: 657273 - DNA, 25 bp, Homo sapien
aaagcaaagatgttctggcaaagga

SEQ ID NO: 657274 - DNA, 25 bp, Homo sapien
agtaatgggcaaacaatcagtggtt

SEQ ID NO: 657275 - DNA, 25 bp, Homo sapien
tgggcaaacaatcagtggttgccag

SEQ ID NO: 657276 - DNA, 25 bp, Homo sapien
tgaccacaaagggaagaatgagaga

SEQ ID NO: 657277 - DNA, 25 bp, Homo sapien
tttgtgtatgatgaactgtctgtat

SEQ ID NO: 657278 - DNA, 25 bp, Homo sapien
tgaactgtctgtatcctattgtggt

SEQ ID NO: 657279 - DNA, 25 bp, Homo sapien
actgtctgtatcctattgtggtggt

SEQ ID NO: 657280 - DNA, 25 bp, Homo sapien
ggttacatgaatctaaacatatgtt

SEQ ID NO: 657281 - DNA, 25 bp, Homo sapien
agtgctttgagccagtttggacaca

SEQ ID NO: 657282 - DNA, 25 bp, Homo sapien
aagcatgagaagagagggcagcact

SEQ ID NO: 657283 - DNA, 25 bp, Homo sapien
gggcagcactggtaggtaacgctaa

SEQ ID NO: 657284 - DNA, 25 bp, Homo sapien
aacgctaaaacaacatcgccttcat

SEQ ID NO: 657285 - DNA, 25 bp, Homo sapien
tcatctcttcaaccctgatctcttt

SEQ ID NO: 657286 - DNA, 25 bp, Homo sapien
gatctctttccaagaagtgagctga

SEQ ID NO: 657287 - DNA, 25 bp, Homo sapien
aagagttctagagggtagtctctaa

SEQ ID NO: 657288 - DNA, 25 bp, Homo sapien
gtctctaagtgagaaggaccatctc

SEQ ID NO: 657289 - DNA, 25 bp, Homo sapien
aggaccatctctatagggtggccct

SEQ ID NO: 657290 - DNA, 25 bp, Homo sapien
atagggtggccctgagtttatcctc

SEQ ID NO: 657291 - DNA, 25 bp, Homo sapien
tgagtttatcctcaaatttcctttc

SEQ ID NO: 657292 - DNA, 25 bp, Homo sapien
ggcagtttggtgttggcttttattc

SEQ ID NO: 657293 - DNA, 25 bp, Homo sapien
tggtgttggcttttattctgcctac

SEQ ID NO: 657294 - DNA, 25 bp, Homo sapien
ttggcttttattctgcctacttggt

SEQ ID NO: 657295 - DNA, 25 bp, Homo sapien
cttttattctgcctacttggtggca

SEQ ID NO: 657296 - DNA, 25 bp, Homo sapien
tgcctacttggtggcagagaaagtg

SEQ ID NO: 657297 - DNA, 25 bp, Homo sapien
gaaagtggttgtgatcacaaagcac

SEQ ID NO: 657298 - DNA, 25 bp, Homo sapien
tgtgatcacaaagcacaacgatgat

SEQ ID NO: 657299 - DNA, 25 bp, Homo sapien
cacaacgatgatgaacagtatgctt

SEQ ID NO: 657300 - DNA, 25 bp, Homo sapien
tcttctgctggaggttccttcactg

SEQ ID NO: 657301 - DNA, 25 bp, Homo sapien
gctggaggttccttcactgtgcgtg

SEQ ID NO: 657302 - DNA, 25 bp, Homo sapien
gtacctagaagagaggcgggtcaaa

SEQ ID NO: 657303 - DNA, 25 bp, Homo sapien
gtgttcatgggtaacactgttaata

SEQ ID NO: 657304 - DNA, 25 bp, Homo sapien
tattttggaaggtttcctgccagtc

SEQ ID NO: 657305 - DNA, 25 bp, Homo sapien
tttcctgccagtctttttttcctat

SEQ ID NO: 657306 - DNA, 25 bp, Homo sapien
tttcctatgcctttacaaaagtagc

SEQ ID NO: 657307 - DNA, 25 bp, Homo sapien
agcatattctatgtgcaatcctgta

SEQ ID NO: 657308 - DNA, 25 bp, Homo sapien
ttctatgtgcaatcctgtaatctgt

SEQ ID NO: 657309 - DNA, 25 bp, Homo sapien
acattattgtatcagcatttcccca

SEQ ID NO: 657310 - DNA, 25 bp, Homo sapien
cagcatttccccacataatcagtaa

SEQ ID NO: 657311 - DNA, 25 bp, Homo sapien
gtaaacgagcataatataattccat

SEQ ID NO: 657312 - DNA, 25 bp, Homo sapien
agcttgcctttgtttgttcgttggt

SEQ ID NO: 657313 - DNA, 25 bp, Homo sapien
ctttgtttgttcgttggtttgcttg

SEQ ID NO: 657314 - DNA, 25 bp, Homo sapien
cgcacccaaccaaatctatacattt

SEQ ID NO: 657315 - DNA, 25 bp, Homo sapien
gcacccaaccaaatctatacatttc

SEQ ID NO: 657316 - DNA, 25 bp, Homo sapien
cacccaaccaaatctatacatttca

SEQ ID NO: 657317 - DNA, 25 bp, Homo sapien
acccaaccaaatctatacatttcaa

SEQ ID NO: 657318 - DNA, 25 bp, Homo sapien
ccaaccaaatctatacatttcaatg

SEQ ID NO: 657319 - DNA, 25 bp, Homo sapien
aaccaaatctatacatttcaatgaa

SEQ ID NO: 657320 - DNA, 25 bp, Homo sapien
tgtaaggttttgttactatcataat

SEQ ID NO: 657321 - DNA, 25 bp, Homo sapien
gtaaggttttgttactatcataatg

SEQ ID NO: 657322 - DNA, 25 bp, Homo sapien
aatgttaattattttcttgtcttat

SEQ ID NO: 657323 - DNA, 25 bp, Homo sapien
tatctgtctttgtagtttaataaaa

SEQ ID NO: 657324 - DNA, 25 bp, Homo sapien
gacctcgtgataccctcacctcacc

SEQ ID NO: 657325 - DNA, 25 bp, Homo sapien
tattttcttttagtgccttttgtat

SEQ ID NO: 657326 - DNA, 25 bp, Homo sapien
gtgccttttgtatatatctctgtta

SEQ ID NO: 657327 - DNA, 25 bp, Homo sapien
gtatatatctctgttattgcattgt

SEQ ID NO: 657328 - DNA, 25 bp, Homo sapien
ctacatgattaattatgggaaggca

SEQ ID NO: 657329 - DNA, 25 bp, Homo sapien
ggaaggcagaaatatactttactct

SEQ ID NO: 657330 - DNA, 25 bp, Homo sapien
gaaatatactttactctgctctttg

SEQ ID NO: 657331 - DNA, 25 bp, Homo sapien
atatactttactctgctctttgtcc

SEQ ID NO: 657332 - DNA, 25 bp, Homo sapien
tttgtccacatttcctcatctaatt

SEQ ID NO: 657333 - DNA, 25 bp, Homo sapien
tccacatttcctcatctaattcttg

SEQ ID NO: 657334 - DNA, 25 bp, Homo sapien
tcatctaattcttggtacaaaacag

SEQ ID NO: 657335 - DNA, 25 bp, Homo sapien
ttcttggtacaaaacaggattcaat

SEQ ID NO: 657336 - DNA, 25 bp, Homo sapien
ttcactatgttggtcttgatctctt

SEQ ID NO: 657337 - DNA, 25 bp, Homo sapien
gagccaccgagcctgacctggaagt

SEQ ID NO: 657338 - DNA, 25 bp, Homo sapien
agccaccgagcctgacctggaagta

SEQ ID NO: 657339 - DNA, 25 bp, Homo sapien
gccaccgagcctgacctggaagtaa

SEQ ID NO: 657340 - DNA, 25 bp, Homo sapien
ccaccgagcctgacctggaagtaac

SEQ ID NO: 657341 - DNA, 25 bp, Homo sapien
caccgagcctgacctggaagtaact

SEQ ID NO: 657342 - DNA, 25 bp, Homo sapien
accgagcctgacctggaagtaactc

SEQ ID NO: 657343 - DNA, 25 bp, Homo sapien
ccgagcctgacctggaagtaactct

SEQ ID NO: 657344 - DNA, 25 bp, Homo sapien
gagcctgacctggaagtaactcttt

SEQ ID NO: 657345 - DNA, 25 bp, Homo sapien
agcctgacctggaagtaactctttt

SEQ ID NO: 657346 - DNA, 25 bp, Homo sapien
gcctgacctggaagtaactctttta

SEQ ID NO: 657347 - DNA, 25 bp, Homo sapien
tttttgtgactatcccccttatata

SEQ ID NO: 657348 - DNA, 25 bp, Homo sapien
gactatcccccttatatattatgaa

SEQ ID NO: 657349 - DNA, 25 bp, Homo sapien
cattttttgtgactatcctctttat

SEQ ID NO: 657350 - DNA, 25 bp, Homo sapien
ttttgtgactatcctctttatatgt

SEQ ID NO: 657351 - DNA, 25 bp, Homo sapien
gtgactatcctctttatatgtattg

SEQ ID NO: 657352 - DNA, 25 bp, Homo sapien
actatcctctttatatgtattgtga

SEQ ID NO: 657353 - DNA, 25 bp, Homo sapien
ggttttttatagtgaatatcctcct

SEQ ID NO: 657354 - DNA, 25 bp, Homo sapien
cctcctaatgctactagtattgttt

SEQ ID NO: 657355 - DNA, 25 bp, Homo sapien
actagtattgtttgcaatctgtcat

SEQ ID NO: 657356 - DNA, 25 bp, Homo sapien
gtttgcaatctgtcattattcttat

SEQ ID NO: 657357 - DNA, 25 bp, Homo sapien
taaacttcaacagagtacctgtgtg

SEQ ID NO: 657358 - DNA, 25 bp, Homo sapien
tggccaaatccaatagaaagctggg

SEQ ID NO: 657359 - DNA, 25 bp, Homo sapien
ctcccccgaacagaagtggcaagtg

SEQ ID NO: 657360 - DNA, 25 bp, Homo sapien
agtgggcagggcaaaaaatgcagct

SEQ ID NO: 657361 - DNA, 25 bp, Homo sapien
aaaatgcagctgaattgtgtgaaca

SEQ ID NO: 657362 - DNA, 25 bp, Homo sapien
attgtgtgaacagactactcggcat

SEQ ID NO: 657363 - DNA, 25 bp, Homo sapien
gtgtgaacagactactcggcatact

SEQ ID NO: 657364 - DNA, 25 bp, Homo sapien
gaacagactactcggcatactgcca

SEQ ID NO: 657365 - DNA, 25 bp, Homo sapien
agactactcggcatactgccaagcc

SEQ ID NO: 657366 - DNA, 25 bp, Homo sapien
tcggcatactgccaagcctcagtgt

SEQ ID NO: 657367 - DNA, 25 bp, Homo sapien
atactgccaagcctcagtgtctcta

SEQ ID NO: 657368 - DNA, 25 bp, Homo sapien
tgccaagcctcagtgtctctatctg

SEQ ID NO: 657369 - DNA, 25 bp, Homo sapien
gggtcccctgaagcagacctagaga

SEQ ID NO: 657370 - DNA, 25 bp, Homo sapien
cccctgaagcagacctagagacaag

SEQ ID NO: 657371 - DNA, 25 bp, Homo sapien
gcagacctagagacaagaattcaag

SEQ ID NO: 657372 - DNA, 25 bp, Homo sapien
ttcaagatcaagtcatttatttaag

SEQ ID NO: 657373 - DNA, 25 bp, Homo sapien
taagaagagatcctggaagttccag

SEQ ID NO: 657374 - DNA, 25 bp, Homo sapien
agagcaatgaaaggcgcgtgaatga

SEQ ID NO: 657375 - DNA, 25 bp, Homo sapien
gaatgagctggtgaccacgctggac

SEQ ID NO: 657376 - DNA, 25 bp, Homo sapien
tggtgaccacgctggacccaggcct

SEQ ID NO: 657377 - DNA, 25 bp, Homo sapien
ctactggggccatctcaagggttgg

SEQ ID NO: 657378 - DNA, 25 bp, Homo sapien
gccaaatcaggcctgcctcctgaat

SEQ ID NO: 657379 - DNA, 25 bp, Homo sapien
ggcctgcctcctgaatttgtaaata

SEQ ID NO: 657380 - DNA, 25 bp, Homo sapien
gatgtaaatatataagaaaccggct

SEQ ID NO: 657381 - DNA, 25 bp, Homo sapien
tgtaaatatataagaaaccggctgg

SEQ ID NO: 657382 - DNA, 25 bp, Homo sapien
gtaaatatataagaaaccggctggg

SEQ ID NO: 657383 - DNA, 25 bp, Homo sapien
taaatatataagaaaccggctgggc

SEQ ID NO: 657384 - DNA, 25 bp, Homo sapien
aaatatataagaaaccggctgggca

SEQ ID NO: 657385 - DNA, 25 bp, Homo sapien
aatatataagaaaccggctgggcac

SEQ ID NO: 657386 - DNA, 25 bp, Homo sapien
atatataagaaaccggctgggcacg

SEQ ID NO: 657387 - DNA, 25 bp, Homo sapien
atataagaaaccggctgggcacggt

SEQ ID NO: 657388 - DNA, 25 bp, Homo sapien
agcctaggcaatggagcgaaaccct

SEQ ID NO: 657389 - DNA, 25 bp, Homo sapien
gcctaggcaatggagcgaaaccctg

SEQ ID NO: 657390 - DNA, 25 bp, Homo sapien
tgaggtgggagaaggtacccaagcc

SEQ ID NO: 657391 - DNA, 25 bp, Homo sapien
gtgaagacaggctgtgacactctgg

SEQ ID NO: 657392 - DNA, 25 bp, Homo sapien
tgtgacactctggatgtcttggtgt

SEQ ID NO: 657393 - DNA, 25 bp, Homo sapien
gtgtagacacacattgcagactctt

SEQ ID NO: 657394 - DNA, 25 bp, Homo sapien
gactcttaacgcaggaaggacttca

SEQ ID NO: 657395 - DNA, 25 bp, Homo sapien
aaggacttcaaacttctgctgagac

SEQ ID NO: 657396 - DNA, 25 bp, Homo sapien
ttcaaacttctgctgagaccttggg

SEQ ID NO: 657397 - DNA, 25 bp, Homo sapien
gggtcaaggaacatttcattggttt

SEQ ID NO: 657398 - DNA, 25 bp, Homo sapien
atctcccttgctcatttggatgcgt

SEQ ID NO: 657399 - DNA, 25 bp, Homo sapien
atttggatgcgtcaccttaattctc

SEQ ID NO: 657400 - DNA, 25 bp, Homo sapien
aggttttctcttggtgggatatgca

SEQ ID NO: 657401 - DNA, 25 bp, Homo sapien
tatgcagaacttgggatgtgtgtat

SEQ ID NO: 657402 - DNA, 25 bp, Homo sapien
gaggaggccaatgatgtgagtaaaa

SEQ ID NO: 657403 - DNA, 25 bp, Homo sapien
aaaggagcactgcaggaaccggacc

SEQ ID NO: 657404 - DNA, 25 bp, Homo sapien
gggagcaaggactcatggcagagaa

SEQ ID NO: 657405 - DNA, 25 bp, Homo sapien
aaccaagataagaaagtcaactgtg

SEQ ID NO: 657406 - DNA, 25 bp, Homo sapien
gtcaactgtgaaggtgaactaagaa

SEQ ID NO: 657407 - DNA, 25 bp, Homo sapien
ggtgaactaagaacacatgatggat

SEQ ID NO: 657408 - DNA, 25 bp, Homo sapien
acacatgatggatgagtggaaacca

SEQ ID NO: 657409 - DNA, 25 bp, Homo sapien
accaggggccagaaagtctttgaag

SEQ ID NO: 657410 - DNA, 25 bp, Homo sapien
aaggcagaagatacaaggcaatttg

SEQ ID NO: 657411 - DNA, 25 bp, Homo sapien
aagtagtgaaaatgtgcaggccaat

SEQ ID NO: 657412 - DNA, 25 bp, Homo sapien
tgaaaatgtgcaggccaatgtgaga

SEQ ID NO: 657413 - DNA, 25 bp, Homo sapien
catggagaccgtgactgtgaaagat

SEQ ID NO: 657414 - DNA, 25 bp, Homo sapien
atcaagtgcagatttggtggcctct

SEQ ID NO: 657415 - DNA, 25 bp, Homo sapien
atttggtggcctctgattgccagta

SEQ ID NO: 657416 - DNA, 25 bp, Homo sapien
tggcctctgattgccagtatctggc

SEQ ID NO: 657417 - DNA, 25 bp, Homo sapien
cttcccacaagatgtgctggaaata

SEQ ID NO: 657418 - DNA, 25 bp, Homo sapien
atgaccaagcagaagttcacttaag

SEQ ID NO: 657419 - DNA, 25 bp, Homo sapien
gaatccaacagttaaacctaccatg

SEQ ID NO: 657420 - DNA, 25 bp, Homo sapien
acctaccatggaagggtgtggtgca

SEQ ID NO: 657421 - DNA, 25 bp, Homo sapien
agaccacagtgggaacctccaagga

SEQ ID NO: 657422 - DNA, 25 bp, Homo sapien
aacctccaaggaactaacatctagc

SEQ ID NO: 657423 - DNA, 25 bp, Homo sapien
aaggagcctcccagatggagtacat

SEQ ID NO: 657424 - DNA, 25 bp, Homo sapien
attttcactgtggatgaggaagcta

SEQ ID NO: 657425 - DNA, 25 bp, Homo sapien
aagctaaagcccgagacttccgaga

SEQ ID NO: 657426 - DNA, 25 bp, Homo sapien
gagacttccgagatcacacaactac

SEQ ID NO: 657427 - DNA, 25 bp, Homo sapien
gatcacacaactacttaagatgcca

SEQ ID NO: 657428 - DNA, 25 bp, Homo sapien
taagatgccagacaaggacccaaac

SEQ ID NO: 657429 - DNA, 25 bp, Homo sapien
tttcatttatgatagccctttggct

SEQ ID NO: 657430 - DNA, 25 bp, Homo sapien
gccctttggcttgaaagcatgccca

SEQ ID NO: 657431 - DNA, 25 bp, Homo sapien
agcatgcccaaaagtctcatcattc

SEQ ID NO: 657432 - DNA, 25 bp, Homo sapien
caatatcctctatttttgtgcctat

SEQ ID NO: 657433 - DNA, 25 bp, Homo sapien
gtgcctatattttattcgtatgttt

SEQ ID NO: 657434 - DNA, 25 bp, Homo sapien
gtagtgccacattgtttgttgattg

SEQ ID NO: 657435 - DNA, 25 bp, Homo sapien
agagctgagaaatttcaggtgcaaa

SEQ ID NO: 657436 - DNA, 25 bp, Homo sapien
gagaggctataacatggtggcacta

SEQ ID NO: 657437 - DNA, 25 bp, Homo sapien
cactagaataagactgccgggtttg

SEQ ID NO: 657438 - DNA, 25 bp, Homo sapien
cgggtttgaatcctggtgcaactac

SEQ ID NO: 657439 - DNA, 25 bp, Homo sapien
gaatcctggtgcaactacttattac

SEQ ID NO: 657440 - DNA, 25 bp, Homo sapien
gcaactacttattacctgtgtgatc

SEQ ID NO: 657441 - DNA, 25 bp, Homo sapien
taacctttctgggtcacagtttgga

SEQ ID NO: 657442 - DNA, 25 bp, Homo sapien
tctgggtcacagtttggatacctat

SEQ ID NO: 657443 - DNA, 25 bp, Homo sapien
ttggatacctataaacggcagatat

SEQ ID NO: 657444 - DNA, 25 bp, Homo sapien
cggcagatattaacagtctctattt

SEQ ID NO: 657445 - DNA, 25 bp, Homo sapien
aacagtctctatttgtgtggatatt

SEQ ID NO: 657446 - DNA, 25 bp, Homo sapien
agcagagaaaaatccctggcctccc

SEQ ID NO: 657447 - DNA, 25 bp, Homo sapien
caccagagcctttcattggccaaat

SEQ ID NO: 657448 - DNA, 25 bp, Homo sapien
tggccaaatccaatagaaagctggg

SEQ ID NO: 657449 - DNA, 25 bp, Homo sapien
ctcccccgaacagaagtggcaagtg

SEQ ID NO: 657450 - DNA, 25 bp, Homo sapien
agtgggcagggcaaaaaatgcagct

SEQ ID NO: 657451 - DNA, 25 bp, Homo sapien
aaaatgcagctgaattgtgtgaaca

SEQ ID NO: 657452 - DNA, 25 bp, Homo sapien
ttgtgtgaacagactactcggcata

SEQ ID NO: 657453 - DNA, 25 bp, Homo sapien
gaacagactactcggcatactgcca

SEQ ID NO: 657454 - DNA, 25 bp, Homo sapien
tcggcatactgccaagcctcagtgt

SEQ ID NO: 657455 - DNA, 25 bp, Homo sapien
tgccaagcctcagtgtctctatctg

SEQ ID NO: 657456 - DNA, 25 bp, Homo sapien
agtgggcataaaatcttcctccttc

SEQ ID NO: 657457 - DNA, 25 bp, Homo sapien
gcaggacaaggaagaggacccacaa

SEQ ID NO: 657458 - DNA, 25 bp, Homo sapien
gagacagggatctctgggtgtctga

SEQ ID NO: 657459 - DNA, 25 bp, Homo sapien
gtgtctgagggcaagtgaaagccat

SEQ ID NO: 657460 - DNA, 25 bp, Homo sapien
agggcaagtgaaagccatggtactg

SEQ ID NO: 657461 - DNA, 25 bp, Homo sapien
gaaagccatggtactgggaaggatc

SEQ ID NO: 657462 - DNA, 25 bp, Homo sapien
aggatctgtggtgctatagaagtat

SEQ ID NO: 657463 - DNA, 25 bp, Homo sapien
gtatgagcaagctagctgcttccag

SEQ ID NO: 657464 - DNA, 25 bp, Homo sapien
tgagcaagctagctgcttccagaaa

SEQ ID NO: 657465 - DNA, 25 bp, Homo sapien
aaaaagtctgtggatggagcaattc

SEQ ID NO: 657466 - DNA, 25 bp, Homo sapien
aatcagagctgatgttcacgccaaa

SEQ ID NO: 657467 - DNA, 25 bp, Homo sapien
cagagctgatgttcacgccaaaaaa

SEQ ID NO: 657468 - DNA, 25 bp, Homo sapien
ggatcctttcctggattgaagcctg

SEQ ID NO: 657469 - DNA, 25 bp, Homo sapien
gatcctttcctggattgaagcctga

SEQ ID NO: 657470 - DNA, 25 bp, Homo sapien
tcctttcctggattgaagcctgact

SEQ ID NO: 657471 - DNA, 25 bp, Homo sapien
cctttcctggattgaagcctgactt

SEQ ID NO: 657472 - DNA, 25 bp, Homo sapien
tttcctggattgaagcctgactttt

SEQ ID NO: 657473 - DNA, 25 bp, Homo sapien
tcctggattgaagcctgacttttaa

SEQ ID NO: 657474 - DNA, 25 bp, Homo sapien
ctggattgaagcctgacttttaaaa

SEQ ID NO: 657475 - DNA, 25 bp, Homo sapien
gattgaagcctgacttttaaaaaag

SEQ ID NO: 657476 - DNA, 25 bp, Homo sapien
gtttcaataaattgcttatacctat

SEQ ID NO: 657477 - DNA, 25 bp, Homo sapien
aattgcttatacctatgaagagatg

SEQ ID NO: 657478 - DNA, 25 bp, Homo sapien
ttatacctatgaagagatgcaaaag

SEQ ID NO: 657479 - DNA, 25 bp, Homo sapien
gagacaattaatctttactccttgt

SEQ ID NO: 657480 - DNA, 25 bp, Homo sapien
tttccctaaattttgttcatactat

SEQ ID NO: 657481 - DNA, 25 bp, Homo sapien
ctatgcaattcatcagccagatccc

SEQ ID NO: 657482 - DNA, 25 bp, Homo sapien
gatccccctttcagaacccaggaga

SEQ ID NO: 657483 - DNA, 25 bp, Homo sapien
gagacagcagctatcaaaaactatg

SEQ ID NO: 657484 - DNA, 25 bp, Homo sapien
aactatgggctataacctttctgtc

SEQ ID NO: 657485 - DNA, 25 bp, Homo sapien
tgggctataacctttctgtcttttt

SEQ ID NO: 657486 - DNA, 25 bp, Homo sapien
agcttaaaaatcttattgcttagaa

SEQ ID NO: 657487 - DNA, 25 bp, Homo sapien
tgttgttagaatcccaaatcttttc

SEQ ID NO: 657488 - DNA, 25 bp, Homo sapien
atcttttcttaatagcatttcatag

SEQ ID NO: 657489 - DNA, 25 bp, Homo sapien
gaagttcacagacagttgaatcatg

SEQ ID NO: 657490 - DNA, 25 bp, Homo sapien
gaccaaaggttagaagactccacat

SEQ ID NO: 657491 - DNA, 25 bp, Homo sapien
aagactccacattggaatcctgggt

SEQ ID NO: 657492 - DNA, 25 bp, Homo sapien
tggaatcctgggtccgccgttaaat

SEQ ID NO: 657493 - DNA, 25 bp, Homo sapien
ctgggtccgccgttaaataatgagg

SEQ ID NO: 657494 - DNA, 25 bp, Homo sapien
ggaacaagcactacctcatagagaa

SEQ ID NO: 657495 - DNA, 25 bp, Homo sapien
gcaagaagcccataggaacacaatt

SEQ ID NO: 657496 - DNA, 25 bp, Homo sapien
taggaacacaattagtagagcactg

SEQ ID NO: 657497 - DNA, 25 bp, Homo sapien
gaataatatttcactgtcctgatgt

SEQ ID NO: 657498 - DNA, 25 bp, Homo sapien
gtcctgatgtaccaagtttatccat

SEQ ID NO: 657499 - DNA, 25 bp, Homo sapien
gacatcttggttgttctatgttttg

SEQ ID NO: 657500 - DNA, 25 bp, Homo sapien
ggttgttctatgttttggcaagtat

SEQ ID NO: 657501 - DNA, 25 bp, Homo sapien
agtgtggtaatttctctaagctatt

SEQ ID NO: 657502 - DNA, 25 bp, Homo sapien
ggtaatttctctaagctattcatct

SEQ ID NO: 657503 - DNA, 25 bp, Homo sapien
ctctaagctattcatcttttggaaa

SEQ ID NO: 657504 - DNA, 25 bp, Homo sapien
taataagactttgtacaagggattt

SEQ ID NO: 657505 - DNA, 25 bp, Homo sapien
cttttagttgaggtgggtgaatata

SEQ ID NO: 657506 - DNA, 25 bp, Homo sapien
gaatataaattatgtctggcagaat

SEQ ID NO: 657507 - DNA, 25 bp, Homo sapien
atgtctggcagaatgggtaaaatac

SEQ ID NO: 657508 - DNA, 25 bp, Homo sapien
gagaaagaaccaccataagctgagg

SEQ ID NO: 657509 - DNA, 25 bp, Homo sapien
gaaccaccataagctgaggtagcag

SEQ ID NO: 657510 - DNA, 25 bp, Homo sapien
aggtagcagaatgtgtgttctcagc

SEQ ID NO: 657511 - DNA, 25 bp, Homo sapien
tgttctcagctccactcatttattc

SEQ ID NO: 657512 - DNA, 25 bp, Homo sapien
aggaactttcgcgtcctcaagtact

SEQ ID NO: 657513 - DNA, 25 bp, Homo sapien
gaactttcgcgtcctcaagtacttt

SEQ ID NO: 657514 - DNA, 25 bp, Homo sapien
ctcggagccttgaggacaaggaccg

SEQ ID NO: 657515 - DNA, 25 bp, Homo sapien
gttctggaagtttcgggagctgaca

SEQ ID NO: 657516 - DNA, 25 bp, Homo sapien
gaagtttcgggagctgacagcagac

SEQ ID NO: 657517 - DNA, 25 bp, Homo sapien
gtttcgggagctgacagcagacact

SEQ ID NO: 657518 - DNA, 25 bp, Homo sapien
ggagctgacagcagacactggtctc

SEQ ID NO: 657519 - DNA, 25 bp, Homo sapien
agctgacagcagacactggtctcta

SEQ ID NO: 657520 - DNA, 25 bp, Homo sapien
gacagcagacactggtctctacctg

SEQ ID NO: 657521 - DNA, 25 bp, Homo sapien
agcagacactggtctctacctggcg

SEQ ID NO: 657522 - DNA, 25 bp, Homo sapien
agacactggtctctacctggcggcc

SEQ ID NO: 657523 - DNA, 25 bp, Homo sapien
agcccaggagaacccggaagccagc

SEQ ID NO: 657524 - DNA, 25 bp, Homo sapien
caggagaacccggaagccagcagct

SEQ ID NO: 657525 - DNA, 25 bp, Homo sapien
gagaacccggaagccagcagctctt

SEQ ID NO: 657526 - DNA, 25 bp, Homo sapien
aacccggaagccagcagctcttgtt

SEQ ID NO: 657527 - DNA, 25 bp, Homo sapien
gaagccagcagctcttgtttctctg

SEQ ID NO: 657528 - DNA, 25 bp, Homo sapien
ctgtgtgtttctgtgaggaaccacc

SEQ ID NO: 657529 - DNA, 25 bp, Homo sapien
tgtgtttctgtgaggaaccaccaaa

SEQ ID NO: 657530 - DNA, 25 bp, Homo sapien
gttttccacggcaagtgcatcattt

SEQ ID NO: 657531 - DNA, 25 bp, Homo sapien
tttccacggcaagtgcatcattttc

SEQ ID NO: 657532 - DNA, 25 bp, Homo sapien
aatttctccacctccttagcaacat

SEQ ID NO: 657533 - DNA, 25 bp, Homo sapien
tccacctccttagcaacattgattt

SEQ ID NO: 657534 - DNA, 25 bp, Homo sapien
aaccaaggatccatgtgctccccag

SEQ ID NO: 657535 - DNA, 25 bp, Homo sapien
atgtgctccccaggtcaagaagcaa

SEQ ID NO: 657536 - DNA, 25 bp, Homo sapien
gctccccaggtcaagaagcaatgcc

SEQ ID NO: 657537 - DNA, 25 bp, Homo sapien
atgcccaccgaaaggcaccatcatt

SEQ ID NO: 657538 - DNA, 25 bp, Homo sapien
attccagcccagcagaagtgtccct

SEQ ID NO: 657539 - DNA, 25 bp, Homo sapien
gtaaggatggactggatattaccat

SEQ ID NO: 657540 - DNA, 25 bp, Homo sapien
ccatcctggctaccagatggaacct

SEQ ID NO: 657541 - DNA, 25 bp, Homo sapien
accagatggaaccttctcttcttcc

SEQ ID NO: 657542 - DNA, 25 bp, Homo sapien
tctcctcctgcccaagatgtaagga

SEQ ID NO: 657543 - DNA, 25 bp, Homo sapien
cctgcccaagatgtaaggaagcatt

SEQ ID NO: 657544 - DNA, 25 bp, Homo sapien
tgtaaggatttcttcccatcgtacc

SEQ ID NO: 657545 - DNA, 25 bp, Homo sapien
gctgcaaaggtgcttgctcttactg

SEQ ID NO: 657546 - DNA, 25 bp, Homo sapien
gtgcttgctcttactgtttcaaatt

SEQ ID NO: 657547 - DNA, 25 bp, Homo sapien
ttcaaatttttgcaactctgtagtg

SEQ ID NO: 657548 - DNA, 25 bp, Homo sapien
gcaactctgtagtgtctcactttta

SEQ ID NO: 657549 - DNA, 25 bp, Homo sapien
ggaacagcttgattgcaaaggagaa

SEQ ID NO: 657550 - DNA, 25 bp, Homo sapien
gttatctccaacttcctaaaggctt

SEQ ID NO: 657551 - DNA, 25 bp, Homo sapien
acttcctaaaggcttatgacttcta

SEQ ID NO: 657552 - DNA, 25 bp, Homo sapien
gtgaatctatcagcattccacatca

SEQ ID NO: 657553 - DNA, 25 bp, Homo sapien
gcattccacatcagatttaaagcat

SEQ ID NO: 657554 - DNA, 25 bp, Homo sapien
taaagcatcaaatgcctgtgaaaca

SEQ ID NO: 657555 - DNA, 25 bp, Homo sapien
gccaaaaccaaccatgaagctgcaa

SEQ ID NO: 657556 - DNA, 25 bp, Homo sapien
gtgcatgaggatcggactccgcctc

SEQ ID NO: 657557 - DNA, 25 bp, Homo sapien
gcctcccatcttggtttcgagtgaa

SEQ ID NO: 657558 - DNA, 25 bp, Homo sapien
tcgagtgaagtgacggctgagccaa

SEQ ID NO: 657559 - DNA, 25 bp, Homo sapien
tttcagctttagtatttccgcaatg

SEQ ID NO: 657560 - DNA, 25 bp, Homo sapien
gctccagctgctcaaagacgagcct

SEQ ID NO: 657561 - DNA, 25 bp, Homo sapien
aaagacgagccttcaacttgaaagt

SEQ ID NO: 657562 - DNA, 25 bp, Homo sapien
acttgaaagttctgcagcctggaaa

SEQ ID NO: 657563 - DNA, 25 bp, Homo sapien
attgggagaatgttccctctggaaa

SEQ ID NO: 657564 - DNA, 25 bp, Homo sapien
tggaaaatttcctctcaccacgttt

SEQ ID NO: 657565 - DNA, 25 bp, Homo sapien
cttttgtctccatatagcagtccag

SEQ ID NO: 657566 - DNA, 25 bp, Homo sapien
atagcagtccaggaaaccggagaaa

SEQ ID NO: 657567 - DNA, 25 bp, Homo sapien
tgccatatgctacaacatggacgtt

SEQ ID NO: 657568 - DNA, 25 bp, Homo sapien
tacaacatggacgttatgctaagtg

SEQ ID NO: 657569 - DNA, 25 bp, Homo sapien
caaatacacccatttccacttatat

SEQ ID NO: 657570 - DNA, 25 bp, Homo sapien
gggtatctaacgtcaaactcagaag

SEQ ID NO: 657571 - DNA, 25 bp, Homo sapien
aaagtactgcggtatttgccacaag

SEQ ID NO: 657572 - DNA, 25 bp, Homo sapien
actgcggtatttgccacaagctggt

SEQ ID NO: 657573 - DNA, 25 bp, Homo sapien
atgggtattgagtgtcagccacgca

SEQ ID NO: 657574 - DNA, 25 bp, Homo sapien
ttgagtgtcagccacgcaagatgga

SEQ ID NO: 657575 - DNA, 25 bp, Homo sapien
gccacgcaagatggaaaagcttttt

SEQ ID NO: 657576 - DNA, 25 bp, Homo sapien
gttaacaatactcttcggtacacac

SEQ ID NO: 657577 - DNA, 25 bp, Homo sapien
actcttcggtacacacaaagtatgt

SEQ ID NO: 657578 - DNA, 25 bp, Homo sapien
atttatgtataatggtaacctgagc

SEQ ID NO: 657579 - DNA, 25 bp, Homo sapien
atgtataatggtaacctgagcctgc

SEQ ID NO: 657580 - DNA, 25 bp, Homo sapien
gtataatggtaacctgagcctgcat

SEQ ID NO: 657581 - DNA, 25 bp, Homo sapien
tataatggtaacctgagcctgcatg

SEQ ID NO: 657582 - DNA, 25 bp, Homo sapien
ataatggtaacctgagcctgcatgt

SEQ ID NO: 657583 - DNA, 25 bp, Homo sapien
taatggtaacctgagcctgcatgtt

SEQ ID NO: 657584 - DNA, 25 bp, Homo sapien
aatggtaacctgagcctgcatgtta

SEQ ID NO: 657585 - DNA, 25 bp, Homo sapien
atggtaacctgagcctgcatgttat

SEQ ID NO: 657586 - DNA, 25 bp, Homo sapien
ggtaacctgagcctgcatgttattc

SEQ ID NO: 657587 - DNA, 25 bp, Homo sapien
gtaacctgagcctgcatgttattca

SEQ ID NO: 657588 - DNA, 25 bp, Homo sapien
gaaatttaatcacaggtggaatctt

SEQ ID NO: 657589 - DNA, 25 bp, Homo sapien
ttgtattctttaaaactggcatgta

SEQ ID NO: 657590 - DNA, 25 bp, Homo sapien
aaaactggcatgtaaacttggtata

SEQ ID NO: 657591 - DNA, 25 bp, Homo sapien
gcatgtaaacttggtatatttcctt

SEQ ID NO: 657592 - DNA, 25 bp, Homo sapien
aatcattatgttgtttacaaatctg

SEQ ID NO: 657593 - DNA, 25 bp, Homo sapien
actgttttactgcttatcctgccaa

SEQ ID NO: 657594 - DNA, 25 bp, Homo sapien
gttttactgcttatcctgccaactt

SEQ ID NO: 657595 - DNA, 25 bp, Homo sapien
tttactgcttatcctgccaactttc

SEQ ID NO: 657596 - DNA, 25 bp, Homo sapien
ctttctgaattatgtcagtatctcc

SEQ ID NO: 657597 - DNA, 25 bp, Homo sapien
atgtcagtatctccactgattttgt

SEQ ID NO: 657598 - DNA, 25 bp, Homo sapien
agtatctccactgattttgtgtgtt

SEQ ID NO: 657599 - DNA, 25 bp, Homo sapien
tgattttgtgtgttccaatttttaa

SEQ ID NO: 657600 - DNA, 25 bp, Homo sapien
atattttgatagtattgcctggaga

SEQ ID NO: 657601 - DNA, 25 bp, Homo sapien
tttgatagtattgcctggagaaaaa

SEQ ID NO: 657602 - DNA, 25 bp, Homo sapien
gcccagtcacaatgaatgttaaaga

SEQ ID NO: 657603 - DNA, 25 bp, Homo sapien
aatgttaaagacttgagacgtcttc

SEQ ID NO: 657604 - DNA, 25 bp, Homo sapien
gacttgagacgtcttcaaaacttgt

SEQ ID NO: 657605 - DNA, 25 bp, Homo sapien
ttgagacgtcttcaaaacttgtttt

SEQ ID NO: 657606 - DNA, 25 bp, Homo sapien
tcaacagtaaatctttttggcccct

SEQ ID NO: 657607 - DNA, 25 bp, Homo sapien
atgtatccattaacatttccaggga

SEQ ID NO: 657608 - DNA, 25 bp, Homo sapien
attaacatttccagggataccagtg

SEQ ID NO: 657609 - DNA, 25 bp, Homo sapien
aacatttccagggataccagtgaaa

SEQ ID NO: 657610 - DNA, 25 bp, Homo sapien
tttccagggataccagtgaaataat

SEQ ID NO: 657611 - DNA, 25 bp, Homo sapien
tgacaaagcatccacctaacagacg

SEQ ID NO: 657612 - DNA, 25 bp, Homo sapien
acaaagcatccacctaacagacgag

SEQ ID NO: 657613 - DNA, 25 bp, Homo sapien
agcatccacctaacagacgaggaat

SEQ ID NO: 657614 - DNA, 25 bp, Homo sapien
ctaacagacgaggaatcagctttga

SEQ ID NO: 657615 - DNA, 25 bp, Homo sapien
aacagacgaggaatcagctttgaag

SEQ ID NO: 657616 - DNA, 25 bp, Homo sapien
ggaatcagctttgaagtgggagccc

SEQ ID NO: 657617 - DNA, 25 bp, Homo sapien
cagctttgaagtgggagcccagttg

SEQ ID NO: 657618 - DNA, 25 bp, Homo sapien
ctttgaagtgggagcccagttggaa

SEQ ID NO: 657619 - DNA, 25 bp, Homo sapien
aaggcagccccgttgatgactgaaa

SEQ ID NO: 657620 - DNA, 25 bp, Homo sapien
ggcagccccgttgatgactgaaaat

SEQ ID NO: 657621 - DNA, 25 bp, Homo sapien
gaaaatgacaaagcatccacctaac

SEQ ID NO: 657622 - DNA, 25 bp, Homo sapien
tacccatttatactctgtttcaccc

SEQ ID NO: 657623 - DNA, 25 bp, Homo sapien
ttatactctgtttcacccttcctaa

SEQ ID NO: 657624 - DNA, 25 bp, Homo sapien
aaaagtactagttatcatccttcac

SEQ ID NO: 657625 - DNA, 25 bp, Homo sapien
atcatccttcacttttcatgtttag

SEQ ID NO: 657626 - DNA, 25 bp, Homo sapien
catgtttagaatcggttaggtgaaa

SEQ ID NO: 657627 - DNA, 25 bp, Homo sapien
gtgaaaaatagcatttccatttact

SEQ ID NO: 657628 - DNA, 25 bp, Homo sapien
aaatatctttctatgtggttttggg

SEQ ID NO: 657629 - DNA, 25 bp, Homo sapien
gataatcttttattggtttttcaga

SEQ ID NO: 657630 - DNA, 25 bp, Homo sapien
gtttttcagactattacctatattc

SEQ ID NO: 657631 - DNA, 25 bp, Homo sapien
tacctatattcctgagtctgacata

SEQ ID NO: 657632 - DNA, 25 bp, Homo sapien
gagtctgacatatcaaagtttttaa

SEQ ID NO: 657633 - DNA, 25 bp, Homo sapien
tggagtttctccactgtaaggttac

SEQ ID NO: 657634 - DNA, 25 bp, Homo sapien
gagtttctccactgtaaggttacta

SEQ ID NO: 657635 - DNA, 25 bp, Homo sapien
tggagaagtactttgagacttgtaa

SEQ ID NO: 657636 - DNA, 25 bp, Homo sapien
gagacttgtaagtagccatccacta

SEQ ID NO: 657637 - DNA, 25 bp, Homo sapien
agccatccactaatgattcttgcct

SEQ ID NO: 657638 - DNA, 25 bp, Homo sapien
gcctgaaccaatttttactatgctg

SEQ ID NO: 657639 - DNA, 25 bp, Homo sapien
aatttttactatgctgattgccaaa

SEQ ID NO: 657640 - DNA, 25 bp, Homo sapien
tatgctgattgccaaatggtgatct

SEQ ID NO: 657641 - DNA, 25 bp, Homo sapien
gccaaatggtgatctaactccttca

SEQ ID NO: 657642 - DNA, 25 bp, Homo sapien
aatggtgatctaactccttcattct

SEQ ID NO: 657643 - DNA, 25 bp, Homo sapien
cccttctccttctttatttatatca

SEQ ID NO: 657644 - DNA, 25 bp, Homo sapien
ctccggactccgctttggaatggct

SEQ ID NO: 657645 - DNA, 25 bp, Homo sapien
cggactccgctttggaatggctcaa

SEQ ID NO: 657646 - DNA, 25 bp, Homo sapien
ggactccgctttggaatggctcaaa

SEQ ID NO: 657647 - DNA, 25 bp, Homo sapien
gactccgctttggaatggctcaaac

SEQ ID NO: 657648 - DNA, 25 bp, Homo sapien
actccgctttggaatggctcaaacc

SEQ ID NO: 657649 - DNA, 25 bp, Homo sapien
tccgctttggaatggctcaaaccac

SEQ ID NO: 657650 - DNA, 25 bp, Homo sapien
gctttggaatggctcaaaccactcc

SEQ ID NO: 657651 - DNA, 25 bp, Homo sapien
tttggaatggctcaaaccactccat

SEQ ID NO: 657652 - DNA, 25 bp, Homo sapien
tggaatggctcaaaccactccattg

SEQ ID NO: 657653 - DNA, 25 bp, Homo sapien
gaatggctcaaaccactccattgag

SEQ ID NO: 657654 - DNA, 25 bp, Homo sapien
tggctcaaaccactccattgagacc

SEQ ID NO: 657655 - DNA, 25 bp, Homo sapien
ggatctatgtttcttccacctacca

SEQ ID NO: 657656 - DNA, 25 bp, Homo sapien
gatctatgtttcttccacctaccac

SEQ ID NO: 657657 - DNA, 25 bp, Homo sapien
ttccacctaccaccgtggctggtgc

SEQ ID NO: 657658 - DNA, 25 bp, Homo sapien
cgtgcagaagtatcaccaatgtatg

SEQ ID NO: 657659 - DNA, 25 bp, Homo sapien
gtatcaccaatgtatggagttcaaa

SEQ ID NO: 657660 - DNA, 25 bp, Homo sapien
accaatgtatggagttcaaaaatat

SEQ ID NO: 657661 - DNA, 25 bp, Homo sapien
atatgatcccattaactcgatgctg

SEQ ID NO: 657662 - DNA, 25 bp, Homo sapien
atgatcccattaactcgatgctgag

SEQ ID NO: 657663 - DNA, 25 bp, Homo sapien
gatcccattaactcgatgctgagta

SEQ ID NO: 657664 - DNA, 25 bp, Homo sapien
ctcgatgctgagtatctacatggat

SEQ ID NO: 657665 - DNA, 25 bp, Homo sapien
gatgctgagtatctacatggataca

SEQ ID NO: 657666 - DNA, 25 bp, Homo sapien
actctcgaggagagccgactatgaa

SEQ ID NO: 657667 - DNA, 25 bp, Homo sapien
ccccgagtgcagatgttgctgctaa

SEQ ID NO: 657668 - DNA, 25 bp, Homo sapien
ttgctgctaacgttcagccctgacg

SEQ ID NO: 657669 - DNA, 25 bp, Homo sapien
agccctgacgccatgtccaatagga

SEQ ID NO: 657670 - DNA, 25 bp, Homo sapien
atgtccaataggaacggcccttcac

SEQ ID NO: 657671 - DNA, 25 bp, Homo sapien
ttcactctcagaaacgcgggccgga

SEQ ID NO: 657672 - DNA, 25 bp, Homo sapien
gaaaccgtggaggtcttttgcacct

SEQ ID NO: 657673 - DNA, 25 bp, Homo sapien
aggtcttttgcaccttgccgtttgc

SEQ ID NO: 657674 - DNA, 25 bp, Homo sapien
ctcccaggttcaacatgataggatg

SEQ ID NO: 657675 - DNA, 25 bp, Homo sapien
atgtggattatcagggcctgggaac

SEQ ID NO: 657676 - DNA, 25 bp, Homo sapien
aacagtgtaaaggaacgcgcaggtc

SEQ ID NO: 657677 - DNA, 25 bp, Homo sapien
gattctcaacacaatatgtcactag

SEQ ID NO: 657678 - DNA, 25 bp, Homo sapien
atatgtcactagaaaattgcaaatt

SEQ ID NO: 657679 - DNA, 25 bp, Homo sapien
caagataccagtatacacttattag

SEQ ID NO: 657680 - DNA, 25 bp, Homo sapien
atgagctaaaatccaaaatactaag

SEQ ID NO: 657681 - DNA, 25 bp, Homo sapien
aaaatactaagaacagcaaatgctg

SEQ ID NO: 657682 - DNA, 25 bp, Homo sapien
cagcaaatgctgatgaggttgtgga

SEQ ID NO: 657683 - DNA, 25 bp, Homo sapien
gcaaaatgatgcagccacttggaag

SEQ ID NO: 657684 - DNA, 25 bp, Homo sapien
tgcagccacttggaagacagtctgg

SEQ ID NO: 657685 - DNA, 25 bp, Homo sapien
gaacaacctgattaaaatatgggca

SEQ ID NO: 657686 - DNA, 25 bp, Homo sapien
aagagctgaatggaaacctccccaa

SEQ ID NO: 657687 - DNA, 25 bp, Homo sapien
ctgaatggaaacctccccaaagaat

SEQ ID NO: 657688 - DNA, 25 bp, Homo sapien
aatcatttggcatacagataaaagg

SEQ ID NO: 657689 - DNA, 25 bp, Homo sapien
gaagcattattttagtttatatcac

SEQ ID NO: 657690 - DNA, 25 bp, Homo sapien
atatcactgtattagtaaatgttac

SEQ ID NO: 657691 - DNA, 25 bp, Homo sapien
atgttacattatatagtttatccta

SEQ ID NO: 657692 - DNA, 25 bp, Homo sapien
ttgacttttccctatttagcaaatg

SEQ ID NO: 657693 - DNA, 25 bp, Homo sapien
gacttttccctatttagcaaatgac

SEQ ID NO: 657694 - DNA, 25 bp, Homo sapien
cttttccctatttagcaaatgacac

SEQ ID NO: 657695 - DNA, 25 bp, Homo sapien
ttagcaaatgacacacactttcttg

SEQ ID NO: 657696 - DNA, 25 bp, Homo sapien
gcaaatgacacacactttcttgtat

SEQ ID NO: 657697 - DNA, 25 bp, Homo sapien
atgacacacactttcttgtatttga

SEQ ID NO: 657698 - DNA, 25 bp, Homo sapien
tgacacacactttcttgtatttgaa

SEQ ID NO: 657699 - DNA, 25 bp, Homo sapien
tcctcaagtactttactcggagcct

SEQ ID NO: 657700 - DNA, 25 bp, Homo sapien
ctcaagtactttactcggagccttg

SEQ ID NO: 657701 - DNA, 25 bp, Homo sapien
caagtactttactcggagccttgag

SEQ ID NO: 657702 - DNA, 25 bp, Homo sapien
aagtactttactcggagccttgagg

SEQ ID NO: 657703 - DNA, 25 bp, Homo sapien
gttctggaagtttcgggagctgaca

SEQ ID NO: 657704 - DNA, 25 bp, Homo sapien
ggagctgacagcagacactggtctc

SEQ ID NO: 657705 - DNA, 25 bp, Homo sapien
ggcctgggcggtgtgccgagctcct

SEQ ID NO: 657706 - DNA, 25 bp, Homo sapien
gcggtgtgccgagctcctgaaggag

SEQ ID NO: 657707 - DNA, 25 bp, Homo sapien
gatttaatggagttcctgcctcaga

SEQ ID NO: 657708 - DNA, 25 bp, Homo sapien
tgcctcagaccacaaggttcggagc

SEQ ID NO: 657709 - DNA, 25 bp, Homo sapien
acctgcacctgctctgaataaactg

SEQ ID NO: 657710 - DNA, 25 bp, Homo sapien
atgggatctgatcacatgttactgt

SEQ ID NO: 657711 - DNA, 25 bp, Homo sapien
atgttactgtcgaaagccctttgca

SEQ ID NO: 657712 - DNA, 25 bp, Homo sapien
ttactgtcgaaagccctttgcaggg

SEQ ID NO: 657713 - DNA, 25 bp, Homo sapien
gaaagccctttgcagggcggcccat

SEQ ID NO: 657714 - DNA, 25 bp, Homo sapien
ggcggcccatgattgagtgcagcct

SEQ ID NO: 657715 - DNA, 25 bp, Homo sapien
gcccatgattgagtgcagcctgtgt

SEQ ID NO: 657716 - DNA, 25 bp, Homo sapien
cagcctgtgtgggacgtggatccac

SEQ ID NO: 657717 - DNA, 25 bp, Homo sapien
ctgtgtgggacgtggatccacctct

SEQ ID NO: 657718 - DNA, 25 bp, Homo sapien
gctaagattaagaagaccaacgtcc

SEQ ID NO: 657719 - DNA, 25 bp, Homo sapien
tccccgacttcttttattgccagaa

SEQ ID NO: 657720 - DNA, 25 bp, Homo sapien
cgacttcttttattgccagaaatgc

SEQ ID NO: 657721 - DNA, 25 bp, Homo sapien
gctagttatttttgacaatgactac

SEQ ID NO: 657722 - DNA, 25 bp, Homo sapien
gacaatgactactaaaatgcaagtt

SEQ ID NO: 657723 - DNA, 25 bp, Homo sapien
aaatgcaagtttcttcaagggcaga

SEQ ID NO: 657724 - DNA, 25 bp, Homo sapien
tcttcaagggcagattcaccttagt

SEQ ID NO: 657725 - DNA, 25 bp, Homo sapien
tctttatacccctcaaaaacctcag

SEQ ID NO: 657726 - DNA, 25 bp, Homo sapien
tcaaaaacctcagggttattctcaa

SEQ ID NO: 657727 - DNA, 25 bp, Homo sapien
agtattgagtaggtgagtgaacttt

SEQ ID NO: 657728 - DNA, 25 bp, Homo sapien
agtgaactttggatgtatactcctt

SEQ ID NO: 657729 - DNA, 25 bp, Homo sapien
gaactttggatgtatactccttgaa

SEQ ID NO: 657730 - DNA, 25 bp, Homo sapien
tggatgtatactccttgaaattata

SEQ ID NO: 657731 - DNA, 25 bp, Homo sapien
aatgtatgtcatgagtctaaagaaa

SEQ ID NO: 657732 - DNA, 25 bp, Homo sapien
aaaaaatcctaccacatgtgctcca

SEQ ID NO: 657733 - DNA, 25 bp, Homo sapien
cacatgtgctccaccaagctctgtc

SEQ ID NO: 657734 - DNA, 25 bp, Homo sapien
aagctctgtctccaaggtggccttg

SEQ ID NO: 657735 - DNA, 25 bp, Homo sapien
caaggtggccttggaagccacatgg

SEQ ID NO: 657736 - DNA, 25 bp, Homo sapien
aaggtggcagagactctaggagcct

SEQ ID NO: 657737 - DNA, 25 bp, Homo sapien
cagagactctaggagcctgagcaga

SEQ ID NO: 657738 - DNA, 25 bp, Homo sapien
gagcctgagcagaaatccagatgat

SEQ ID NO: 657739 - DNA, 25 bp, Homo sapien
gcctgagcagaaatccagatgatta

SEQ ID NO: 657740 - DNA, 25 bp, Homo sapien
atccttattcacctgggaccaccgt

SEQ ID NO: 657741 - DNA, 25 bp, Homo sapien
ttattcacctgggaccaccgtgaac

SEQ ID NO: 657742 - DNA, 25 bp, Homo sapien
ttcacctgggaccaccgtgaactat

SEQ ID NO: 657743 - DNA, 25 bp, Homo sapien
gttaggtcccgcaacacgagacgga

SEQ ID NO: 657744 - DNA, 25 bp, Homo sapien
caacacgagacggagaccagcttga

SEQ ID NO: 657745 - DNA, 25 bp, Homo sapien
agacggagaccagcttgagaaagaa

SEQ ID NO: 657746 - DNA, 25 bp, Homo sapien
tgctccaagagttaggattttaaca

SEQ ID NO: 657747 - DNA, 25 bp, Homo sapien
ataaaatgcctgacttggaccgatc

SEQ ID NO: 657748 - DNA, 25 bp, Homo sapien
atgcctgacttggaccgatcaacag

SEQ ID NO: 657749 - DNA, 25 bp, Homo sapien
gacttggaccgatcaacagaagaca

SEQ ID NO: 657750 - DNA, 25 bp, Homo sapien
gattaaggcccattcaagtctgaga

SEQ ID NO: 657751 - DNA, 25 bp, Homo sapien
gcccattcaagtctgagagccttct

SEQ ID NO: 657752 - DNA, 25 bp, Homo sapien
aagtctgagagccttctgacagctg

SEQ ID NO: 657753 - DNA, 25 bp, Homo sapien
gccttctgacagctgccattgagtt

SEQ ID NO: 657754 - DNA, 25 bp, Homo sapien
catgttattcactgtgtggtgcata

SEQ ID NO: 657755 - DNA, 25 bp, Homo sapien
aaattgtgtttatatttggatgcaa

SEQ ID NO: 657756 - DNA, 25 bp, Homo sapien
attgtgtttatatttggatgcaaat

SEQ ID NO: 657757 - DNA, 25 bp, Homo sapien
tttggatgcaaattaattgtgtact

SEQ ID NO: 657758 - DNA, 25 bp, Homo sapien
ttgtgtactttatagaacagtttcc

SEQ ID NO: 657759 - DNA, 25 bp, Homo sapien
agcatttagggatatgtaaaccaga

SEQ ID NO: 657760 - DNA, 25 bp, Homo sapien
gcatttagggatatgtaaaccagat

SEQ ID NO: 657761 - DNA, 25 bp, Homo sapien
ttagggatatgtaaaccagatgtta

SEQ ID NO: 657762 - DNA, 25 bp, Homo sapien
gggatatgtaaaccagatgttatta

SEQ ID NO: 657763 - DNA, 25 bp, Homo sapien
tatgtaaaccagatgttattaggac

SEQ ID NO: 657764 - DNA, 25 bp, Homo sapien
tgtaaaccagatgttattaggacta

SEQ ID NO: 657765 - DNA, 25 bp, Homo sapien
ggtggcaggcacctgcaatcagcta

SEQ ID NO: 657766 - DNA, 25 bp, Homo sapien
aataaagtttcttttactctcatct

SEQ ID NO: 657767 - DNA, 25 bp, Homo sapien
aattccagacatttaagcttctcct

SEQ ID NO: 657768 - DNA, 25 bp, Homo sapien
ttccagacatttaagcttctccttt

SEQ ID NO: 657769 - DNA, 25 bp, Homo sapien
ccagacatttaagcttctcctttta

SEQ ID NO: 657770 - DNA, 25 bp, Homo sapien
catttaagcttctccttttagctgt

SEQ ID NO: 657771 - DNA, 25 bp, Homo sapien
taagcttctccttttagctgtttct

SEQ ID NO: 657772 - DNA, 25 bp, Homo sapien
ttctccttttagctgtttctgtttg

SEQ ID NO: 657773 - DNA, 25 bp, Homo sapien
gtttctgtttgcttcctcagaggaa

SEQ ID NO: 657774 - DNA, 25 bp, Homo sapien
ttctgtttgcttcctcagaggaatt

SEQ ID NO: 657775 - DNA, 25 bp, Homo sapien
gtttgcttcctcagaggaatttaac

SEQ ID NO: 657776 - DNA, 25 bp, Homo sapien
aggtaggtataactatccccactct

SEQ ID NO: 657777 - DNA, 25 bp, Homo sapien
actatccccactctgcagatgcaga

SEQ ID NO: 657778 - DNA, 25 bp, Homo sapien
aacggaggcacagagtgttttggta

SEQ ID NO: 657779 - DNA, 25 bp, Homo sapien
ggtagctaaacaagctcaccaggag

SEQ ID NO: 657780 - DNA, 25 bp, Homo sapien
aggaggctagaaggtggccacacct

SEQ ID NO: 657781 - DNA, 25 bp, Homo sapien
ctccctttgctgtgttgcatgcaag

SEQ ID NO: 657782 - DNA, 25 bp, Homo sapien
catgcaagaatgtgactccaagttt

SEQ ID NO: 657783 - DNA, 25 bp, Homo sapien
tgagtgtttaccatgcaccaagccc

SEQ ID NO: 657784 - DNA, 25 bp, Homo sapien
tgggctaaacacttcatctgcaggc

SEQ ID NO: 657785 - DNA, 25 bp, Homo sapien
atctgcaggctgttcgtctttacgg

SEQ ID NO: 657786 - DNA, 25 bp, Homo sapien
tcgtctttacggcaaacccagtagg

SEQ ID NO: 657787 - DNA, 25 bp, Homo sapien
gtataatggtaacctgagcctgcat

SEQ ID NO: 657788 - DNA, 25 bp, Homo sapien
aacctgagcctgcatgttattcact

SEQ ID NO: 657789 - DNA, 25 bp, Homo sapien
catgttattcactgtgtggtgcata

SEQ ID NO: 657790 - DNA, 25 bp, Homo sapien
ttcactgtgtggtgcatactgatct

SEQ ID NO: 657791 - DNA, 25 bp, Homo sapien
ggtgcatactgatctttaattttaa

SEQ ID NO: 657792 - DNA, 25 bp, Homo sapien
aaattgtgtttatatttggatgcaa

SEQ ID NO: 657793 - DNA, 25 bp, Homo sapien
tttggatgcaaattaattgtgtact

SEQ ID NO: 657794 - DNA, 25 bp, Homo sapien
ttgtgtactttatagaacagtttcc

SEQ ID NO: 657795 - DNA, 25 bp, Homo sapien
agcatttagggatatgtaaaccaga

SEQ ID NO: 657796 - DNA, 25 bp, Homo sapien
ttagggatatgtaaaccagatgtta

SEQ ID NO: 657797 - DNA, 25 bp, Homo sapien
tgtaaaccagatgttattaggacta

SEQ ID NO: 657798 - DNA, 25 bp, Homo sapien
gtttgattaatattactctcagcga

SEQ ID NO: 657799 - DNA, 25 bp, Homo sapien
atattactctcagcgatgagtactg

SEQ ID NO: 657800 - DNA, 25 bp, Homo sapien
tgagtactgagaagaaagccatatc

SEQ ID NO: 657801 - DNA, 25 bp, Homo sapien
aagccatatcagtagcataaagcaa

SEQ ID NO: 657802 - DNA, 25 bp, Homo sapien
aagcaagcagcaaaggctctgtgga

SEQ ID NO: 657803 - DNA, 25 bp, Homo sapien
ggatctgttgcagtaaagatggcac

SEQ ID NO: 657804 - DNA, 25 bp, Homo sapien
cagtaaagatggcacattcccagtt

SEQ ID NO: 657805 - DNA, 25 bp, Homo sapien
gcacattcccagttgctgcagtaga

SEQ ID NO: 657806 - DNA, 25 bp, Homo sapien
ttcccagttgctgcagtagaggcct

SEQ ID NO: 657807 - DNA, 25 bp, Homo sapien
tgctgcagtagaggcctggccaaca

SEQ ID NO: 657808 - DNA, 25 bp, Homo sapien
agttatctggaaattgcttgaatct

SEQ ID NO: 657809 - DNA, 25 bp, Homo sapien
ctggagtatatacaaagagcatctt

SEQ ID NO: 657810 - DNA, 25 bp, Homo sapien
gagcatcttgttctacttagctgga

SEQ ID NO: 657811 - DNA, 25 bp, Homo sapien
cttagctggagcattaggttcatga

SEQ ID NO: 657812 - DNA, 25 bp, Homo sapien
ggagaggatagttcctgttaggaat

SEQ ID NO: 657813 - DNA, 25 bp, Homo sapien
agtgatgtaatctggccaaaatttt

SEQ ID NO: 657814 - DNA, 25 bp, Homo sapien
gcgatagagctggtgttagacccca

SEQ ID NO: 657815 - DNA, 25 bp, Homo sapien
agagctggtgttagaccccaggtct

SEQ ID NO: 657816 - DNA, 25 bp, Homo sapien
agaccccaggtctttgtggttccag

SEQ ID NO: 657817 - DNA, 25 bp, Homo sapien
gtttcctgctccaggctcaggcctt

SEQ ID NO: 657818 - DNA, 25 bp, Homo sapien
gccttggtggaaggatgccattttc

SEQ ID NO: 657819 - DNA, 25 bp, Homo sapien
gccattttccatcagcttgtatgga

SEQ ID NO: 657820 - DNA, 25 bp, Homo sapien
aggtgcaggctccagctcaatggcc

SEQ ID NO: 657821 - DNA, 25 bp, Homo sapien
agctcaatggcctgtcattacaaga

SEQ ID NO: 657822 - DNA, 25 bp, Homo sapien
ggcctgtcattacaagaggctcttg

SEQ ID NO: 657823 - DNA, 25 bp, Homo sapien
gaggctcttggagtttctgatcttc

SEQ ID NO: 657824 - DNA, 25 bp, Homo sapien
tcttggagtttctgatcttcttcgc

SEQ ID NO: 657825 - DNA, 25 bp, Homo sapien
tctgatcttcttcgcctctctctat

SEQ ID NO: 657826 - DNA, 25 bp, Homo sapien
tatgcccaaccctgtctagagtgca

SEQ ID NO: 657827 - DNA, 25 bp, Homo sapien
gtctagagtgcacctcagcatgatt

SEQ ID NO: 657828 - DNA, 25 bp, Homo sapien
gtgcacctcagcatgattttagaaa

SEQ ID NO: 657829 - DNA, 25 bp, Homo sapien
tcctccgatcaccaagtatctatta

SEQ ID NO: 657830 - DNA, 25 bp, Homo sapien
gtatctattaaaagccattccctcc

SEQ ID NO: 657831 - DNA, 25 bp, Homo sapien
caaaagtatataaatgatctgggca

SEQ ID NO: 657832 - DNA, 25 bp, Homo sapien
gtatataaatgatctgggcatggtg

SEQ ID NO: 657833 - DNA, 25 bp, Homo sapien
gctcctcagggcttaggcgagatcg

SEQ ID NO: 657834 - DNA, 25 bp, Homo sapien
ctcctcagggcttaggcgagatcgc

SEQ ID NO: 657835 - DNA, 25 bp, Homo sapien
tcctcagggcttaggcgagatcgct

SEQ ID NO: 657836 - DNA, 25 bp, Homo sapien
cctcagggcttaggcgagatcgctt

SEQ ID NO: 657837 - DNA, 25 bp, Homo sapien
cagggcttaggcgagatcgcttgat

SEQ ID NO: 657838 - DNA, 25 bp, Homo sapien
agggcttaggcgagatcgcttgatc

SEQ ID NO: 657839 - DNA, 25 bp, Homo sapien
gggcttaggcgagatcgcttgatcc

SEQ ID NO: 657840 - DNA, 25 bp, Homo sapien
ggcttaggcgagatcgcttgatccc

SEQ ID NO: 657841 - DNA, 25 bp, Homo sapien
gcttaggcgagatcgcttgatccca

SEQ ID NO: 657842 - DNA, 25 bp, Homo sapien
gtaattgattcttcttcaacccgga

SEQ ID NO: 657843 - DNA, 25 bp, Homo sapien
attgattcttcttcaacccggaact

SEQ ID NO: 657844 - DNA, 25 bp, Homo sapien
gattcttcttcaacccggaactgaa

SEQ ID NO: 657845 - DNA, 25 bp, Homo sapien
ttcaacccggaactgaaggtcctca

SEQ ID NO: 657846 - DNA, 25 bp, Homo sapien
gaactgaaggtcctcaaccttcctt

SEQ ID NO: 657847 - DNA, 25 bp, Homo sapien
tgaaggtcctcaaccttccttttct

SEQ ID NO: 657848 - DNA, 25 bp, Homo sapien
tgtagccacattctcaggatcttca

SEQ ID NO: 657849 - DNA, 25 bp, Homo sapien
tagccacattctcaggatcttcaga

SEQ ID NO: 657850 - DNA, 25 bp, Homo sapien
ggatcttcagaaatatggctctttt

SEQ ID NO: 657851 - DNA, 25 bp, Homo sapien
cttcagaaatatggctcttttgctc

SEQ ID NO: 657852 - DNA, 25 bp, Homo sapien
cacctttggtaattgattcttcttc

SEQ ID NO: 657853 - DNA, 25 bp, Homo sapien
aaagcaatggcatgattgtacagta

SEQ ID NO: 657854 - DNA, 25 bp, Homo sapien
atgattgtacagtaaaccctgaagt

SEQ ID NO: 657855 - DNA, 25 bp, Homo sapien
tgattgtacagtaaaccctgaagtg

SEQ ID NO: 657856 - DNA, 25 bp, Homo sapien
gattgtacagtaaaccctgaagtga

SEQ ID NO: 657857 - DNA, 25 bp, Homo sapien
attgtacagtaaaccctgaagtgaa

SEQ ID NO: 657858 - DNA, 25 bp, Homo sapien
taaaccctgaagtgaaatataccca

SEQ ID NO: 657859 - DNA, 25 bp, Homo sapien
cattttgataacttacagacatttg

SEQ ID NO: 657860 - DNA, 25 bp, Homo sapien
acagacatttgcaatttatctttct

SEQ ID NO: 657861 - DNA, 25 bp, Homo sapien
cagacatttgcaatttatctttctt

SEQ ID NO: 657862 - DNA, 25 bp, Homo sapien
agacatttgcaatttatctttcttt

SEQ ID NO: 657863 - DNA, 25 bp, Homo sapien
tatctttcttttttcctcaaatggg

SEQ ID NO: 657864 - DNA, 25 bp, Homo sapien
gggttgcagaagcacatatttcact

SEQ ID NO: 657865 - DNA, 25 bp, Homo sapien
atatttcactatggagggccgcctg

SEQ ID NO: 657866 - DNA, 25 bp, Homo sapien
tcgcgctgacaggatcttttgtgac

SEQ ID NO: 657867 - DNA, 25 bp, Homo sapien
cttttgtgacgctgcaaatgtcctg

SEQ ID NO: 657868 - DNA, 25 bp, Homo sapien
aaatgtcctggtcagtgtccttctt

SEQ ID NO: 657869 - DNA, 25 bp, Homo sapien
gtgtccttctttctacaagaggcgt

SEQ ID NO: 657870 - DNA, 25 bp, Homo sapien
ccgggctctgcatagggcgtatata

SEQ ID NO: 657871 - DNA, 25 bp, Homo sapien
gtatatatccctggccgccaaggaa

SEQ ID NO: 657872 - DNA, 25 bp, Homo sapien
gaagctttcatattcactcaataca

SEQ ID NO: 657873 - DNA, 25 bp, Homo sapien
caatacacatttacagagcctctac

SEQ ID NO: 657874 - DNA, 25 bp, Homo sapien
ttcctgtcaggcgtcacacaataaa

SEQ ID NO: 657875 - DNA, 25 bp, Homo sapien
ggagcagattgtgtttacaccttcc

SEQ ID NO: 657876 - DNA, 25 bp, Homo sapien
attgtgtttacaccttccccgcaca

SEQ ID NO: 657877 - DNA, 25 bp, Homo sapien
gggctctctgcgcagtctgcacatt

SEQ ID NO: 657878 - DNA, 25 bp, Homo sapien
agtctgcacatttgcagctcctgct

SEQ ID NO: 657879 - DNA, 25 bp, Homo sapien
tcctgctgcagaaagttacctctct

SEQ ID NO: 657880 - DNA, 25 bp, Homo sapien
gaaagttacctctctcagcctagag

SEQ ID NO: 657881 - DNA, 25 bp, Homo sapien
tcagcctagagctccccacagaagg

SEQ ID NO: 657882 - DNA, 25 bp, Homo sapien
agctccccacagaaggctcctggga

SEQ ID NO: 657883 - DNA, 25 bp, Homo sapien
gctcccatcacagggcttagtgtga

SEQ ID NO: 657884 - DNA, 25 bp, Homo sapien
cacagggcttagtgtgaagctcagg

SEQ ID NO: 657885 - DNA, 25 bp, Homo sapien
agctcagggcaagggtggaccttta

SEQ ID NO: 657886 - DNA, 25 bp, Homo sapien
tggtgtcaacccattctcaagatgg

SEQ ID NO: 657887 - DNA, 25 bp, Homo sapien
tctcaagatgggacaataactcaag

SEQ ID NO: 657888 - DNA, 25 bp, Homo sapien
aagtcatcaaaacaagccacgtaga

SEQ ID NO: 657889 - DNA, 25 bp, Homo sapien
aaacaagccacgtagaccagcacca

SEQ ID NO: 657890 - DNA, 25 bp, Homo sapien
aaccctagcattttgcccaagaatt

SEQ ID NO: 657891 - DNA, 25 bp, Homo sapien
agcagtttcattaaggcaggagcct

SEQ ID NO: 657892 - DNA, 25 bp, Homo sapien
taaggcaggagcctgaaccacttcc

SEQ ID NO: 657893 - DNA, 25 bp, Homo sapien
cacttccccactgttagctttggaa

SEQ ID NO: 657894 - DNA, 25 bp, Homo sapien
ggcagcagctaatttacaacctggt

SEQ ID NO: 657895 - DNA, 25 bp, Homo sapien
ttacaacctggtcaagcctgagatg

SEQ ID NO: 657896 - DNA, 25 bp, Homo sapien
gtcaagcctgagatggtgtcaaccc

SEQ ID NO: 657897 - DNA, 25 bp, Homo sapien
agttgctgacagtgatggctggtgt

SEQ ID NO: 657898 - DNA, 25 bp, Homo sapien
gctggtgtggccacgccttgactac

SEQ ID NO: 657899 - DNA, 25 bp, Homo sapien
gtgtggccacgccttgactactgta

SEQ ID NO: 657900 - DNA, 25 bp, Homo sapien
gtggccacgccttgactactgtaca

SEQ ID NO: 657901 - DNA, 25 bp, Homo sapien
acgccttgactactgtacacatcaa

SEQ ID NO: 657902 - DNA, 25 bp, Homo sapien
gactactgtacacatcaagcagatt

SEQ ID NO: 657903 - DNA, 25 bp, Homo sapien
tgtacacatcaagcagattccctga

SEQ ID NO: 657904 - DNA, 25 bp, Homo sapien
tacacatcaagcagattccctgaca

SEQ ID NO: 657905 - DNA, 25 bp, Homo sapien
acatcaagcagattccctgacacag

SEQ ID NO: 657906 - DNA, 25 bp, Homo sapien
atcaagcagattccctgacacaggc

SEQ ID NO: 657907 - DNA, 25 bp, Homo sapien
caagcagattccctgacacaggcag

SEQ ID NO: 657908 - DNA, 25 bp, Homo sapien
tggttccctgtgagcaagatgatct

SEQ ID NO: 657909 - DNA, 25 bp, Homo sapien
gatgatctgcaagtggcgacatgaa

SEQ ID NO: 657910 - DNA, 25 bp, Homo sapien
ggcgacatgaactgattaccaatca

SEQ ID NO: 657911 - DNA, 25 bp, Homo sapien
cactgacttcaggaggaagcaagtt

SEQ ID NO: 657912 - DNA, 25 bp, Homo sapien
aagatcaaggcaggcgccagcagac

SEQ ID NO: 657913 - DNA, 25 bp, Homo sapien
aggcgccagcagactctgggtctga

SEQ ID NO: 657914 - DNA, 25 bp, Homo sapien
gactctgggtctgacaagggaatga

SEQ ID NO: 657915 - DNA, 25 bp, Homo sapien
aatgaagctgttagaccaaattttc

SEQ ID NO: 657916 - DNA, 25 bp, Homo sapien
gaccaaattttcagcttctcacatg

SEQ ID NO: 657917 - DNA, 25 bp, Homo sapien
gcttctcacatggtacaattattgt

SEQ ID NO: 657918 - DNA, 25 bp, Homo sapien
aagcaagttcttaagtcacattgag

SEQ ID NO: 657919 - DNA, 25 bp, Homo sapien
tttaccccttacattgtgtaatttg

SEQ ID NO: 657920 - DNA, 25 bp, Homo sapien
gtccttgattggcatcttcattcgg

SEQ ID NO: 657921 - DNA, 25 bp, Homo sapien
gattggcatcttcattcggatgatg

SEQ ID NO: 657922 - DNA, 25 bp, Homo sapien
ttcattcggatgatggagagccttt

SEQ ID NO: 657923 - DNA, 25 bp, Homo sapien
gagcctttgtggtagtgtttgctta

SEQ ID NO: 657924 - DNA, 25 bp, Homo sapien
tgtggtagtgtttgcttatgtgaac

SEQ ID NO: 657925 - DNA, 25 bp, Homo sapien
gcttatgtgaacagcaggcctttca

SEQ ID NO: 657926 - DNA, 25 bp, Homo sapien
tatgtgaacagcaggcctttcagat

SEQ ID NO: 657927 - DNA, 25 bp, Homo sapien
caggcctttcagataagagaagtgg

SEQ ID NO: 657928 - DNA, 25 bp, Homo sapien
agagaagtggcttttccttggtgat

SEQ ID NO: 657929 - DNA, 25 bp, Homo sapien
tttttggccatcatgaggatctaac

SEQ ID NO: 657930 - DNA, 25 bp, Homo sapien
gtattatctttcatatggctctaag

SEQ ID NO: 657931 - DNA, 25 bp, Homo sapien
atggctctaagttgttttggaaatc

SEQ ID NO: 657932 - DNA, 25 bp, Homo sapien
aggtggcagacctcatgtttgtttc

SEQ ID NO: 657933 - DNA, 25 bp, Homo sapien
gaaatgttttaacggatgacagtga

SEQ ID NO: 657934 - DNA, 25 bp, Homo sapien
ctctctttagcgattgttacaatag

SEQ ID NO: 657935 - DNA, 25 bp, Homo sapien
ctctctttagcagttgttacagtat

SEQ ID NO: 657936 - DNA, 25 bp, Homo sapien
gtatatactataattcctcttttta

SEQ ID NO: 657937 - DNA, 25 bp, Homo sapien
ttcctctttttagcgattgttatct

SEQ ID NO: 657938 - DNA, 25 bp, Homo sapien
gcgattgttatctagctgttctaaa

SEQ ID NO: 657939 - DNA, 25 bp, Homo sapien
tctagctgttctaaacctgtgtttt

SEQ ID NO: 657940 - DNA, 25 bp, Homo sapien
cctgtgttttacgaatttgattact

SEQ ID NO: 657941 - DNA, 25 bp, Homo sapien
ttttcggaggcttgtcattgattaa

SEQ ID NO: 657942 - DNA, 25 bp, Homo sapien
cggaggcttgtcattgattaacttt

SEQ ID NO: 657943 - DNA, 25 bp, Homo sapien
atagtactgtaggatgattatagct

SEQ ID NO: 657944 - DNA, 25 bp, Homo sapien
gaaaacatcgaacattcccaacata

SEQ ID NO: 657945 - DNA, 25 bp, Homo sapien
aacatcgaacattcccaacataaag

SEQ ID NO: 657946 - DNA, 25 bp, Homo sapien
gctaattaattaccctgttctgatc

SEQ ID NO: 657947 - DNA, 25 bp, Homo sapien
aattaattaccctgttctgatcact

SEQ ID NO: 657948 - DNA, 25 bp, Homo sapien
ctgttctgatcactctgcattacat

SEQ ID NO: 657949 - DNA, 25 bp, Homo sapien
gatcactctgcattacatgtattga

SEQ ID NO: 657950 - DNA, 25 bp, Homo sapien
attgaaacatcactacataccccag

SEQ ID NO: 657951 - DNA, 25 bp, Homo sapien
acatcactacataccccaggaatat

SEQ ID NO: 657952 - DNA, 25 bp, Homo sapien
aggacctgctctgtttatgtccagg

SEQ ID NO: 657953 - DNA, 25 bp, Homo sapien
ttatgtccaggtatgttcagtgttc

SEQ ID NO: 657954 - DNA, 25 bp, Homo sapien
taatgctccatgtacgaacctttgc

SEQ ID NO: 657955 - DNA, 25 bp, Homo sapien
aaccgatggatgagttcttacctct

SEQ ID NO: 657956 - DNA, 25 bp, Homo sapien
tcttacctcttttttcgtccagaca

SEQ ID NO: 657957 - DNA, 25 bp, Homo sapien
tttcgtccagacaaactgtcctaag

SEQ ID NO: 657958 - DNA, 25 bp, Homo sapien
gataccgagtaatcagctgccagct

SEQ ID NO: 657959 - DNA, 25 bp, Homo sapien
agctcagtagcgcatcttcagattg

SEQ ID NO: 657960 - DNA, 25 bp, Homo sapien
tagcgcatcttcagattgactctcc

SEQ ID NO: 657961 - DNA, 25 bp, Homo sapien
atattcttcatcttgttccctggga

SEQ ID NO: 657962 - DNA, 25 bp, Homo sapien
tccctgggatctttctccctaataa

SEQ ID NO: 657963 - DNA, 25 bp, Homo sapien
caaggttttggatagcaattgctgc

SEQ ID NO: 657964 - DNA, 25 bp, Homo sapien
gctgcatatttagcttgtgtcttat

SEQ ID NO: 657965 - DNA, 25 bp, Homo sapien
gcttgtgtcttatttgctgtgtttt

SEQ ID NO: 657966 - DNA, 25 bp, Homo sapien
gtcttatttgctgtgtttttcaaca

SEQ ID NO: 657967 - DNA, 25 bp, Homo sapien
tttcaacattttcctatctccagca

SEQ ID NO: 657968 - DNA, 25 bp, Homo sapien
attttcctatctccagcaaactgac

SEQ ID NO: 657969 - DNA, 25 bp, Homo sapien
agcaaactgacctgcccctattgta

SEQ ID NO: 657970 - DNA, 25 bp, Homo sapien
gcccctattgtaagtcaattaataa

SEQ ID NO: 657971 - DNA, 25 bp, Homo sapien
ggacaaaacagcattaaactcatca

SEQ ID NO: 657972 - DNA, 25 bp, Homo sapien
aactcatcagttgcaaagattgcct

SEQ ID NO: 657973 - DNA, 25 bp, Homo sapien
aagattgcctataaaaggaccttag

SEQ ID NO: 657974 - DNA, 25 bp, Homo sapien
gagaacatactctatggttttatgt

SEQ ID NO: 657975 - DNA, 25 bp, Homo sapien
gaagtgagaatcatggttaccctga

SEQ ID NO: 657976 - DNA, 25 bp, Homo sapien
agaatcatggttaccctgaagcagg

SEQ ID NO: 657977 - DNA, 25 bp, Homo sapien
ggatttctagggtcccaaaatgtct

SEQ ID NO: 657978 - DNA, 25 bp, Homo sapien
ttctagggtcccaaaatgtctgttt

SEQ ID NO: 657979 - DNA, 25 bp, Homo sapien
aaaatgtctgtttcttagtctgtga

SEQ ID NO: 657980 - DNA, 25 bp, Homo sapien
atgtctgtttcttagtctgtgaggt

SEQ ID NO: 657981 - DNA, 25 bp, Homo sapien
ctgtttcttagtctgtgaggtggtt

SEQ ID NO: 657982 - DNA, 25 bp, Homo sapien
tgaggtggttacagggagcatttac

SEQ ID NO: 657983 - DNA, 25 bp, Homo sapien
tttatgaaaagtcatccaactgtat

SEQ ID NO: 657984 - DNA, 25 bp, Homo sapien
gtatacttatgataacagttttcta

SEQ ID NO: 657985 - DNA, 25 bp, Homo sapien
taacaacgccaaagaagccaggctc

SEQ ID NO: 657986 - DNA, 25 bp, Homo sapien
tctttctgttcttaaaccgaccact

SEQ ID NO: 657987 - DNA, 25 bp, Homo sapien
taaaccgaccactaactgcctatat

SEQ ID NO: 657988 - DNA, 25 bp, Homo sapien
cactaactgcctatatatctctctt

SEQ ID NO: 657989 - DNA, 25 bp, Homo sapien
atatctctctttttattggtttctt

SEQ ID NO: 657990 - DNA, 25 bp, Homo sapien
tatatacatgagagttagggtctgt

SEQ ID NO: 657991 - DNA, 25 bp, Homo sapien
ttagggtctgtaacagatgcgttga

SEQ ID NO: 657992 - DNA, 25 bp, Homo sapien
ctataaatgtgggttctgggagaaa

SEQ ID NO: 657993 - DNA, 25 bp, Homo sapien
aaatgtatacatgagggccagttat

SEQ ID NO: 657994 - DNA, 25 bp, Homo sapien
atgagggccagttatgacaaggtaa

SEQ ID NO: 657995 - DNA, 25 bp, Homo sapien
aatatcaatgttgtctgtcacaggg

SEQ ID NO: 657996 - DNA, 25 bp, Homo sapien
tgggagacaatttcacatggacttt

SEQ ID NO: 657997 - DNA, 25 bp, Homo sapien
gagacaatttcacatggactttgga

SEQ ID NO: 657998 - DNA, 25 bp, Homo sapien
acaatttcacatggactttggaaaa

SEQ ID NO: 657999 - DNA, 25 bp, Homo sapien
ttcctttgcattcatctctcaaact

SEQ ID NO: 658000 - DNA, 25 bp, Homo sapien
tcctttgcattcatctctcaaactt

SEQ ID NO: 658001 - DNA, 25 bp, Homo sapien
tgcattcatctctcaaacttagttt

SEQ ID NO: 658002 - DNA, 25 bp, Homo sapien
cattcatctctcaaacttagttttt

SEQ ID NO: 658003 - DNA, 25 bp, Homo sapien
atctctcaaacttagtttttatctt

SEQ ID NO: 658004 - DNA, 25 bp, Homo sapien
tttttatctttgaccaaccgaacat

SEQ ID NO: 658005 - DNA, 25 bp, Homo sapien
atctttgaccaaccgaacatgacca

SEQ ID NO: 658006 - DNA, 25 bp, Homo sapien
tgaccaaccgaacatgaccaaaaac

SEQ ID NO: 658007 - DNA, 25 bp, Homo sapien
ctgggcatggtgacgctatgatgta

SEQ ID NO: 658008 - DNA, 25 bp, Homo sapien
catggtgacgctatgatgtagtccc

SEQ ID NO: 658009 - DNA, 25 bp, Homo sapien
atggtgacgctatgatgtagtccca

SEQ ID NO: 658010 - DNA, 25 bp, Homo sapien
tggtgacgctatgatgtagtcccag

SEQ ID NO: 658011 - DNA, 25 bp, Homo sapien
ggtgacgctatgatgtagtcccagt

SEQ ID NO: 658012 - DNA, 25 bp, Homo sapien
gtgacgctatgatgtagtcccagtt

SEQ ID NO: 658013 - DNA, 25 bp, Homo sapien
tgacgctatgatgtagtcccagtta

SEQ ID NO: 658014 - DNA, 25 bp, Homo sapien
gacgctatgatgtagtcccagttat

SEQ ID NO: 658015 - DNA, 25 bp, Homo sapien
gctatgatgtagtcccagttatgca

SEQ ID NO: 658016 - DNA, 25 bp, Homo sapien
ctatgatgtagtcccagttatgcag

SEQ ID NO: 658017 - DNA, 25 bp, Homo sapien
gatgtagtcccagttatgcaggagg

SEQ ID NO: 658018 - DNA, 25 bp, Homo sapien
aagaaagttcctcggagtgggtcat

SEQ ID NO: 658019 - DNA, 25 bp, Homo sapien
aagttcctcggagtgggtcatttga

SEQ ID NO: 658020 - DNA, 25 bp, Homo sapien
tcctcggagtgggtcatttgagctg

SEQ ID NO: 658021 - DNA, 25 bp, Homo sapien
ataggagtatgtcaggtgtgcttca

SEQ ID NO: 658022 - DNA, 25 bp, Homo sapien
tatgtcaggtgtgcttcatatcagc

SEQ ID NO: 658023 - DNA, 25 bp, Homo sapien
ggtgtgcttcatatcagcaactaac

SEQ ID NO: 658024 - DNA, 25 bp, Homo sapien
gctgtagttgttaaagtgaccccat

SEQ ID NO: 658025 - DNA, 25 bp, Homo sapien
tagttgttaaagtgaccccatctct

SEQ ID NO: 658026 - DNA, 25 bp, Homo sapien
ctacaaaagttatccacgggtggtg

SEQ ID NO: 658027 - DNA, 25 bp, Homo sapien
agttatccacgggtggtgacacacc

SEQ ID NO: 658028 - DNA, 25 bp, Homo sapien
acgggtggtgacacacccctgtggt

SEQ ID NO: 658029 - DNA, 25 bp, Homo sapien
tgtgctcactccacatcttgcatca

SEQ ID NO: 658030 - DNA, 25 bp, Homo sapien
catcttgcatcagccctgtgaagga

SEQ ID NO: 658031 - DNA, 25 bp, Homo sapien
agaatgtagtggatggtcctgccca

SEQ ID NO: 658032 - DNA, 25 bp, Homo sapien
atggtcctgcccatgactcatgagg

SEQ ID NO: 658033 - DNA, 25 bp, Homo sapien
ctgcccatgactcatgaggtggaac

SEQ ID NO: 658034 - DNA, 25 bp, Homo sapien
gaggtggaacagacccagctcacat

SEQ ID NO: 658035 - DNA, 25 bp, Homo sapien
agctcacatctcatctatctggatt

SEQ ID NO: 658036 - DNA, 25 bp, Homo sapien
tcatctatctggattggctcccata

SEQ ID NO: 658037 - DNA, 25 bp, Homo sapien
atctggattggctcccatacaataa

SEQ ID NO: 658038 - DNA, 25 bp, Homo sapien
ggattggctcccatacaataaaaat

SEQ ID NO: 658039 - DNA, 25 bp, Homo sapien
taaaaatctttcttccgttgagttg

SEQ ID NO: 658040 - DNA, 25 bp, Homo sapien
actagtgagtggttcctcacctctt

SEQ ID NO: 658041 - DNA, 25 bp, Homo sapien
tcacctcttctctcaaatacaatct

SEQ ID NO: 658042 - DNA, 25 bp, Homo sapien
ggaggtattagtcctctagctccat

SEQ ID NO: 658043 - DNA, 25 bp, Homo sapien
tctagctccataccttactcagtta

SEQ ID NO: 658044 - DNA, 25 bp, Homo sapien
ttactcagttactgcagacccctct

SEQ ID NO: 658045 - DNA, 25 bp, Homo sapien
tacctccttcattcactatacatct

SEQ ID NO: 658046 - DNA, 25 bp, Homo sapien
ttttcccgaggatgtgaatctccct

SEQ ID NO: 658047 - DNA, 25 bp, Homo sapien
atctccctcaagaaagatccctggg

SEQ ID NO: 658048 - DNA, 25 bp, Homo sapien
agtggtgtcttactcgtttctgctt

SEQ ID NO: 658049 - DNA, 25 bp, Homo sapien
tcgtttctgcttcctcagtctctgt

SEQ ID NO: 658050 - DNA, 25 bp, Homo sapien
gtctctgtcagataatcagtgctat

SEQ ID NO: 658051 - DNA, 25 bp, Homo sapien
atcacaatatattagaggattctgg

SEQ ID NO: 658052 - DNA, 25 bp, Homo sapien
ggaatctatctccctacctcaacaa

SEQ ID NO: 658053 - DNA, 25 bp, Homo sapien
cctacctcaacaacaattgcattgg

SEQ ID NO: 658054 - DNA, 25 bp, Homo sapien
cctcaacaacaattgcattggcaga

SEQ ID NO: 658055 - DNA, 25 bp, Homo sapien
actctggagtctattcaactcttgc

SEQ ID NO: 658056 - DNA, 25 bp, Homo sapien
ggagtctattcaactcttgcagctt

SEQ ID NO: 658057 - DNA, 25 bp, Homo sapien
gtctattcaactcttgcagcttcta

SEQ ID NO: 658058 - DNA, 25 bp, Homo sapien
tattcaactcttgcagcttctacag

SEQ ID NO: 658059 - DNA, 25 bp, Homo sapien
tcaactcttgcagcttctacagtag

SEQ ID NO: 658060 - DNA, 25 bp, Homo sapien
aactcttgcagcttctacagtaggg

SEQ ID NO: 658061 - DNA, 25 bp, Homo sapien
gcttctacagtaggggtgtccagtg

SEQ ID NO: 658062 - DNA, 25 bp, Homo sapien
aagactgtatggaaggaggttgcct

SEQ ID NO: 658063 - DNA, 25 bp, Homo sapien
atggaaggaggttgcctggccacac

SEQ ID NO: 658064 - DNA, 25 bp, Homo sapien
ttgtgcaaggcaacacatacatttg

SEQ ID NO: 658065 - DNA, 25 bp, Homo sapien
tttggtctgtgtatatactttggtc

SEQ ID NO: 658066 - DNA, 25 bp, Homo sapien
ggtctgtgtatatactttggtctat

SEQ ID NO: 658067 - DNA, 25 bp, Homo sapien
ctttggtctatgtattctgttattt

SEQ ID NO: 658068 - DNA, 25 bp, Homo sapien
aatgttgatgaccttaaaatatgtt

SEQ ID NO: 658069 - DNA, 25 bp, Homo sapien
gcaaatattgccctaaaatgttcac

SEQ ID NO: 658070 - DNA, 25 bp, Homo sapien
cacaggttccaggataaccagatga

SEQ ID NO: 658071 - DNA, 25 bp, Homo sapien
gttccaggataaccagatgactgag

SEQ ID NO: 658072 - DNA, 25 bp, Homo sapien
atgactgaggaatgttgaagattgc

SEQ ID NO: 658073 - DNA, 25 bp, Homo sapien
gccaggcaggccctcaggcgggaag

SEQ ID NO: 658074 - DNA, 25 bp, Homo sapien
ccaggcaggccctcaggcgggaagg

SEQ ID NO: 658075 - DNA, 25 bp, Homo sapien
ggcaggccctcaggcgggaagggat

SEQ ID NO: 658076 - DNA, 25 bp, Homo sapien
gccctcaggcgggaagggatgcgcg

SEQ ID NO: 658077 - DNA, 25 bp, Homo sapien
tgcgcgcctgcgattccgggacgta

SEQ ID NO: 658078 - DNA, 25 bp, Homo sapien
gcgcgcctgcgattccgggacgtac

SEQ ID NO: 658079 - DNA, 25 bp, Homo sapien
gcgcctgcgattccgggacgtaccg

SEQ ID NO: 658080 - DNA, 25 bp, Homo sapien
tgcgattccgggacgtaccgcgcca

SEQ ID NO: 658081 - DNA, 25 bp, Homo sapien
gcgattccgggacgtaccgcgccag

SEQ ID NO: 658082 - DNA, 25 bp, Homo sapien
cgattccgggacgtaccgcgccagc

SEQ ID NO: 658083 - DNA, 25 bp, Homo sapien
gagtcacggccaggcaggccctcag

SEQ ID NO: 658084 - DNA, 25 bp, Homo sapien
catattttgaacagtccagaaaggc

SEQ ID NO: 658085 - DNA, 25 bp, Homo sapien
tattttgaacagtccagaaaggcat

SEQ ID NO: 658086 - DNA, 25 bp, Homo sapien
gcattcagaagatttgagccttaaa

SEQ ID NO: 658087 - DNA, 25 bp, Homo sapien
cattcagaagatttgagccttaaat

SEQ ID NO: 658088 - DNA, 25 bp, Homo sapien
cagaagatttgagccttaaattatt

SEQ ID NO: 658089 - DNA, 25 bp, Homo sapien
aattattccaagatacagaaggcag

SEQ ID NO: 658090 - DNA, 25 bp, Homo sapien
ttattccaagatacagaaggcagac

SEQ ID NO: 658091 - DNA, 25 bp, Homo sapien
tacagaaggcagacttgctttgctg

SEQ ID NO: 658092 - DNA, 25 bp, Homo sapien
acagaaggcagacttgctttgctga

SEQ ID NO: 658093 - DNA, 25 bp, Homo sapien
cagaaggcagacttgctttgctgaa

SEQ ID NO: 658094 - DNA, 25 bp, Homo sapien
agaaggcagacttgctttgctgaat

SEQ ID NO: 658095 - DNA, 25 bp, Homo sapien
atgacctggtatactgtaggtgcac

SEQ ID NO: 658096 - DNA, 25 bp, Homo sapien
gtaggtgcacacaagattctccata

SEQ ID NO: 658097 - DNA, 25 bp, Homo sapien
ggtgcacacaagattctccatagtg

SEQ ID NO: 658098 - DNA, 25 bp, Homo sapien
gattctccatagtgaaagtacatat

SEQ ID NO: 658099 - DNA, 25 bp, Homo sapien
gaaagtacatatacaattgttgcta

SEQ ID NO: 658100 - DNA, 25 bp, Homo sapien
tgttgctaatttttgatcctagaaa

SEQ ID NO: 658101 - DNA, 25 bp, Homo sapien
ttttgatcctagaaaatccactgga

SEQ ID NO: 658102 - DNA, 25 bp, Homo sapien
aatccactggattgatactttagaa

SEQ ID NO: 658103 - DNA, 25 bp, Homo sapien
aaatcaatcgatcggaaaattcaaa

SEQ ID NO: 658104 - DNA, 25 bp, Homo sapien
gaaaatactagtttcaatctactgt

SEQ ID NO: 658105 - DNA, 25 bp, Homo sapien
tactagtttcaatctactgtaaaaa

SEQ ID NO: 658106 - DNA, 25 bp, Homo sapien
aatgactgttggtgtggtgcctact

SEQ ID NO: 658107 - DNA, 25 bp, Homo sapien
gtgcctacttctcattgtctgattt

SEQ ID NO: 658108 - DNA, 25 bp, Homo sapien
gtctgatttctcattgtctctgatg

SEQ ID NO: 658109 - DNA, 25 bp, Homo sapien
aaaagtcattcttccctggttgatt

SEQ ID NO: 658110 - DNA, 25 bp, Homo sapien
tgaggtctattcaaaagtcctgctt

SEQ ID NO: 658111 - DNA, 25 bp, Homo sapien
gcttttaggcagttaagggatctca

SEQ ID NO: 658112 - DNA, 25 bp, Homo sapien
gggatctcaggaactcaaatgcttt

SEQ ID NO: 658113 - DNA, 25 bp, Homo sapien
agtggcttatcctaaacaccttcac

SEQ ID NO: 658114 - DNA, 25 bp, Homo sapien
tacctcgcactgaactcacagtcta

SEQ ID NO: 658115 - DNA, 25 bp, Homo sapien
tcacagtctatttcctccaaggagg

SEQ ID NO: 658116 - DNA, 25 bp, Homo sapien
aggaggaaatttgcgctttttatat

SEQ ID NO: 658117 - DNA, 25 bp, Homo sapien
tagtagagacaagtcctcactatgt

SEQ ID NO: 658118 - DNA, 25 bp, Homo sapien
cacacccagccaatggtagaatttt

SEQ ID NO: 658119 - DNA, 25 bp, Homo sapien
cagccaatggtagaatttttaaaag

SEQ ID NO: 658120 - DNA, 25 bp, Homo sapien
acagtcttcaaaagtggatgcttat

SEQ ID NO: 658121 - DNA, 25 bp, Homo sapien
cagtcttcaaaagtggatgcttatg

SEQ ID NO: 658122 - DNA, 25 bp, Homo sapien
gtcttcaaaagtggatgcttatggt

SEQ ID NO: 658123 - DNA, 25 bp, Homo sapien
cttcaaaagtggatgcttatggtat

SEQ ID NO: 658124 - DNA, 25 bp, Homo sapien
tcaaaagtggatgcttatggtatca

SEQ ID NO: 658125 - DNA, 25 bp, Homo sapien
caaaagtggatgcttatggtatcag

SEQ ID NO: 658126 - DNA, 25 bp, Homo sapien
aaaagtggatgcttatggtatcagg

SEQ ID NO: 658127 - DNA, 25 bp, Homo sapien
aaagtggatgcttatggtatcaggg

SEQ ID NO: 658128 - DNA, 25 bp, Homo sapien
gcacggcaattgtggaagacccaga

SEQ ID NO: 658129 - DNA, 25 bp, Homo sapien
gaagacccagattagtgatggcaga

SEQ ID NO: 658130 - DNA, 25 bp, Homo sapien
cccagattagtgatggcagaaccat

SEQ ID NO: 658131 - DNA, 25 bp, Homo sapien
gcagaaccatagatgggaggaacct

SEQ ID NO: 658132 - DNA, 25 bp, Homo sapien
cccctgcagtgagatgtggccatcg

SEQ ID NO: 658133 - DNA, 25 bp, Homo sapien
agatgtggccatcggagccagcatt

SEQ ID NO: 658134 - DNA, 25 bp, Homo sapien
ggagccagcattggccaatggactc

SEQ ID NO: 658135 - DNA, 25 bp, Homo sapien
tggactctgcatgggagtgacgcat

SEQ ID NO: 658136 - DNA, 25 bp, Homo sapien
atgggagtgacgcatgctgcctcca

SEQ ID NO: 658137 - DNA, 25 bp, Homo sapien
gtgacgcatgctgcctccaggcttg

SEQ ID NO: 658138 - DNA, 25 bp, Homo sapien
acctccaaggagcacggcaattgtg

SEQ ID NO: 658139 - DNA, 25 bp, Homo sapien
ggaaagaggaactcacccaattcat

SEQ ID NO: 658140 - DNA, 25 bp, Homo sapien
ggaactcacccaattcatacagata

SEQ ID NO: 658141 - DNA, 25 bp, Homo sapien
ttggcatggcttctagccttgaggc

SEQ ID NO: 658142 - DNA, 25 bp, Homo sapien
tggcttctagccttgaggcttttaa

SEQ ID NO: 658143 - DNA, 25 bp, Homo sapien
aaagttccagcaaagtcagtcttaa

SEQ ID NO: 658144 - DNA, 25 bp, Homo sapien
aagagtttatatgcagcctgaatga

SEQ ID NO: 658145 - DNA, 25 bp, Homo sapien
atgacatagtaagaatcccatctct

SEQ ID NO: 658146 - DNA, 25 bp, Homo sapien
tctggtatgttgtctgcaaggttcc

SEQ ID NO: 658147 - DNA, 25 bp, Homo sapien
gtctgcaaggttcctttacaagttc

SEQ ID NO: 658148 - DNA, 25 bp, Homo sapien
ttggtaactaaggaatgtcactttc

SEQ ID NO: 658149 - DNA, 25 bp, Homo sapien
gacagtcccaggaacctcaaattat

SEQ ID NO: 658150 - DNA, 25 bp, Homo sapien
gggaagttctgagctggcattgtca

SEQ ID NO: 658151 - DNA, 25 bp, Homo sapien
aagttctgagctggcattgtcaccc

SEQ ID NO: 658152 - DNA, 25 bp, Homo sapien
cgggtctagtatccccacagagtgg

SEQ ID NO: 658153 - DNA, 25 bp, Homo sapien
agtatccccacagagtggaccctgg

SEQ ID NO: 658154 - DNA, 25 bp, Homo sapien
tcccctatgtgcagccgctgggatg

SEQ ID NO: 658155 - DNA, 25 bp, Homo sapien
atgtgcagccgctgggatgtgtcca

SEQ ID NO: 658156 - DNA, 25 bp, Homo sapien
tcattccctgagatgtggtgctttc

SEQ ID NO: 658157 - DNA, 25 bp, Homo sapien
attccctgagatgtggtgctttctc

SEQ ID NO: 658158 - DNA, 25 bp, Homo sapien
tttctctcctggagccccgtgttgg

SEQ ID NO: 658159 - DNA, 25 bp, Homo sapien
gggacgcttcaaccgcaggccttgc

SEQ ID NO: 658160 - DNA, 25 bp, Homo sapien
ctgaggaaggacaggccctcccttc

SEQ ID NO: 658161 - DNA, 25 bp, Homo sapien
atcctcaggtgcaccctggcagtca

SEQ ID NO: 658162 - DNA, 25 bp, Homo sapien
tggcagtcagccatctgaaggtact

SEQ ID NO: 658163 - DNA, 25 bp, Homo sapien
gtcagccatctgaaggtactatgga

SEQ ID NO: 658164 - DNA, 25 bp, Homo sapien
ggtactatggaaattcagttactca

SEQ ID NO: 658165 - DNA, 25 bp, Homo sapien
gagcagaaggattccagaccattcc

SEQ ID NO: 658166 - DNA, 25 bp, Homo sapien
cagggagccatctgaaggtactgtg

SEQ ID NO: 658167 - DNA, 25 bp, Homo sapien
ggtactgtggaaattcagttactca

SEQ ID NO: 658168 - DNA, 25 bp, Homo sapien
ttcagttactcacccttgcaagcat

SEQ ID NO: 658169 - DNA, 25 bp, Homo sapien
aggattccagattcttcagggtccc

SEQ ID NO: 658170 - DNA, 25 bp, Homo sapien
aattgctacactatattcttcttta

SEQ ID NO: 658171 - DNA, 25 bp, Homo sapien
tatattcttctttatttcatgtgtg

SEQ ID NO: 658172 - DNA, 25 bp, Homo sapien
tgtttcttcatcatttcactcagcc

SEQ ID NO: 658173 - DNA, 25 bp, Homo sapien
aaagtacatttcatgtgcaactgaa

SEQ ID NO: 658174 - DNA, 25 bp, Homo sapien
gaaagttgagtctgtctcagcatgt

SEQ ID NO: 658175 - DNA, 25 bp, Homo sapien
gagtctgtctcagcatgtgaggata

SEQ ID NO: 658176 - DNA, 25 bp, Homo sapien
gatatgaagtttgccttgtcatggg

SEQ ID NO: 658177 - DNA, 25 bp, Homo sapien
gggagcatttcaggtccctaggcct

SEQ ID NO: 658178 - DNA, 25 bp, Homo sapien
atgaggcaccagatggatgtgtcta

SEQ ID NO: 658179 - DNA, 25 bp, Homo sapien
ggatgtgtctaaaaacccttgttga

SEQ ID NO: 658180 - DNA, 25 bp, Homo sapien
aaacccttgttgaaggcactccaca

SEQ ID NO: 658181 - DNA, 25 bp, Homo sapien
aggcactccacagctcaataactga

SEQ ID NO: 658182 - DNA, 25 bp, Homo sapien
tgaccattgctcactactctcttgg

SEQ ID NO: 658183 - DNA, 25 bp, Homo sapien
agtctatttccataggaagaagtct

SEQ ID NO: 658184 - DNA, 25 bp, Homo sapien
gtctatttccataggaagaagtctt

SEQ ID NO: 658185 - DNA, 25 bp, Homo sapien
atttccataggaagaagtctttgca

SEQ ID NO: 658186 - DNA, 25 bp, Homo sapien
taggtgaaggtgatggatacagaat

SEQ ID NO: 658187 - DNA, 25 bp, Homo sapien
ggtgaaggtgatggatacagaatct

SEQ ID NO: 658188 - DNA, 25 bp, Homo sapien
gaaggtgatggatacagaatctgag

SEQ ID NO: 658189 - DNA, 25 bp, Homo sapien
aggtgatggatacagaatctgagtc

SEQ ID NO: 658190 - DNA, 25 bp, Homo sapien
gtgatggatacagaatctgagtctg

SEQ ID NO: 658191 - DNA, 25 bp, Homo sapien
gatggatacagaatctgagtctgag

SEQ ID NO: 658192 - DNA, 25 bp, Homo sapien
atggatacagaatctgagtctgagg

SEQ ID NO: 658193 - DNA, 25 bp, Homo sapien
gcctggttgacagagagacaaaaaa

SEQ ID NO: 658194 - DNA, 25 bp, Homo sapien
taaactactcataaggcagccacct

SEQ ID NO: 658195 - DNA, 25 bp, Homo sapien
ggcagccacctaaaacctatacatg

SEQ ID NO: 658196 - DNA, 25 bp, Homo sapien
aaaacctatacatgagatctgatgg

SEQ ID NO: 658197 - DNA, 25 bp, Homo sapien
gatctgatgggttttgtccaaatgc

SEQ ID NO: 658198 - DNA, 25 bp, Homo sapien
ggttttgtccaaatgcatattataa

SEQ ID NO: 658199 - DNA, 25 bp, Homo sapien
tgcatattataatcatcttctctaa

SEQ ID NO: 658200 - DNA, 25 bp, Homo sapien
atttcataaacactttcacattctt

SEQ ID NO: 658201 - DNA, 25 bp, Homo sapien
agctgcagtgccataatttaactca

SEQ ID NO: 658202 - DNA, 25 bp, Homo sapien
atttaactcactattccaattcagg

SEQ ID NO: 658203 - DNA, 25 bp, Homo sapien
tattccaattcaggtttttctgcta

SEQ ID NO: 658204 - DNA, 25 bp, Homo sapien
ggtttttctgctattatagttaacg

SEQ ID NO: 658205 - DNA, 25 bp, Homo sapien
atgtttcaggtgtaccttggagcct

SEQ ID NO: 658206 - DNA, 25 bp, Homo sapien
gagcctgactggctttctgacattc

SEQ ID NO: 658207 - DNA, 25 bp, Homo sapien
tgactggctttctgacattcctttt

SEQ ID NO: 658208 - DNA, 25 bp, Homo sapien
ttccttttatttagaatcctggctc

SEQ ID NO: 658209 - DNA, 25 bp, Homo sapien
ggctctgtcagagttttaagtgata

SEQ ID NO: 658210 - DNA, 25 bp, Homo sapien
agaaattcatagcttgaactcagga

SEQ ID NO: 658211 - DNA, 25 bp, Homo sapien
aggtgatccattgtacttatgagat

SEQ ID NO: 658212 - DNA, 25 bp, Homo sapien
ggattctctatatttgtgcttcttg

SEQ ID NO: 658213 - DNA, 25 bp, Homo sapien
tatttgtgcttcttggaatcatctt

SEQ ID NO: 658214 - DNA, 25 bp, Homo sapien
ggaatcatcttagagactattggta

SEQ ID NO: 658215 - DNA, 25 bp, Homo sapien
tagagactattggtaacattacgtt

SEQ ID NO: 658216 - DNA, 25 bp, Homo sapien
aattgttgaaatttatgccctttga

SEQ ID NO: 658217 - DNA, 25 bp, Homo sapien
atgccctttgattctatagctgact

SEQ ID NO: 658218 - DNA, 25 bp, Homo sapien
gattctatagctgactttcactgtg

SEQ ID NO: 658219 - DNA, 25 bp, Homo sapien
actttcactgtgagtcattccatca

SEQ ID NO: 658220 - DNA, 25 bp, Homo sapien
gagtcattccatcattatttctgta

SEQ ID NO: 658221 - DNA, 25 bp, Homo sapien
cattccatcattatttctgtattca

SEQ ID NO: 658222 - DNA, 25 bp, Homo sapien
attctcctgctgaagtacatttcag

SEQ ID NO: 658223 - DNA, 25 bp, Homo sapien
atttcaggttgttgctattcctctg

SEQ ID NO: 658224 - DNA, 25 bp, Homo sapien
gttgttgctattcctctgctgatcc

SEQ ID NO: 658225 - DNA, 25 bp, Homo sapien
ccccaacacacatgcttttattaat

SEQ ID NO: 658226 - DNA, 25 bp, Homo sapien
aaatctgctggaacattcttgcata

SEQ ID NO: 658227 - DNA, 25 bp, Homo sapien
ctgtgacagcggcatatttcaaaaa

SEQ ID NO: 658228 - DNA, 25 bp, Homo sapien
atgtattgcaaatttcacacaaggg

SEQ ID NO: 658229 - DNA, 25 bp, Homo sapien
gaaagtctccttggctttcacagac

SEQ ID NO: 658230 - DNA, 25 bp, Homo sapien
gtctccttggctttcacagactttt

SEQ ID NO: 658231 - DNA, 25 bp, Homo sapien
cttttaattaagagagaactcctct

SEQ ID NO: 658232 - DNA, 25 bp, Homo sapien
gaactcctcttctttgaaaatcaaa

SEQ ID NO: 658233 - DNA, 25 bp, Homo sapien
gtagatgggaacttacagccacatt

SEQ ID NO: 658234 - DNA, 25 bp, Homo sapien
tgggaacttacagccacatttaaaa

SEQ ID NO: 658235 - DNA, 25 bp, Homo sapien
gaaaagggcacattggcacctcaca

SEQ ID NO: 658236 - DNA, 25 bp, Homo sapien
gggcacattggcacctcacaattaa

SEQ ID NO: 658237 - DNA, 25 bp, Homo sapien
attggcacctcacaattaaaagagt

SEQ ID NO: 658238 - DNA, 25 bp, Homo sapien
gttttgaaatcactaagtccttcca

SEQ ID NO: 658239 - DNA, 25 bp, Homo sapien
aatcactaagtccttccagtgttcc

SEQ ID NO: 658240 - DNA, 25 bp, Homo sapien
ttccagtgttccttgcacagtcttc

SEQ ID NO: 658241 - DNA, 25 bp, Homo sapien
gcacagtcttccctggagcaaaaag

SEQ ID NO: 658242 - DNA, 25 bp, Homo sapien
cactgagggcttccaatcttgcaga

SEQ ID NO: 658243 - DNA, 25 bp, Homo sapien
gggcttccaatcttgcagaatcgtc

SEQ ID NO: 658244 - DNA, 25 bp, Homo sapien
ttgcagaatcgtcctcactgaattg

SEQ ID NO: 658245 - DNA, 25 bp, Homo sapien
atcgtcctcactgaattgcacttta

SEQ ID NO: 658246 - DNA, 25 bp, Homo sapien
tgcactttaatgttataccctaggt

SEQ ID NO: 658247 - DNA, 25 bp, Homo sapien
gcagcctgtaggtcaaattcaggag

SEQ ID NO: 658248 - DNA, 25 bp, Homo sapien
ttacaagtttaaagggctgcaagag

SEQ ID NO: 658249 - DNA, 25 bp, Homo sapien
atttccacagaagattaatcggtta

SEQ ID NO: 658250 - DNA, 25 bp, Homo sapien
taatcggttaatctcctcaagtcca

SEQ ID NO: 658251 - DNA, 25 bp, Homo sapien
cggttaatctcctcaagtccatggg

SEQ ID NO: 658252 - DNA, 25 bp, Homo sapien
ttccaaattcacttttcctatgcat

SEQ ID NO: 658253 - DNA, 25 bp, Homo sapien
tgtgttctctttggaaactgctcat

SEQ ID NO: 658254 - DNA, 25 bp, Homo sapien
gaaactgctcatcgttttcttactc

SEQ ID NO: 658255 - DNA, 25 bp, Homo sapien
actgctcatcgttttcttactctga

SEQ ID NO: 658256 - DNA, 25 bp, Homo sapien
gctcatcgttttcttactctgattt

SEQ ID NO: 658257 - DNA, 25 bp, Homo sapien
tcgttttcttactctgatttctttc

SEQ ID NO: 658258 - DNA, 25 bp, Homo sapien
tttctttctccctctgttgttgcaa

SEQ ID NO: 658259 - DNA, 25 bp, Homo sapien
ttctccctctgttgttgcaaagata

SEQ ID NO: 658260 - DNA, 25 bp, Homo sapien
gcgctaatgtttaccagatgcagag

SEQ ID NO: 658261 - DNA, 25 bp, Homo sapien
agagaacatccgctgtgtggcacca

SEQ ID NO: 658262 - DNA, 25 bp, Homo sapien
tccgctgtgtggcaccaacaaagca

SEQ ID NO: 658263 - DNA, 25 bp, Homo sapien
aaatgggcacaggacgcttaagaaa

SEQ ID NO: 658264 - DNA, 25 bp, Homo sapien
gaaccaatccaagtggctgggaagt

SEQ ID NO: 658265 - DNA, 25 bp, Homo sapien
gctgggaagttatctagaggtgctc

SEQ ID NO: 658266 - DNA, 25 bp, Homo sapien
tcagaaccacaagaagcaggcgaga

SEQ ID NO: 658267 - DNA, 25 bp, Homo sapien
gagaggtcagcgaagacagcacaat

SEQ ID NO: 658268 - DNA, 25 bp, Homo sapien
gacagcacaatatcagtttctactc

SEQ ID NO: 658269 - DNA, 25 bp, Homo sapien
atatcagtttctactcactggaggg

SEQ ID NO: 658270 - DNA, 25 bp, Homo sapien
tgatgaaacaccatccgttgctggt

SEQ ID NO: 658271 - DNA, 25 bp, Homo sapien
tcagcactttcggagactgacgtgg

SEQ ID NO: 658272 - DNA, 25 bp, Homo sapien
gcactttcggagactgacgtgggca

SEQ ID NO: 658273 - DNA, 25 bp, Homo sapien
actttcggagactgacgtgggcaga

SEQ ID NO: 658274 - DNA, 25 bp, Homo sapien
ctttcggagactgacgtgggcagat

SEQ ID NO: 658275 - DNA, 25 bp, Homo sapien
tttcggagactgacgtgggcagatc

SEQ ID NO: 658276 - DNA, 25 bp, Homo sapien
tcggagactgacgtgggcagatcac

SEQ ID NO: 658277 - DNA, 25 bp, Homo sapien
aattagctggccgtgttggcatgca

SEQ ID NO: 658278 - DNA, 25 bp, Homo sapien
attagctggccgtgttggcatgcac

SEQ ID NO: 658279 - DNA, 25 bp, Homo sapien
tagctggccgtgttggcatgcacct

SEQ ID NO: 658280 - DNA, 25 bp, Homo sapien
caagagaatggcttgagcctgtgag

SEQ ID NO: 658281 - DNA, 25 bp, Homo sapien
cactctagccttgtgacagagtctc

SEQ ID NO: 658282 - DNA, 25 bp, Homo sapien
gctcttttgttaacgcagtggaaac

SEQ ID NO: 658283 - DNA, 25 bp, Homo sapien
gttaacgcagtggaaacaacacagg

SEQ ID NO: 658284 - DNA, 25 bp, Homo sapien
gcacattatcattctcaggccactg

SEQ ID NO: 658285 - DNA, 25 bp, Homo sapien
attctcaggccactgcatttagcct

SEQ ID NO: 658286 - DNA, 25 bp, Homo sapien
gtctaatggaagtgacctcgtcaac

SEQ ID NO: 658287 - DNA, 25 bp, Homo sapien
aagtgacctcgtcaacaacagtctt

SEQ ID NO: 658288 - DNA, 25 bp, Homo sapien
aacagtcttttgttgagaaagtctg

SEQ ID NO: 658289 - DNA, 25 bp, Homo sapien
attggcagtgtatttgtaatggtac

SEQ ID NO: 658290 - DNA, 25 bp, Homo sapien
ggtacataaaatgacgtctgcttta

SEQ ID NO: 658291 - DNA, 25 bp, Homo sapien
gctttataagcattctcattcctat

SEQ ID NO: 658292 - DNA, 25 bp, Homo sapien
agcattctcattcctatattagatg

SEQ ID NO: 658293 - DNA, 25 bp, Homo sapien
aggtgggcagatcgcctgtaatccc

SEQ ID NO: 658294 - DNA, 25 bp, Homo sapien
catgccattgcacttacagccctgt

SEQ ID NO: 658295 - DNA, 25 bp, Homo sapien
atgccattgcacttacagccctgtc

SEQ ID NO: 658296 - DNA, 25 bp, Homo sapien
tgccattgcacttacagccctgtca

SEQ ID NO: 658297 - DNA, 25 bp, Homo sapien
gccattgcacttacagccctgtcaa

SEQ ID NO: 658298 - DNA, 25 bp, Homo sapien
cattgcacttacagccctgtcaaca

SEQ ID NO: 658299 - DNA, 25 bp, Homo sapien
attgcacttacagccctgtcaacag

SEQ ID NO: 658300 - DNA, 25 bp, Homo sapien
ttgcacttacagccctgtcaacagt

SEQ ID NO: 658301 - DNA, 25 bp, Homo sapien
tgcacttacagccctgtcaacagtg

SEQ ID NO: 658302 - DNA, 25 bp, Homo sapien
gcacttacagccctgtcaacagtgc

SEQ ID NO: 658303 - DNA, 25 bp, Homo sapien
cacttacagccctgtcaacagtgca

SEQ ID NO: 658304 - DNA, 25 bp, Homo sapien
atgattgtacagtaaaccctgaagt

SEQ ID NO: 658305 - DNA, 25 bp, Homo sapien
tgattgtacagtaaaccctgaagtg

SEQ ID NO: 658306 - DNA, 25 bp, Homo sapien
gattgtacagtaaaccctgaagtga

SEQ ID NO: 658307 - DNA, 25 bp, Homo sapien
attgtacagtaaaccctgaagtgaa

SEQ ID NO: 658308 - DNA, 25 bp, Homo sapien
cattttgataacttacagacatttg

SEQ ID NO: 658309 - DNA, 25 bp, Homo sapien
acagacatttgcaatttatctttct

SEQ ID NO: 658310 - DNA, 25 bp, Homo sapien
cagacatttgcaatttatctttctt

SEQ ID NO: 658311 - DNA, 25 bp, Homo sapien
agacatttgcaatttatctttcttt

SEQ ID NO: 658312 - DNA, 25 bp, Homo sapien
acaccacgaggctacatttttattg

SEQ ID NO: 658313 - DNA, 25 bp, Homo sapien
gaactggagcgcactgcggtcagaa

SEQ ID NO: 658314 - DNA, 25 bp, Homo sapien
actgcggtcagaaccctgggttgga

SEQ ID NO: 658315 - DNA, 25 bp, Homo sapien
ttggatggaggtttggtttctgtct

SEQ ID NO: 658316 - DNA, 25 bp, Homo sapien
agaagccgtctctcttaaccgtgga

SEQ ID NO: 658317 - DNA, 25 bp, Homo sapien
aaccgtggacagatcttgttcctga

SEQ ID NO: 658318 - DNA, 25 bp, Homo sapien
gatcttgttcctgaatggacgcttt

SEQ ID NO: 658319 - DNA, 25 bp, Homo sapien
atggacgctttcagtatttctttct

SEQ ID NO: 658320 - DNA, 25 bp, Homo sapien
tttctttctgaagtctgatatttgc

SEQ ID NO: 658321 - DNA, 25 bp, Homo sapien
ttttctgtggctgtagatacccttt

SEQ ID NO: 658322 - DNA, 25 bp, Homo sapien
gctgtagataccctttatctggtta

SEQ ID NO: 658323 - DNA, 25 bp, Homo sapien
tcctttttgtgtatcatcgaccctg

SEQ ID NO: 658324 - DNA, 25 bp, Homo sapien
tcatcgaccctgaacaacacaagtt

SEQ ID NO: 658325 - DNA, 25 bp, Homo sapien
caagtttgagccgtgtgggtgcact

SEQ ID NO: 658326 - DNA, 25 bp, Homo sapien
tgggtgcacttctacgtggattttc

SEQ ID NO: 658327 - DNA, 25 bp, Homo sapien
cacttctacgtggattttcttcctc

SEQ ID NO: 658328 - DNA, 25 bp, Homo sapien
gtcacccgagacagtaagagccacc

SEQ ID NO: 658329 - DNA, 25 bp, Homo sapien
ctccccagctgactcaacgtgaaga

SEQ ID NO: 658330 - DNA, 25 bp, Homo sapien
gaagacctttacaatgatctgctta

SEQ ID NO: 658331 - DNA, 25 bp, Homo sapien
atgatctgcttatgctgaatgaata

SEQ ID NO: 658332 - DNA, 25 bp, Homo sapien
ctgataccccaccacttatggaatg

SEQ ID NO: 658333 - DNA, 25 bp, Homo sapien
ttccccactggattagaatgtcctt

SEQ ID NO: 658334 - DNA, 25 bp, Homo sapien
tcctcaagtactttactcggagcct

SEQ ID NO: 658335 - DNA, 25 bp, Homo sapien
cctcaagtactttactcggagcctt

SEQ ID NO: 658336 - DNA, 25 bp, Homo sapien
ctcaagtactttactcggagccttg

SEQ ID NO: 658337 - DNA, 25 bp, Homo sapien
tcaagtactttactcggagccttga

SEQ ID NO: 658338 - DNA, 25 bp, Homo sapien
caagtactttactcggagccttgag

SEQ ID NO: 658339 - DNA, 25 bp, Homo sapien
aagtactttactcggagccttgagg

SEQ ID NO: 658340 - DNA, 25 bp, Homo sapien
ggcctgggcggtgtgccgagctcct

SEQ ID NO: 658341 - DNA, 25 bp, Homo sapien
gcctgggcggtgtgccgagctcctg

SEQ ID NO: 658342 - DNA, 25 bp, Homo sapien
gcggtgtgccgagctcctgaaggag

SEQ ID NO: 658343 - DNA, 25 bp, Homo sapien
atgtggatcagatgccatttgagaa

SEQ ID NO: 658344 - DNA, 25 bp, Homo sapien
atgctgagaacaactgagagatggc

SEQ ID NO: 658345 - DNA, 25 bp, Homo sapien
agatggcagcatttttcagctcggg

SEQ ID NO: 658346 - DNA, 25 bp, Homo sapien
gatgagtctgcctagggctggaaac

SEQ ID NO: 658347 - DNA, 25 bp, Homo sapien
tagggctggaaactctgtcttctgc

SEQ ID NO: 658348 - DNA, 25 bp, Homo sapien
gaaactctgtcttctgccatgggac

SEQ ID NO: 658349 - DNA, 25 bp, Homo sapien
tgccatgggactgcacgtggccttg

SEQ ID NO: 658350 - DNA, 25 bp, Homo sapien
tccagtcttggattcctcatctgtc

SEQ ID NO: 658351 - DNA, 25 bp, Homo sapien
tgccatctgttcaaagtgttgttaa

SEQ ID NO: 658352 - DNA, 25 bp, Homo sapien
gataaggctatatccccaagctcat

SEQ ID NO: 658353 - DNA, 25 bp, Homo sapien
ccccaagctcatttacagcaacaat

SEQ ID NO: 658354 - DNA, 25 bp, Homo sapien
ttaaactgaccataatcctactctg

SEQ ID NO: 658355 - DNA, 25 bp, Homo sapien
actgaccataatcctactctggaaa

SEQ ID NO: 658356 - DNA, 25 bp, Homo sapien
tttccttttggtggatagtatttct

SEQ ID NO: 658357 - DNA, 25 bp, Homo sapien
cttttggtggatagtatttctttat

SEQ ID NO: 658358 - DNA, 25 bp, Homo sapien
aaagttattcagaggttactatggt

SEQ ID NO: 658359 - DNA, 25 bp, Homo sapien
gaggttactatggtgatggcagatt

SEQ ID NO: 658360 - DNA, 25 bp, Homo sapien
tggcagattttgatccattaggagt

SEQ ID NO: 658361 - DNA, 25 bp, Homo sapien
gatccattaggagtgttaaacagat

SEQ ID NO: 658362 - DNA, 25 bp, Homo sapien
gagtgttaaacagatagctccgttt

SEQ ID NO: 658363 - DNA, 25 bp, Homo sapien
taaacagatagctccgtttttctaa

SEQ ID NO: 658364 - DNA, 25 bp, Homo sapien
cagatagctccgtttttctaaaact

SEQ ID NO: 658365 - DNA, 25 bp, Homo sapien
tcagtgggtaagactttaaagccga

SEQ ID NO: 658366 - DNA, 25 bp, Homo sapien
ttaaagccgaattattttctcctgt

SEQ ID NO: 658367 - DNA, 25 bp, Homo sapien
tttctcctgtttcaaaatgctcaaa

SEQ ID NO: 658368 - DNA, 25 bp, Homo sapien
ataaaagcaccgtcgacaacttgat

SEQ ID NO: 658369 - DNA, 25 bp, Homo sapien
agcaccgtcgacaacttgattataa

SEQ ID NO: 658370 - DNA, 25 bp, Homo sapien
aacccaagtaaaactcatattgttg

SEQ ID NO: 658371 - DNA, 25 bp, Homo sapien
catattgttgtctgtctaggctttt

SEQ ID NO: 658372 - DNA, 25 bp, Homo sapien
gttgtctgtctaggcttttgaagga

SEQ ID NO: 658373 - DNA, 25 bp, Homo sapien
gaaggacctttttgtagtctaggca

SEQ ID NO: 658374 - DNA, 25 bp, Homo sapien
gacctttttgtagtctaggcaagtt

SEQ ID NO: 658375 - DNA, 25 bp, Homo sapien
agtctaggcaagtttatgtgacata

SEQ ID NO: 658376 - DNA, 25 bp, Homo sapien
gctgcctgtgtcagggaatctgctt

SEQ ID NO: 658377 - DNA, 25 bp, Homo sapien
gcctgtgtcagggaatctgcttgat

SEQ ID NO: 658378 - DNA, 25 bp, Homo sapien
ctgtgtcagggaatctgcttgatgt

SEQ ID NO: 658379 - DNA, 25 bp, Homo sapien
gtcagggaatctgcttgatgtgtac

SEQ ID NO: 658380 - DNA, 25 bp, Homo sapien
gaatctgcttgatgtgtacagtagt

SEQ ID NO: 658381 - DNA, 25 bp, Homo sapien
atctgcttgatgtgtacagtagtca

SEQ ID NO: 658382 - DNA, 25 bp, Homo sapien
tgtacagtagtcaaggcgtggccac

SEQ ID NO: 658383 - DNA, 25 bp, Homo sapien
tacagtagtcaaggcgtggccacac

SEQ ID NO: 658384 - DNA, 25 bp, Homo sapien
agtagtcaaggcgtggccacaccag

SEQ ID NO: 658385 - DNA, 25 bp, Homo sapien
gtagtcaaggcgtggccacaccagc

SEQ ID NO: 658386 - DNA, 25 bp, Homo sapien
gccacaccagccatcactgtcagca

SEQ ID NO: 658387 - DNA, 25 bp, Homo sapien
ttttcctaccttttcttgatcacac

SEQ ID NO: 658388 - DNA, 25 bp, Homo sapien
tgatcacaccatccgctgagttaag

SEQ ID NO: 658389 - DNA, 25 bp, Homo sapien
ggatctgtaaacaaagcttgaattg

SEQ ID NO: 658390 - DNA, 25 bp, Homo sapien
ttgagccaaaatgatctaacttcca

SEQ ID NO: 658391 - DNA, 25 bp, Homo sapien
tgatctaacttccaaagggaaccct

SEQ ID NO: 658392 - DNA, 25 bp, Homo sapien
ggtaaacttgaacgtcttcattgat

SEQ ID NO: 658393 - DNA, 25 bp, Homo sapien
gatgatagagaaccttgcttctcaa

SEQ ID NO: 658394 - DNA, 25 bp, Homo sapien
taacctagcatgaagggcaacttgg

SEQ ID NO: 658395 - DNA, 25 bp, Homo sapien
gtagttgtttttgttgctaatatcc

SEQ ID NO: 658396 - DNA, 25 bp, Homo sapien
gttgctaatatccaattccccatgg

SEQ ID NO: 658397 - DNA, 25 bp, Homo sapien
tccccatggcctgatacttttgtaa

SEQ ID NO: 658398 - DNA, 25 bp, Homo sapien
cctggtcaacatggcaaaactgtct

SEQ ID NO: 658399 - DNA, 25 bp, Homo sapien
ctggtcaacatggcaaaactgtctc

SEQ ID NO: 658400 - DNA, 25 bp, Homo sapien
aggtgtgatggcacacacctgcaat

SEQ ID NO: 658401 - DNA, 25 bp, Homo sapien
agaatcgtttgcacctgggagacag

SEQ ID NO: 658402 - DNA, 25 bp, Homo sapien
gaatcgtttgcacctgggagacaga

SEQ ID NO: 658403 - DNA, 25 bp, Homo sapien
aatcgtttgcacctgggagacagag

SEQ ID NO: 658404 - DNA, 25 bp, Homo sapien
atcgtttgcacctgggagacagagg

SEQ ID NO: 658405 - DNA, 25 bp, Homo sapien
tcgtttgcacctgggagacagaggt

SEQ ID NO: 658406 - DNA, 25 bp, Homo sapien
cgcaccactgtacttcagccagcct

SEQ ID NO: 658407 - DNA, 25 bp, Homo sapien
ccactgtacttcagccagcctgggt

SEQ ID NO: 658408 - DNA, 25 bp, Homo sapien
ctgtacttcagccagcctgggtgac

SEQ ID NO: 658409 - DNA, 25 bp, Homo sapien
cttgctttgctgaattgacatttta

SEQ ID NO: 658410 - DNA, 25 bp, Homo sapien
gctttgctgaattgacattttaatc

SEQ ID NO: 658411 - DNA, 25 bp, Homo sapien
tattttttaacaaggcaactatatt

SEQ ID NO: 658412 - DNA, 25 bp, Homo sapien
tatttataatatcctgccaaacatg

SEQ ID NO: 658413 - DNA, 25 bp, Homo sapien
atatcctgccaaacatgaatgcatg

SEQ ID NO: 658414 - DNA, 25 bp, Homo sapien
acatgaatgcatgcctttcacctgt

SEQ ID NO: 658415 - DNA, 25 bp, Homo sapien
tcttggctgaagaattcctctggaa

SEQ ID NO: 658416 - DNA, 25 bp, Homo sapien
ttggctgaagaattcctctggaaat

SEQ ID NO: 658417 - DNA, 25 bp, Homo sapien
gaattcctctggaaatatttcccag

SEQ ID NO: 658418 - DNA, 25 bp, Homo sapien
ggaaatatttcccaggccaaaggtg

SEQ ID NO: 658419 - DNA, 25 bp, Homo sapien
gccagtaattggaagttttatgaag

SEQ ID NO: 658420 - DNA, 25 bp, Homo sapien
gaaggctctcagagtctggactaga

SEQ ID NO: 658421 - DNA, 25 bp, Homo sapien
ggactagagactacatattagctgt

SEQ ID NO: 658422 - DNA, 25 bp, Homo sapien
taacttggaggagcgtacttactct

SEQ ID NO: 658423 - DNA, 25 bp, Homo sapien
gaggagcgtacttactctccctaaa

SEQ ID NO: 658424 - DNA, 25 bp, Homo sapien
tctccctaaacttcagccgcaaaat

SEQ ID NO: 658425 - DNA, 25 bp, Homo sapien
gccgcaaaatggagatgacgctaca

SEQ ID NO: 658426 - DNA, 25 bp, Homo sapien
gatgacgctacatgcctggaagggt

SEQ ID NO: 658427 - DNA, 25 bp, Homo sapien
aagggtggctgtaccaacccagcaa

SEQ ID NO: 658428 - DNA, 25 bp, Homo sapien
cagcaagacatcaggcctggagtaa

SEQ ID NO: 658429 - DNA, 25 bp, Homo sapien
tcaggcctggagtaagtgcttaata

SEQ ID NO: 658430 - DNA, 25 bp, Homo sapien
gcttaataaatggaattgtccctgg

SEQ ID NO: 658431 - DNA, 25 bp, Homo sapien
gagcattttggagcccgggaagaaa

SEQ ID NO: 658432 - DNA, 25 bp, Homo sapien
agcccgggaagaaactcatcagaag

SEQ ID NO: 658433 - DNA, 25 bp, Homo sapien
ataaaggctctgtataccgccacgg

SEQ ID NO: 658434 - DNA, 25 bp, Homo sapien
tataccgccacggaaaagctttcca

SEQ ID NO: 658435 - DNA, 25 bp, Homo sapien
aagcaagctggagcatgccaacaaa

SEQ ID NO: 658436 - DNA, 25 bp, Homo sapien
gtgatagctctatggaagtccaaac

SEQ ID NO: 658437 - DNA, 25 bp, Homo sapien
gtccaaactggagactgccatcgca

SEQ ID NO: 658438 - DNA, 25 bp, Homo sapien
atcccaccagcaggcgatggaagaa

SEQ ID NO: 658439 - DNA, 25 bp, Homo sapien
gaaggtatctttcagcaaagggctt

SEQ ID NO: 658440 - DNA, 25 bp, Homo sapien
caaagggcttggaacagagacggca

SEQ ID NO: 658441 - DNA, 25 bp, Homo sapien
gagacggcagaatttgctgaactaa

SEQ ID NO: 658442 - DNA, 25 bp, Homo sapien
aataaagtttcttttactctcatct

SEQ ID NO: 658443 - DNA, 25 bp, Homo sapien
aattccagacatttaagcttctcct

SEQ ID NO: 658444 - DNA, 25 bp, Homo sapien
ttccagacatttaagcttctccttt

SEQ ID NO: 658445 - DNA, 25 bp, Homo sapien
ccagacatttaagcttctcctttta

SEQ ID NO: 658446 - DNA, 25 bp, Homo sapien
catttaagcttctccttttagctgt

SEQ ID NO: 658447 - DNA, 25 bp, Homo sapien
tttaagcttctccttttagctgttt

SEQ ID NO: 658448 - DNA, 25 bp, Homo sapien
taagcttctccttttagctgtttct

SEQ ID NO: 658449 - DNA, 25 bp, Homo sapien
gtttctgtttgcttcctcagaggaa

SEQ ID NO: 658450 - DNA, 25 bp, Homo sapien
tttctgtttgcttcctcagaggaat

SEQ ID NO: 658451 - DNA, 25 bp, Homo sapien
ttctgtttgcttcctcagaggaatt

SEQ ID NO: 658452 - DNA, 25 bp, Homo sapien
gtttgcttcctcagaggaatttaac

SEQ ID NO: 658453 - DNA, 25 bp, Homo sapien
caggcagatcatgagtcaggaaatt

SEQ ID NO: 658454 - DNA, 25 bp, Homo sapien
aggcagatcatgagtcaggaaattg

SEQ ID NO: 658455 - DNA, 25 bp, Homo sapien
cagatcatgagtcaggaaattgaga

SEQ ID NO: 658456 - DNA, 25 bp, Homo sapien
aattagccgggcatgctggcacacg

SEQ ID NO: 658457 - DNA, 25 bp, Homo sapien
attagccgggcatgctggcacacgc

SEQ ID NO: 658458 - DNA, 25 bp, Homo sapien
ttagccgggcatgctggcacacgcc

SEQ ID NO: 658459 - DNA, 25 bp, Homo sapien
tagccgggcatgctggcacacgcct

SEQ ID NO: 658460 - DNA, 25 bp, Homo sapien
agccgggcatgctggcacacgcctg

SEQ ID NO: 658461 - DNA, 25 bp, Homo sapien
acagtcttcaaaagtggatgcttat

SEQ ID NO: 658462 - DNA, 25 bp, Homo sapien
cagtcttcaaaagtggatgcttatg

SEQ ID NO: 658463 - DNA, 25 bp, Homo sapien
agtcttcaaaagtggatgcttatgg

SEQ ID NO: 658464 - DNA, 25 bp, Homo sapien
gtcttcaaaagtggatgcttatggt

SEQ ID NO: 658465 - DNA, 25 bp, Homo sapien
tcttcaaaagtggatgcttatggta

SEQ ID NO: 658466 - DNA, 25 bp, Homo sapien
cttcaaaagtggatgcttatggtat

SEQ ID NO: 658467 - DNA, 25 bp, Homo sapien
ttcaaaagtggatgcttatggtatc

SEQ ID NO: 658468 - DNA, 25 bp, Homo sapien
tcaaaagtggatgcttatggtatca

SEQ ID NO: 658469 - DNA, 25 bp, Homo sapien
caaaagtggatgcttatggtatcag

SEQ ID NO: 658470 - DNA, 25 bp, Homo sapien
aaaagtggatgcttatggtatcagg

SEQ ID NO: 658471 - DNA, 25 bp, Homo sapien
aaagtggatgcttatggtatcaggg

SEQ ID NO: 658472 - DNA, 25 bp, Homo sapien
atttgatggcccatgtgggatcaaa

SEQ ID NO: 658473 - DNA, 25 bp, Homo sapien
gcccatgtgggatcaaaggccactg

SEQ ID NO: 658474 - DNA, 25 bp, Homo sapien
tcagttctaaggcatgtatttttca

SEQ ID NO: 658475 - DNA, 25 bp, Homo sapien
ctaaggcatgtatttttcatacttt

SEQ ID NO: 658476 - DNA, 25 bp, Homo sapien
gaaatcaagtatagcttctagtaga

SEQ ID NO: 658477 - DNA, 25 bp, Homo sapien
gcttctagtagatattaaaacccat

SEQ ID NO: 658478 - DNA, 25 bp, Homo sapien
ttgccattccctgcttttgtatgaa

SEQ ID NO: 658479 - DNA, 25 bp, Homo sapien
attccctgcttttgtatgaacccag

SEQ ID NO: 658480 - DNA, 25 bp, Homo sapien
cttttgtatgaacccagctgagcat

SEQ ID NO: 658481 - DNA, 25 bp, Homo sapien
gaacccagctgagcataaaccgtaa

SEQ ID NO: 658482 - DNA, 25 bp, Homo sapien
gctgagcataaaccgtaatctattc

SEQ ID NO: 658483 - DNA, 25 bp, Homo sapien
agagcaaaaacagccaatcttgaaa

SEQ ID NO: 658484 - DNA, 25 bp, Homo sapien
aacatacatgtagcaggattccatt

SEQ ID NO: 658485 - DNA, 25 bp, Homo sapien
gcaggattccatttatgtaacattg

SEQ ID NO: 658486 - DNA, 25 bp, Homo sapien
tacattattatctggcatagactgt

SEQ ID NO: 658487 - DNA, 25 bp, Homo sapien
ggcatagactgttatatatagcata

SEQ ID NO: 658488 - DNA, 25 bp, Homo sapien
aaacaatatgtatccgtactgtatg

SEQ ID NO: 658489 - DNA, 25 bp, Homo sapien
atatgtatccgtactgtatgtgata

SEQ ID NO: 658490 - DNA, 25 bp, Homo sapien
gtatgtgatatagtgccattttcag

SEQ ID NO: 658491 - DNA, 25 bp, Homo sapien
atagtgccattttcagtaactgctg

SEQ ID NO: 658492 - DNA, 25 bp, Homo sapien
attttcagtaactgctgtacacaca

SEQ ID NO: 658493 - DNA, 25 bp, Homo sapien
acagcaactcagatgaaactcaagg

SEQ ID NO: 658494 - DNA, 25 bp, Homo sapien
ggtggtcatgcctcggtcctcttgg

SEQ ID NO: 658495 - DNA, 25 bp, Homo sapien
gcctggaaggatgtggctcttagtc

SEQ ID NO: 658496 - DNA, 25 bp, Homo sapien
gatgtggctcttagtcgagggccct

SEQ ID NO: 658497 - DNA, 25 bp, Homo sapien
ggctcttagtcgagggccctgctca

SEQ ID NO: 658498 - DNA, 25 bp, Homo sapien
cgggctgcttccaaggtctgttctc

SEQ ID NO: 658499 - DNA, 25 bp, Homo sapien
ccaaggtctgttctccgatctggag

SEQ ID NO: 658500 - DNA, 25 bp, Homo sapien
tgttctccgatctggagctgagcct

SEQ ID NO: 658501 - DNA, 25 bp, Homo sapien
agggccagggtcacataggtgattc

SEQ ID NO: 658502 - DNA, 25 bp, Homo sapien
gtcacataggtgattccgctggatg

SEQ ID NO: 658503 - DNA, 25 bp, Homo sapien
gtgattccgctggatggacgcatgc

SEQ ID NO: 658504 - DNA, 25 bp, Homo sapien
tggatggacgcatgccccagtagat

SEQ ID NO: 658505 - DNA, 25 bp, Homo sapien
aaagaagcactttgtctggcaccac

SEQ ID NO: 658506 - DNA, 25 bp, Homo sapien
tctggcaccacccatcagagggttg

SEQ ID NO: 658507 - DNA, 25 bp, Homo sapien
atcagagggttgtggctaatggacc

SEQ ID NO: 658508 - DNA, 25 bp, Homo sapien
ctaatggaccaggaacaccttggac

SEQ ID NO: 658509 - DNA, 25 bp, Homo sapien
tgatgcagcaggttcccaatctcac

SEQ ID NO: 658510 - DNA, 25 bp, Homo sapien
gtaccaactccccagacttagagtc

SEQ ID NO: 658511 - DNA, 25 bp, Homo sapien
gacttagagtccaccaggagtgctg

SEQ ID NO: 658512 - DNA, 25 bp, Homo sapien
gtccaccaggagtgctgagctgagc

SEQ ID NO: 658513 - DNA, 25 bp, Homo sapien
tgagctgagccgtggcccctaaaat

SEQ ID NO: 658514 - DNA, 25 bp, Homo sapien
atgaacccagtcaactgaacctacc

SEQ ID NO: 658515 - DNA, 25 bp, Homo sapien
tgaacctaccttataccgcaatgaa

SEQ ID NO: 658516 - DNA, 25 bp, Homo sapien
taaacttggaggtagaaaccagact

SEQ ID NO: 658517 - DNA, 25 bp, Homo sapien
accagacttgaattctgcctctatg

SEQ ID NO: 658518 - DNA, 25 bp, Homo sapien
attctgcctctatgtatagcctttg

SEQ ID NO: 658519 - DNA, 25 bp, Homo sapien
gcctctatgtatagcctttggaaaa

SEQ ID NO: 658520 - DNA, 25 bp, Homo sapien
tgtttcaaagcccaagtttctccat

SEQ ID NO: 658521 - DNA, 25 bp, Homo sapien
aaagcccaagtttctccatctataa

SEQ ID NO: 658522 - DNA, 25 bp, Homo sapien
agcccaagtttctccatctataaaa

SEQ ID NO: 658523 - DNA, 25 bp, Homo sapien
aataccttcattcaaagagttgtac

SEQ ID NO: 658524 - DNA, 25 bp, Homo sapien
gagttgtactataacttttcaatga

SEQ ID NO: 658525 - DNA, 25 bp, Homo sapien
aaactgtgtatgattctgatcttta

SEQ ID NO: 658526 - DNA, 25 bp, Homo sapien
ttaatacagattaagactcccaagt

SEQ ID NO: 658527 - DNA, 25 bp, Homo sapien
taaacctcctgcattatctgaatca

SEQ ID NO: 658528 - DNA, 25 bp, Homo sapien
ctcctgcattatctgaatcaacgaa

SEQ ID NO: 658529 - DNA, 25 bp, Homo sapien
gaatcaacgaataaatccatactaa

SEQ ID NO: 658530 - DNA, 25 bp, Homo sapien
atactaaacaataagccctcctcct

SEQ ID NO: 658531 - DNA, 25 bp, Homo sapien
aaacaataagccctcctcctgcggg

SEQ ID NO: 658532 - DNA, 25 bp, Homo sapien
ctcctgcgggtctgtatctctgtga

SEQ ID NO: 658533 - DNA, 25 bp, Homo sapien
tgcgggtctgtatctctgtgacacg

SEQ ID NO: 658534 - DNA, 25 bp, Homo sapien
ggtctgtatctctgtgacacgtctt

SEQ ID NO: 658535 - DNA, 25 bp, Homo sapien
tgtgacacgtcttccctgtgaaagg

SEQ ID NO: 658536 - DNA, 25 bp, Homo sapien
acacgtcttccctgtgaaaggcaca

SEQ ID NO: 658537 - DNA, 25 bp, Homo sapien
acagaatgttctcgatgctactcag

SEQ ID NO: 658538 - DNA, 25 bp, Homo sapien
atccctactctagaacctaagattg

SEQ ID NO: 658539 - DNA, 25 bp, Homo sapien
gactcaactggtcctgtggcctcca

SEQ ID NO: 658540 - DNA, 25 bp, Homo sapien
ggcagactcagcacacaaggaacat

SEQ ID NO: 658541 - DNA, 25 bp, Homo sapien
gactcagcacacaaggaacattttc

SEQ ID NO: 658542 - DNA, 25 bp, Homo sapien
tgatttcatccccagtcagtcaaca

SEQ ID NO: 658543 - DNA, 25 bp, Homo sapien
tcagtcaacattcctcattccctag

SEQ ID NO: 658544 - DNA, 25 bp, Homo sapien
cccttgcctactaaactattcttga

SEQ ID NO: 658545 - DNA, 25 bp, Homo sapien
tgcctactaaactattcttgaaaaa

SEQ ID NO: 658546 - DNA, 25 bp, Homo sapien
aaaccctaatctctgaggcttcaga

SEQ ID NO: 658547 - DNA, 25 bp, Homo sapien
gatttgagtgatagctctgtcttct

SEQ ID NO: 658548 - DNA, 25 bp, Homo sapien
gagtgatagctctgtcttctgtgtg

SEQ ID NO: 658549 - DNA, 25 bp, Homo sapien
tacatcgtgaccttcatgaagagca

SEQ ID NO: 658550 - DNA, 25 bp, Homo sapien
gaagagcatcctaccatttgaagca

SEQ ID NO: 658551 - DNA, 25 bp, Homo sapien
gcagttgtgtgcatgtatcggttcc

SEQ ID NO: 658552 - DNA, 25 bp, Homo sapien
tgtatcggttcctaggagcggacaa

SEQ ID NO: 658553 - DNA, 25 bp, Homo sapien
gagcggacaagtgtatgtacccctt

SEQ ID NO: 658554 - DNA, 25 bp, Homo sapien
tgtatgtacccctttattgctcaaa

SEQ ID NO: 658555 - DNA, 25 bp, Homo sapien
gaaagcaagccacaaacaataatga

SEQ ID NO: 658556 - DNA, 25 bp, Homo sapien
gtatggaatattacttctatcagaa

SEQ ID NO: 658557 - DNA, 25 bp, Homo sapien
gatcaagatgtttcagtccagtgca

SEQ ID NO: 658558 - DNA, 25 bp, Homo sapien
atgtttcagtccagtgcacatcagc

SEQ ID NO: 658559 - DNA, 25 bp, Homo sapien
tcagcattgctgacattttatggat

SEQ ID NO: 658560 - DNA, 25 bp, Homo sapien
ttattctagggcatatgtttggaca

SEQ ID NO: 658561 - DNA, 25 bp, Homo sapien
attctagggcatatgtttggacagg

SEQ ID NO: 658562 - DNA, 25 bp, Homo sapien
tctagggcatatgtttggacagggt

SEQ ID NO: 658563 - DNA, 25 bp, Homo sapien
ggcatatgtttggacagggtgtaaa

SEQ ID NO: 658564 - DNA, 25 bp, Homo sapien
tggaaaggtttattcactttgtcga

SEQ ID NO: 658565 - DNA, 25 bp, Homo sapien
aggtttattcactttgtcgaaccag

SEQ ID NO: 658566 - DNA, 25 bp, Homo sapien
gtttattcactttgtcgaaccagaa

SEQ ID NO: 658567 - DNA, 25 bp, Homo sapien
ttattcactttgtcgaaccagaaat

SEQ ID NO: 658568 - DNA, 25 bp, Homo sapien
attcactttgtcgaaccagaaatga

SEQ ID NO: 658569 - DNA, 25 bp, Homo sapien
cactttgtcgaaccagaaatgactt

SEQ ID NO: 658570 - DNA, 25 bp, Homo sapien
tttgtcgaaccagaaatgacttttt

SEQ ID NO: 658571 - DNA, 25 bp, Homo sapien
aaagacatcttatagtcatggataa

SEQ ID NO: 658572 - DNA, 25 bp, Homo sapien
tgaaatgaccatactaccccaaata

SEQ ID NO: 658573 - DNA, 25 bp, Homo sapien
atgaccatactaccccaaataaaat

SEQ ID NO: 658574 - DNA, 25 bp, Homo sapien
aaaatacacattcaatgccctccct

SEQ ID NO: 658575 - DNA, 25 bp, Homo sapien
aaccaagatgtagtcggaatagcca

SEQ ID NO: 658576 - DNA, 25 bp, Homo sapien
gatgtagtcggaatagccaaagcaa

SEQ ID NO: 658577 - DNA, 25 bp, Homo sapien
agaacgaagttcaaaacctcacaca

SEQ ID NO: 658578 - DNA, 25 bp, Homo sapien
cctcacacaaactgacttcagatta

SEQ ID NO: 658579 - DNA, 25 bp, Homo sapien
aactgacttcagattataaggctat

SEQ ID NO: 658580 - DNA, 25 bp, Homo sapien
atcaaaacagcatggcattggtata

SEQ ID NO: 658581 - DNA, 25 bp, Homo sapien
atggcattggtatagaaatagacac

SEQ ID NO: 658582 - DNA, 25 bp, Homo sapien
ctgggcatggtgacgctatgatgta

SEQ ID NO: 658583 - DNA, 25 bp, Homo sapien
tgggcatggtgacgctatgatgtag

SEQ ID NO: 658584 - DNA, 25 bp, Homo sapien
gggcatggtgacgctatgatgtagt

SEQ ID NO: 658585 - DNA, 25 bp, Homo sapien
ggcatggtgacgctatgatgtagtc

SEQ ID NO: 658586 - DNA, 25 bp, Homo sapien
catggtgacgctatgatgtagtccc

SEQ ID NO: 658587 - DNA, 25 bp, Homo sapien
atggtgacgctatgatgtagtccca

SEQ ID NO: 658588 - DNA, 25 bp, Homo sapien
tggtgacgctatgatgtagtcccag

SEQ ID NO: 658589 - DNA, 25 bp, Homo sapien
ggtgacgctatgatgtagtcccagt

SEQ ID NO: 658590 - DNA, 25 bp, Homo sapien
gtgacgctatgatgtagtcccagtt

SEQ ID NO: 658591 - DNA, 25 bp, Homo sapien
tgacgctatgatgtagtcccagtta

SEQ ID NO: 658592 - DNA, 25 bp, Homo sapien
gacgctatgatgtagtcccagttat

SEQ ID NO: 658593 - DNA, 25 bp, Homo sapien
aataattagaatgggctattctgaa

SEQ ID NO: 658594 - DNA, 25 bp, Homo sapien
tagaatgggctattctgaaagatat

SEQ ID NO: 658595 - DNA, 25 bp, Homo sapien
ttctgaaagatatagcattagttat

SEQ ID NO: 658596 - DNA, 25 bp, Homo sapien
tgagttttctattaacctatatttg

SEQ ID NO: 658597 - DNA, 25 bp, Homo sapien
gagttttctattaacctatatttgt

SEQ ID NO: 658598 - DNA, 25 bp, Homo sapien
aatagataccttgttttattctgtc

SEQ ID NO: 658599 - DNA, 25 bp, Homo sapien
atagataccttgttttattctgtct

SEQ ID NO: 658600 - DNA, 25 bp, Homo sapien
tagataccttgttttattctgtcta

SEQ ID NO: 658601 - DNA, 25 bp, Homo sapien
agataccttgttttattctgtctaa

SEQ ID NO: 658602 - DNA, 25 bp, Homo sapien
ctgtctaaacagatacactaggtgg

SEQ ID NO: 658603 - DNA, 25 bp, Homo sapien
tgtctaaacagatacactaggtggg

SEQ ID NO: 658604 - DNA, 25 bp, Homo sapien
aagattctcaacacaatatgtcact

SEQ ID NO: 658605 - DNA, 25 bp, Homo sapien
gattctcaacacaatatgtcactag

SEQ ID NO: 658606 - DNA, 25 bp, Homo sapien
tctcaacacaatatgtcactagaaa

SEQ ID NO: 658607 - DNA, 25 bp, Homo sapien
atatgtcactagaaaattgcaaatt

SEQ ID NO: 658608 - DNA, 25 bp, Homo sapien
caagataccagtatacacttattag

SEQ ID NO: 658609 - DNA, 25 bp, Homo sapien
atgagctaaaatccaaaatactaag

SEQ ID NO: 658610 - DNA, 25 bp, Homo sapien
aaaatactaagaacagcaaatgctg

SEQ ID NO: 658611 - DNA, 25 bp, Homo sapien
cagcaaatgctgatgaggttgtgga

SEQ ID NO: 658612 - DNA, 25 bp, Homo sapien
aatgcaaaatgatgcagccacttgg

SEQ ID NO: 658613 - DNA, 25 bp, Homo sapien
caaaatgatgcagccacttggaaga

SEQ ID NO: 658614 - DNA, 25 bp, Homo sapien
gtagatggcaaatgaacatatgaaa

SEQ ID NO: 658615 - DNA, 25 bp, Homo sapien
atgacaacatgtgcccgaaacttca

SEQ ID NO: 658616 - DNA, 25 bp, Homo sapien
gtgatcttgctctgcctccatttgc

SEQ ID NO: 658617 - DNA, 25 bp, Homo sapien
gggcatcatggaacctgctgacagt

SEQ ID NO: 658618 - DNA, 25 bp, Homo sapien
gcatcatggaacctgctgacagttg

SEQ ID NO: 658619 - DNA, 25 bp, Homo sapien
tggaacctgctgacagttgattcgt

SEQ ID NO: 658620 - DNA, 25 bp, Homo sapien
acctgctgacagttgattcgtgagc

SEQ ID NO: 658621 - DNA, 25 bp, Homo sapien
ctgacagttgattcgtgagccaagc

SEQ ID NO: 658622 - DNA, 25 bp, Homo sapien
acagttgattcgtgagccaagctcc

SEQ ID NO: 658623 - DNA, 25 bp, Homo sapien
gttgattcgtgagccaagctcccac

SEQ ID NO: 658624 - DNA, 25 bp, Homo sapien
cacttctcaattccatggccattaa

SEQ ID NO: 658625 - DNA, 25 bp, Homo sapien
acttctcaattccatggccattaaa

SEQ ID NO: 658626 - DNA, 25 bp, Homo sapien
gaagagcataattcctgatcagaag

SEQ ID NO: 658627 - DNA, 25 bp, Homo sapien
cctgatcagaagacagctgcaattt

SEQ ID NO: 658628 - DNA, 25 bp, Homo sapien
tgaaccattgaatgctaagcggact

SEQ ID NO: 658629 - DNA, 25 bp, Homo sapien
aatgctaagcggacttctagaaggt

SEQ ID NO: 658630 - DNA, 25 bp, Homo sapien
tgaacttaggatttcaaacctacca

SEQ ID NO: 658631 - DNA, 25 bp, Homo sapien
taccactgcatctctgcatgacatg

SEQ ID NO: 658632 - DNA, 25 bp, Homo sapien
gcatctctgcatgacatggtggaga

SEQ ID NO: 658633 - DNA, 25 bp, Homo sapien
tggtggagatctgccctatgaagac

SEQ ID NO: 658634 - DNA, 25 bp, Homo sapien
gagatctgccctatgaagaccccag

SEQ ID NO: 658635 - DNA, 25 bp, Homo sapien
gctggcagcccatctgtcttgagga

SEQ ID NO: 658636 - DNA, 25 bp, Homo sapien
agcccatctgtcttgaggactgttt

SEQ ID NO: 658637 - DNA, 25 bp, Homo sapien
ttgcggtgagccaacccaggaagcg

SEQ ID NO: 658638 - DNA, 25 bp, Homo sapien
tgcggtgagccaacccaggaagcgg

SEQ ID NO: 658639 - DNA, 25 bp, Homo sapien
gcggtgagccaacccaggaagcgga

SEQ ID NO: 658640 - DNA, 25 bp, Homo sapien
cggtgagccaacccaggaagcggag

SEQ ID NO: 658641 - DNA, 25 bp, Homo sapien
ggtgagccaacccaggaagcggagg

SEQ ID NO: 658642 - DNA, 25 bp, Homo sapien
gtgagccaacccaggaagcggaggt

SEQ ID NO: 658643 - DNA, 25 bp, Homo sapien
tgagccaacccaggaagcggaggtg

SEQ ID NO: 658644 - DNA, 25 bp, Homo sapien
gagccaacccaggaagcggaggtgc

SEQ ID NO: 658645 - DNA, 25 bp, Homo sapien
agccaacccaggaagcggaggtgca

SEQ ID NO: 658646 - DNA, 25 bp, Homo sapien
ccaacccaggaagcggaggtgcagt

SEQ ID NO: 658647 - DNA, 25 bp, Homo sapien
caacccaggaagcggaggtgcagtg

SEQ ID NO: 658648 - DNA, 25 bp, Homo sapien
ttctgcacattgtgacccatcactc

SEQ ID NO: 658649 - DNA, 25 bp, Homo sapien
tgccccacaatgcaacggaaacctt

SEQ ID NO: 658650 - DNA, 25 bp, Homo sapien
caatgcaacggaaaccttgcggagt

SEQ ID NO: 658651 - DNA, 25 bp, Homo sapien
caacggaaaccttgcggagtgctag

SEQ ID NO: 658652 - DNA, 25 bp, Homo sapien
aaaccttgcggagtgctaggcggaa

SEQ ID NO: 658653 - DNA, 25 bp, Homo sapien
aagctgcgaggcctgtgtagacact

SEQ ID NO: 658654 - DNA, 25 bp, Homo sapien
agctgcgaggcctgtgtagacactg

SEQ ID NO: 658655 - DNA, 25 bp, Homo sapien
gcagggctggcgcactcctccgagg

SEQ ID NO: 658656 - DNA, 25 bp, Homo sapien
gcactcctccgagggccgactgagg

SEQ ID NO: 658657 - DNA, 25 bp, Homo sapien
gcaaaataaaagttatcgcctgtgg

SEQ ID NO: 658658 - DNA, 25 bp, Homo sapien
taaaagttatcgcctgtgggccctg

SEQ ID NO: 658659 - DNA, 25 bp, Homo sapien
cagataggagttaggtatgagaaca

SEQ ID NO: 658660 - DNA, 25 bp, Homo sapien
gaaaacttggcgctgaccctgttat

SEQ ID NO: 658661 - DNA, 25 bp, Homo sapien
aaacttggcgctgaccctgttatag

SEQ ID NO: 658662 - DNA, 25 bp, Homo sapien
acttggcgctgaccctgttatagtg

SEQ ID NO: 658663 - DNA, 25 bp, Homo sapien
ttggcgctgaccctgttatagtggt

SEQ ID NO: 658664 - DNA, 25 bp, Homo sapien
ggcgctgaccctgttatagtggtta

SEQ ID NO: 658665 - DNA, 25 bp, Homo sapien
gcgctgaccctgttatagtggttat

SEQ ID NO: 658666 - DNA, 25 bp, Homo sapien
gctgaccctgttatagtggttatag

SEQ ID NO: 658667 - DNA, 25 bp, Homo sapien
atagtggttatagtggtgtccctaa

SEQ ID NO: 658668 - DNA, 25 bp, Homo sapien
agtggttatagtggtgtccctaaag

SEQ ID NO: 658669 - DNA, 25 bp, Homo sapien
gttatagtggtgtccctaaagggag

SEQ ID NO: 658670 - DNA, 25 bp, Homo sapien
atctgtgagcgctctgccaaaggtg

SEQ ID NO: 658671 - DNA, 25 bp, Homo sapien
agcgctctgccaaaggtgcaacttt

SEQ ID NO: 658672 - DNA, 25 bp, Homo sapien
aggtgcaactttttaatactatctt

SEQ ID NO: 658673 - DNA, 25 bp, Homo sapien
gggctaagttctaacacataaattt

SEQ ID NO: 658674 - DNA, 25 bp, Homo sapien
tttcatctccctgtaaaatgtgctg

SEQ ID NO: 658675 - DNA, 25 bp, Homo sapien
aatgtgctggccaatgactctcaac

SEQ ID NO: 658676 - DNA, 25 bp, Homo sapien
acatgaagcccacaccctgtgcttt

SEQ ID NO: 658677 - DNA, 25 bp, Homo sapien
tttaactcccaccagctgagctata

SEQ ID NO: 658678 - DNA, 25 bp, Homo sapien
tatacaagctatatgcttaccaggg

SEQ ID NO: 658679 - DNA, 25 bp, Homo sapien
gtccccaagcctgtttatggcaaca

SEQ ID NO: 658680 - DNA, 25 bp, Homo sapien
ggcaacagtcctttaattgtaacca

SEQ ID NO: 658681 - DNA, 25 bp, Homo sapien
aaataggaacggctctggtctacag

SEQ ID NO: 658682 - DNA, 25 bp, Homo sapien
atttccatctgagactggtgaaaat

SEQ ID NO: 658683 - DNA, 25 bp, Homo sapien
cttgggaatcactacttagaagata

SEQ ID NO: 658684 - DNA, 25 bp, Homo sapien
atgatcttcatttctaatcacttat

SEQ ID NO: 658685 - DNA, 25 bp, Homo sapien
catttctaatcacttataactgttg

SEQ ID NO: 658686 - DNA, 25 bp, Homo sapien
tttctatctagagcttatgtttaaa

SEQ ID NO: 658687 - DNA, 25 bp, Homo sapien
ctagagcttatgtttaaatctgttt

SEQ ID NO: 658688 - DNA, 25 bp, Homo sapien
aaaactgtagtttcctccacattga

SEQ ID NO: 658689 - DNA, 25 bp, Homo sapien
agtttcctccacattgaagaaaact

SEQ ID NO: 658690 - DNA, 25 bp, Homo sapien
cctaggacagccttttgggagagga

SEQ ID NO: 658691 - DNA, 25 bp, Homo sapien
acagccttttgggagaggagccaag

SEQ ID NO: 658692 - DNA, 25 bp, Homo sapien
caagaattagcccggtgcggtggca

SEQ ID NO: 658693 - DNA, 25 bp, Homo sapien
gtgcggtggcacacatccgtggtcc

SEQ ID NO: 658694 - DNA, 25 bp, Homo sapien
tgcggtggcacacatccgtggtccc

SEQ ID NO: 658695 - DNA, 25 bp, Homo sapien
gcggtggcacacatccgtggtccca

SEQ ID NO: 658696 - DNA, 25 bp, Homo sapien
cggtggcacacatccgtggtcccag

SEQ ID NO: 658697 - DNA, 25 bp, Homo sapien
acacatccgtggtcccagctgcaga

SEQ ID NO: 658698 - DNA, 25 bp, Homo sapien
cacatccgtggtcccagctgcagag

SEQ ID NO: 658699 - DNA, 25 bp, Homo sapien
catccgtggtcccagctgcagaggc

SEQ ID NO: 658700 - DNA, 25 bp, Homo sapien
ctgcagaggctgggataggagaatt

SEQ ID NO: 658701 - DNA, 25 bp, Homo sapien
tgcagaggctgggataggagaattg

SEQ ID NO: 658702 - DNA, 25 bp, Homo sapien
gcagaggctgggataggagaattgc

SEQ ID NO: 658703 - DNA, 25 bp, Homo sapien
aataattagaatgggctattctgaa

SEQ ID NO: 658704 - DNA, 25 bp, Homo sapien
tagaatgggctattctgaaagatat

SEQ ID NO: 658705 - DNA, 25 bp, Homo sapien
ttctgaaagatatagcattagttat

SEQ ID NO: 658706 - DNA, 25 bp, Homo sapien
ttgtgtttgagttttctattaacct

SEQ ID NO: 658707 - DNA, 25 bp, Homo sapien
gagttttctattaacctatatttgt

SEQ ID NO: 658708 - DNA, 25 bp, Homo sapien
aatagataccttgttttattctgtc

SEQ ID NO: 658709 - DNA, 25 bp, Homo sapien
atagataccttgttttattctgtct

SEQ ID NO: 658710 - DNA, 25 bp, Homo sapien
agataccttgttttattctgtctaa

SEQ ID NO: 658711 - DNA, 25 bp, Homo sapien
ccttgttttattctgtctaaacaga

SEQ ID NO: 658712 - DNA, 25 bp, Homo sapien
ctgtctaaacagatacactaggtgg

SEQ ID NO: 658713 - DNA, 25 bp, Homo sapien
tgtctaaacagatacactaggtggg

SEQ ID NO: 658714 - DNA, 25 bp, Homo sapien
aaaaattgtcttctagctaggcacg

SEQ ID NO: 658715 - DNA, 25 bp, Homo sapien
aaaattgtcttctagctaggcacgg

SEQ ID NO: 658716 - DNA, 25 bp, Homo sapien
aaattgtcttctagctaggcacggt

SEQ ID NO: 658717 - DNA, 25 bp, Homo sapien
aattgtcttctagctaggcacggtg

SEQ ID NO: 658718 - DNA, 25 bp, Homo sapien
attgtcttctagctaggcacggtgg

SEQ ID NO: 658719 - DNA, 25 bp, Homo sapien
ttgtcttctagctaggcacggtggc

SEQ ID NO: 658720 - DNA, 25 bp, Homo sapien
tgtcttctagctaggcacggtggct

SEQ ID NO: 658721 - DNA, 25 bp, Homo sapien
gtcttctagctaggcacggtggctc

SEQ ID NO: 658722 - DNA, 25 bp, Homo sapien
tcttctagctaggcacggtggctca

SEQ ID NO: 658723 - DNA, 25 bp, Homo sapien
ttgaatctgggaggtggagtttgcg

SEQ ID NO: 658724 - DNA, 25 bp, Homo sapien
tgaatctgggaggtggagtttgcgg

SEQ ID NO: 658725 - DNA, 25 bp, Homo sapien
atttccacagaagattaatcggtta

SEQ ID NO: 658726 - DNA, 25 bp, Homo sapien
taatcggttaatctcctcaagtcca

SEQ ID NO: 658727 - DNA, 25 bp, Homo sapien
atcggttaatctcctcaagtccatg

SEQ ID NO: 658728 - DNA, 25 bp, Homo sapien
cggttaatctcctcaagtccatggg

SEQ ID NO: 658729 - DNA, 25 bp, Homo sapien
tggaaactgctcatcgttttcttac

SEQ ID NO: 658730 - DNA, 25 bp, Homo sapien
gaaactgctcatcgttttcttactc

SEQ ID NO: 658731 - DNA, 25 bp, Homo sapien
actgctcatcgttttcttactctga

SEQ ID NO: 658732 - DNA, 25 bp, Homo sapien
gctcatcgttttcttactctgattt

SEQ ID NO: 658733 - DNA, 25 bp, Homo sapien
tcgttttcttactctgatttctttc

SEQ ID NO: 658734 - DNA, 25 bp, Homo sapien
tttctttctccctctgttgttgcaa

SEQ ID NO: 658735 - DNA, 25 bp, Homo sapien
ttctccctctgttgttgcaaagata

SEQ ID NO: 658736 - DNA, 25 bp, Homo sapien
cccttcgtgccttttgaggaagcag

SEQ ID NO: 658737 - DNA, 25 bp, Homo sapien
gcagccttggtcatggcccataaga

SEQ ID NO: 658738 - DNA, 25 bp, Homo sapien
atggcccataagaactcagacttca

SEQ ID NO: 658739 - DNA, 25 bp, Homo sapien
gaactcagacttcaactgaaaaaag

SEQ ID NO: 658740 - DNA, 25 bp, Homo sapien
gaaaaaagtggctcttccctacaca

SEQ ID NO: 658741 - DNA, 25 bp, Homo sapien
acaacagtccaggaagctggatatt

SEQ ID NO: 658742 - DNA, 25 bp, Homo sapien
gtgagacgagaactgacccatccat

SEQ ID NO: 658743 - DNA, 25 bp, Homo sapien
aactgacccatccataagctattct

SEQ ID NO: 658744 - DNA, 25 bp, Homo sapien
gacccatccataagctattctggat

SEQ ID NO: 658745 - DNA, 25 bp, Homo sapien
attctggattctctgtcactctcag

SEQ ID NO: 658746 - DNA, 25 bp, Homo sapien
ggattctctgtcactctcagccgtg

SEQ ID NO: 658747 - DNA, 25 bp, Homo sapien
gggacccgagcctctagaaatgagg

SEQ ID NO: 658748 - DNA, 25 bp, Homo sapien
gagggagaagacgactctgcctttc

SEQ ID NO: 658749 - DNA, 25 bp, Homo sapien
cgactctgcctttctgcaatttaga

SEQ ID NO: 658750 - DNA, 25 bp, Homo sapien
gcaatttagacgtcgcaaggatgaa

SEQ ID NO: 658751 - DNA, 25 bp, Homo sapien
gatgaaaacgatgcggacaggcttt

SEQ ID NO: 658752 - DNA, 25 bp, Homo sapien
atgcggacaggctttccagcagtga

SEQ ID NO: 658753 - DNA, 25 bp, Homo sapien
ggaaatctgcgtcacatgggcgaca

SEQ ID NO: 658754 - DNA, 25 bp, Homo sapien
atgggcgacagaaggtccctcgaat

SEQ ID NO: 658755 - DNA, 25 bp, Homo sapien
gtggcccgcaccactgtgtaataat

SEQ ID NO: 658756 - DNA, 25 bp, Homo sapien
gcaccactgtgtaataatctccaaa

SEQ ID NO: 658757 - DNA, 25 bp, Homo sapien
aataatctccaaaggttgcagtagg

SEQ ID NO: 658758 - DNA, 25 bp, Homo sapien
ggtggttccccgcatccggtgtccg

SEQ ID NO: 658759 - DNA, 25 bp, Homo sapien
tacctgcccttaaccgcgacctggg

SEQ ID NO: 658760 - DNA, 25 bp, Homo sapien
gggtcctcagaggtccagggaccca

SEQ ID NO: 658761 - DNA, 25 bp, Homo sapien
gtccctttcaaattgggaccaccag

SEQ ID NO: 658762 - DNA, 25 bp, Homo sapien
tttcaaattgggaccaccaggcagg

SEQ ID NO: 658763 - DNA, 25 bp, Homo sapien
aaattgggaccaccaggcaggaatc

SEQ ID NO: 658764 - DNA, 25 bp, Homo sapien
ttgggaccaccaggcaggaatcagg

SEQ ID NO: 658765 - DNA, 25 bp, Homo sapien
gaccaccaggcaggaatcaggcgca

SEQ ID NO: 658766 - DNA, 25 bp, Homo sapien
caccaggcaggaatcaggcgcacgg

SEQ ID NO: 658767 - DNA, 25 bp, Homo sapien
ggaatcaggcgcacgggttcctcct

SEQ ID NO: 658768 - DNA, 25 bp, Homo sapien
ttcctgtggcactccaagtgggaag

SEQ ID NO: 658769 - DNA, 25 bp, Homo sapien
aagatgaaaagtccatgccatgttt

SEQ ID NO: 658770 - DNA, 25 bp, Homo sapien
gtgtgatttccagtaaagtctccag

SEQ ID NO: 658771 - DNA, 25 bp, Homo sapien
agtctccagaaatcaaagcctagtt

SEQ ID NO: 658772 - DNA, 25 bp, Homo sapien
gggtttagatccagattttgccata

SEQ ID NO: 658773 - DNA, 25 bp, Homo sapien
gattttgccataggtgcttgctgtg

SEQ ID NO: 658774 - DNA, 25 bp, Homo sapien
tgcttgctgtgtgccctcaagggaa

SEQ ID NO: 658775 - DNA, 25 bp, Homo sapien
acctcacttgctccctttgaaatga

SEQ ID NO: 658776 - DNA, 25 bp, Homo sapien
gcatttaatagcaccggagccctag

SEQ ID NO: 658777 - DNA, 25 bp, Homo sapien
gagccctagggctgctgccgcaaaa

SEQ ID NO: 658778 - DNA, 25 bp, Homo sapien
gagctggcaaagtggcttcgtgatt

SEQ ID NO: 658779 - DNA, 25 bp, Homo sapien
agtggcttcgtgattgtccttaaca

SEQ ID NO: 658780 - DNA, 25 bp, Homo sapien
atattttgatagtattgcctggaga

SEQ ID NO: 658781 - DNA, 25 bp, Homo sapien
tttgatagtattgcctggagaaaaa

SEQ ID NO: 658782 - DNA, 25 bp, Homo sapien
tggaaaacactgcatattatacccc

SEQ ID NO: 658783 - DNA, 25 bp, Homo sapien
gcccagtcacaatgaatgttaaaga

SEQ ID NO: 658784 - DNA, 25 bp, Homo sapien
agacttgagacgtcttcaaaacttg

SEQ ID NO: 658785 - DNA, 25 bp, Homo sapien
ttgagacgtcttcaaaacttgtttt

SEQ ID NO: 658786 - DNA, 25 bp, Homo sapien
tcaacagtaaatctttttggcccct

SEQ ID NO: 658787 - DNA, 25 bp, Homo sapien
ttttggcccctcaatgtatccatta

SEQ ID NO: 658788 - DNA, 25 bp, Homo sapien
atgtatccattaacatttccaggga

SEQ ID NO: 658789 - DNA, 25 bp, Homo sapien
aacatttccagggataccagtgaaa

SEQ ID NO: 658790 - DNA, 25 bp, Homo sapien
tttccagggataccagtgaaataat

SEQ ID NO: 658791 - DNA, 25 bp, Homo sapien
ttgctttaagccctggttttcaaat

SEQ ID NO: 658792 - DNA, 25 bp, Homo sapien
taagccctggttttcaaattaatga

SEQ ID NO: 658793 - DNA, 25 bp, Homo sapien
gttgatgagggtgaactttgagcat

SEQ ID NO: 658794 - DNA, 25 bp, Homo sapien
gaactttgagcattaatagaccttg

SEQ ID NO: 658795 - DNA, 25 bp, Homo sapien
ttaatagaccttggagcctttccct

SEQ ID NO: 658796 - DNA, 25 bp, Homo sapien
aatagaccttggagcctttccctat

SEQ ID NO: 658797 - DNA, 25 bp, Homo sapien
ccttggagcctttccctatgtgact

SEQ ID NO: 658798 - DNA, 25 bp, Homo sapien
tcattttgagctcttgctgtttgga

SEQ ID NO: 658799 - DNA, 25 bp, Homo sapien
tttaatgacatttctcctttccagg

SEQ ID NO: 658800 - DNA, 25 bp, Homo sapien
aatgacatttctcctttccaggacg

SEQ ID NO: 658801 - DNA, 25 bp, Homo sapien
tttctcctttccaggacgctgccaa

SEQ ID NO: 658802 - DNA, 25 bp, Homo sapien
agctggaggactccttcaccgagca

SEQ ID NO: 658803 - DNA, 25 bp, Homo sapien
gactccttcaccgagcaggtgcaat

SEQ ID NO: 658804 - DNA, 25 bp, Homo sapien
gagcaggtgcaatccctggccaagt

SEQ ID NO: 658805 - DNA, 25 bp, Homo sapien
aggtgcaatccctggccaagtccat

SEQ ID NO: 658806 - DNA, 25 bp, Homo sapien
tggccaagtccatcgacgacgcgct

SEQ ID NO: 658807 - DNA, 25 bp, Homo sapien
atcgacgacgcgctcagcacgtgga

SEQ ID NO: 658808 - DNA, 25 bp, Homo sapien
acgcgctcagcacgtggagcctcaa

SEQ ID NO: 658809 - DNA, 25 bp, Homo sapien
cgtggagcctcaagaccatgtgctc

SEQ ID NO: 658810 - DNA, 25 bp, Homo sapien
aagaccatgtgctccctgcgggaga

SEQ ID NO: 658811 - DNA, 25 bp, Homo sapien
gagaaaatccgcaactcgcttctgg

SEQ ID NO: 658812 - DNA, 25 bp, Homo sapien
aaaatccgcaactcgcttctggaga

SEQ ID NO: 658813 - DNA, 25 bp, Homo sapien
gagacatgggcctcggtgtgccttt

SEQ ID NO: 658814 - DNA, 25 bp, Homo sapien
gtgtgcctttcaacatcgccagcta

SEQ ID NO: 658815 - DNA, 25 bp, Homo sapien
tacgccctgctcacgtacatgattg

SEQ ID NO: 658816 - DNA, 25 bp, Homo sapien
gctcacgtacatgattgcgcacatc

SEQ ID NO: 658817 - DNA, 25 bp, Homo sapien
gattgcgcacatcacgggcctgaag

SEQ ID NO: 658818 - DNA, 25 bp, Homo sapien
tgaagccaggtgactttatacacac

SEQ ID NO: 658819 - DNA, 25 bp, Homo sapien
tacacactttgggagatgcacatat

SEQ ID NO: 658820 - DNA, 25 bp, Homo sapien
gggagatgcacatatttacctgaat

SEQ ID NO: 658821 - DNA, 25 bp, Homo sapien
ttacctgaatcacatcgagccactg

SEQ ID NO: 658822 - DNA, 25 bp, Homo sapien
caaagctcaggattcttcgaaaagt

SEQ ID NO: 658823 - DNA, 25 bp, Homo sapien
tgaagggtacaatccgcatccaact

SEQ ID NO: 658824 - DNA, 25 bp, Homo sapien
aagtcccgaggaacatacttggaga

SEQ ID NO: 658825 - DNA, 25 bp, Homo sapien
ttggagagagctaactgcttcccgc

SEQ ID NO: 658826 - DNA, 25 bp, Homo sapien
ggccgagctggcagtgtttatttac

SEQ ID NO: 658827 - DNA, 25 bp, Homo sapien
ttactatgctgtgtggaagcctcag

SEQ ID NO: 658828 - DNA, 25 bp, Homo sapien
gaagcctcagaaacagtggatcacg

SEQ ID NO: 658829 - DNA, 25 bp, Homo sapien
gaaacagtggatcacgttggacaca

SEQ ID NO: 658830 - DNA, 25 bp, Homo sapien
acgttggacacaggcatcttggaga

SEQ ID NO: 658831 - DNA, 25 bp, Homo sapien
gcatcttggagagtccctttatcta

SEQ ID NO: 658832 - DNA, 25 bp, Homo sapien
tttatctacagtcctgagaagaggg

SEQ ID NO: 658833 - DNA, 25 bp, Homo sapien
ggaagcctggaggtttatctcatac

SEQ ID NO: 658834 - DNA, 25 bp, Homo sapien
ggtttatctcatacatgctggtaca

SEQ ID NO: 658835 - DNA, 25 bp, Homo sapien
gatcatgccgcggtttggttttcag

SEQ ID NO: 658836 - DNA, 25 bp, Homo sapien
atcatgccgcggtttggttttcaga

SEQ ID NO: 658837 - DNA, 25 bp, Homo sapien
tgccgcggtttggttttcagatagg

SEQ ID NO: 658838 - DNA, 25 bp, Homo sapien
gagagaaaacttggcgctgaccctg

SEQ ID NO: 658839 - DNA, 25 bp, Homo sapien
aaaacttggcgctgaccctgttata

SEQ ID NO: 658840 - DNA, 25 bp, Homo sapien
ggcgctgaccctgttatagtggtta

SEQ ID NO: 658841 - DNA, 25 bp, Homo sapien
atagtggttatagtggtgtccctaa

SEQ ID NO: 658842 - DNA, 25 bp, Homo sapien
gttatagtggtgtccctaaagggag

SEQ ID NO: 658843 - DNA, 25 bp, Homo sapien
aggaatcccaatttgcctccactta

SEQ ID NO: 658844 - DNA, 25 bp, Homo sapien
ttgcctccacttagtgagcggaaga

SEQ ID NO: 658845 - DNA, 25 bp, Homo sapien
gcggaagaatgtgctacagttgaaa

SEQ ID NO: 658846 - DNA, 25 bp, Homo sapien
gtatactatgtacactattcaggtg

SEQ ID NO: 658847 - DNA, 25 bp, Homo sapien
aaatttcagatttcaccagtatata

SEQ ID NO: 658848 - DNA, 25 bp, Homo sapien
tttcaccagtatataattcatccat

SEQ ID NO: 658849 - DNA, 25 bp, Homo sapien
gtatataattcatccatataaccag

SEQ ID NO: 658850 - DNA, 25 bp, Homo sapien
tataaccagaaaccacttgtacacc

SEQ ID NO: 658851 - DNA, 25 bp, Homo sapien
aataaaaatcccacatatattaggg

SEQ ID NO: 658852 - DNA, 25 bp, Homo sapien
gggagtataattcacactctctatg

SEQ ID NO: 658853 - DNA, 25 bp, Homo sapien
ataattcacactctctatgaagtaa

SEQ ID NO: 658854 - DNA, 25 bp, Homo sapien
caaccctaccactgtgatttaacct

SEQ ID NO: 658855 - DNA, 25 bp, Homo sapien
tgtgatttaacctaattccccaagc

SEQ ID NO: 658856 - DNA, 25 bp, Homo sapien
gatttaacctaattccccaagcatc

SEQ ID NO: 658857 - DNA, 25 bp, Homo sapien
gctgccttcatcacttacctgcagg

SEQ ID NO: 658858 - DNA, 25 bp, Homo sapien
tcatcacttacctgcaggccaagca

SEQ ID NO: 658859 - DNA, 25 bp, Homo sapien
gcaggcggcagggatcatcaacgtt

SEQ ID NO: 658860 - DNA, 25 bp, Homo sapien
ggatcatcaacgttcccaaccctgg

SEQ ID NO: 658861 - DNA, 25 bp, Homo sapien
gatcttcccgccctgtgagttctct

SEQ ID NO: 658862 - DNA, 25 bp, Homo sapien
gtgagttctctgagagtcacctgtc

SEQ ID NO: 658863 - DNA, 25 bp, Homo sapien
acctcatgattgtcattgcctccgt

SEQ ID NO: 658864 - DNA, 25 bp, Homo sapien
tcattgcctccgtgtgagccactga

SEQ ID NO: 658865 - DNA, 25 bp, Homo sapien
gagccactgagtggttatcacctca

SEQ ID NO: 658866 - DNA, 25 bp, Homo sapien
ttatcacctcagtgaatcttcccag

SEQ ID NO: 658867 - DNA, 25 bp, Homo sapien
ccagggctctgcagtaaaaacaaag

SEQ ID NO: 658868 - DNA, 25 bp, Homo sapien
tccgagccatccagtgtatgaaact

SEQ ID NO: 658869 - DNA, 25 bp, Homo sapien
gccatccagtgtatgaaacttcacc

SEQ ID NO: 658870 - DNA, 25 bp, Homo sapien
agctccttattctctgtcagacctt

SEQ ID NO: 658871 - DNA, 25 bp, Homo sapien
attctctgtcagaccttattcttgg

SEQ ID NO: 658872 - DNA, 25 bp, Homo sapien
accttattcttggaggcggagccca

SEQ ID NO: 658873 - DNA, 25 bp, Homo sapien
cttggaggcggagcccactcactat

SEQ ID NO: 658874 - DNA, 25 bp, Homo sapien
tccctgccttaggtctagcctgtta

SEQ ID NO: 658875 - DNA, 25 bp, Homo sapien
aggtctagcctgttacctctgaact

SEQ ID NO: 658876 - DNA, 25 bp, Homo sapien
tctgaactccccaagcagcattaat

SEQ ID NO: 658877 - DNA, 25 bp, Homo sapien
tccccaagcagcattaattttactt

SEQ ID NO: 658878 - DNA, 25 bp, Homo sapien
gtatgacactatgtactactaattt

SEQ ID NO: 658879 - DNA, 25 bp, Homo sapien
gctgagagtgcttctttactatatc

SEQ ID NO: 658880 - DNA, 25 bp, Homo sapien
gcttctttactatatcactgccttc

SEQ ID NO: 658881 - DNA, 25 bp, Homo sapien
ttctttactatatcactgccttctt

SEQ ID NO: 658882 - DNA, 25 bp, Homo sapien
taaaaatcacctgcaggcctacttt

SEQ ID NO: 658883 - DNA, 25 bp, Homo sapien
tcacctgcaggcctactttccagaa

SEQ ID NO: 658884 - DNA, 25 bp, Homo sapien
actttccagaagtaactcttgttat

SEQ ID NO: 658885 - DNA, 25 bp, Homo sapien
gaagtaactcttgttattaacattt

SEQ ID NO: 658886 - DNA, 25 bp, Homo sapien
tttactttttcccagtccgtctatg

SEQ ID NO: 658887 - DNA, 25 bp, Homo sapien
tttcccagtccgtctatgtgtctat

SEQ ID NO: 658888 - DNA, 25 bp, Homo sapien
ccagtccgtctatgtgtctattaca

SEQ ID NO: 658889 - DNA, 25 bp, Homo sapien
tgtgtctattacagggaaagaatcc

SEQ ID NO: 658890 - DNA, 25 bp, Homo sapien
aatgtagataaccacctctgcctta

SEQ ID NO: 658891 - DNA, 25 bp, Homo sapien
ctctgccttatcacattggaaaatt

SEQ ID NO: 658892 - DNA, 25 bp, Homo sapien
attggaaaattatggctgagctatg

SEQ ID NO: 658893 - DNA, 25 bp, Homo sapien
tgagctatgccaggattttgtgaag

SEQ ID NO: 658894 - DNA, 25 bp, Homo sapien
ggcagaagacaaaagagcctggctt

SEQ ID NO: 658895 - DNA, 25 bp, Homo sapien
gagcctggcttaaagatgtatagac

SEQ ID NO: 658896 - DNA, 25 bp, Homo sapien
gatgtatagacccaccaattccact

SEQ ID NO: 658897 - DNA, 25 bp, Homo sapien
tccactcctatttctaaacccaaag

SEQ ID NO: 658898 - DNA, 25 bp, Homo sapien
gtatgtccataattgcccaaacttg

SEQ ID NO: 658899 - DNA, 25 bp, Homo sapien
taattgcccaaacttgaatcaactg

SEQ ID NO: 658900 - DNA, 25 bp, Homo sapien
gaatcaactgaatgtccagcaatag

SEQ ID NO: 658901 - DNA, 25 bp, Homo sapien
gaaaactttgttattgacactggat

SEQ ID NO: 658902 - DNA, 25 bp, Homo sapien
ctttgttattgacactggattctcc

SEQ ID NO: 658903 - DNA, 25 bp, Homo sapien
actggattctcctagattttgcttt

SEQ ID NO: 658904 - DNA, 25 bp, Homo sapien
gattctcctagattttgctttattt

SEQ ID NO: 658905 - DNA, 25 bp, Homo sapien
gctttattttacatcctcattccag

SEQ ID NO: 658906 - DNA, 25 bp, Homo sapien
cagaggccagaaaagactacttatt

SEQ ID NO: 658907 - DNA, 25 bp, Homo sapien
aaagactacttattctcagatgtgt

SEQ ID NO: 658908 - DNA, 25 bp, Homo sapien
gactacttattctcagatgtgtaaa

SEQ ID NO: 658909 - DNA, 25 bp, Homo sapien
gtgtaaatatagataagtccttctg

SEQ ID NO: 658910 - DNA, 25 bp, Homo sapien
tatagataagtccttctgtttcttc

SEQ ID NO: 658911 - DNA, 25 bp, Homo sapien
aagtttttaaatgcatagcatggaa

SEQ ID NO: 658912 - DNA, 25 bp, Homo sapien
gctaggtgtggccaccttctagcct

SEQ ID NO: 658913 - DNA, 25 bp, Homo sapien
tagcctcctggtgagcttgtttagc

SEQ ID NO: 658914 - DNA, 25 bp, Homo sapien
tttagctaccaaaacactctgtgcc

SEQ ID NO: 658915 - DNA, 25 bp, Homo sapien
ctccgtttctgcatctgcagagtgg

SEQ ID NO: 658916 - DNA, 25 bp, Homo sapien
tatacctacctactgggtttgccgt

SEQ ID NO: 658917 - DNA, 25 bp, Homo sapien
ggtttgccgtaaagacgaacagcct

SEQ ID NO: 658918 - DNA, 25 bp, Homo sapien
gacgaacagcctgcagatgaagtgt

SEQ ID NO: 658919 - DNA, 25 bp, Homo sapien
cccagggcttggtgcatggtaaaca

SEQ ID NO: 658920 - DNA, 25 bp, Homo sapien
aaacttggagtcacattcttgcatg

SEQ ID NO: 658921 - DNA, 25 bp, Homo sapien
ggagtcacattcttgcatgcaacac

SEQ ID NO: 658922 - DNA, 25 bp, Homo sapien
tgcaacacagcaaagggaggcagtt

SEQ ID NO: 658923 - DNA, 25 bp, Homo sapien
tatcttcctcgaatatcaacagaga

SEQ ID NO: 658924 - DNA, 25 bp, Homo sapien
gagaagaacagcagccacgtggata

SEQ ID NO: 658925 - DNA, 25 bp, Homo sapien
cagccacgtggataaggcagagttt

SEQ ID NO: 658926 - DNA, 25 bp, Homo sapien
atcctggattcccttatcataaagc

SEQ ID NO: 658927 - DNA, 25 bp, Homo sapien
tacagtaacctcagaaatgcagaag

SEQ ID NO: 658928 - DNA, 25 bp, Homo sapien
agttacttgtaatggtgctgtagac

SEQ ID NO: 658929 - DNA, 25 bp, Homo sapien
ggtgctgtagacactgtacgagaaa

SEQ ID NO: 658930 - DNA, 25 bp, Homo sapien
gacactgtacgagaaagtttcacct

SEQ ID NO: 658931 - DNA, 25 bp, Homo sapien
gaaagtttcacctttatgatctaat

SEQ ID NO: 658932 - DNA, 25 bp, Homo sapien
ggaattctgcaacttacagtcaaag

SEQ ID NO: 658933 - DNA, 25 bp, Homo sapien
aataaacaggagcatctgtggtttg

SEQ ID NO: 658934 - DNA, 25 bp, Homo sapien
agaaaaatctgcctactttccagaa

SEQ ID NO: 658935 - DNA, 25 bp, Homo sapien
ctactttccagaagtgggcatacaa

SEQ ID NO: 658936 - DNA, 25 bp, Homo sapien
gactatatcaatctaaagtgctact

SEQ ID NO: 658937 - DNA, 25 bp, Homo sapien
aagtgctacttcttgaaacagaggt

SEQ ID NO: 658938 - DNA, 25 bp, Homo sapien
cagaggtagtgttattcaggcaaaa

SEQ ID NO: 658939 - DNA, 25 bp, Homo sapien
caggcaaaaagcatacatcccatat

SEQ ID NO: 658940 - DNA, 25 bp, Homo sapien
atatgtgttaatgctttctctctca

SEQ ID NO: 658941 - DNA, 25 bp, Homo sapien
actattttagtcatatcctctttgg

SEQ ID NO: 658942 - DNA, 25 bp, Homo sapien
atatcctctttggtacctatcattc

SEQ ID NO: 658943 - DNA, 25 bp, Homo sapien
aaatgcagctcctcagctgtcattt

SEQ ID NO: 658944 - DNA, 25 bp, Homo sapien
gctcctcagctgtcatttcagactt

SEQ ID NO: 658945 - DNA, 25 bp, Homo sapien
actctcgattctatttgctgttctg

SEQ ID NO: 658946 - DNA, 25 bp, Homo sapien
ttgctgttctgctactgatttacta

SEQ ID NO: 658947 - DNA, 25 bp, Homo sapien
gctactgatttactatgagatctgt

SEQ ID NO: 658948 - DNA, 25 bp, Homo sapien
ttgtaacttagatttccgtctgtaa

SEQ ID NO: 658949 - DNA, 25 bp, Homo sapien
ggaaatgacccaacatatgtgattt

SEQ ID NO: 658950 - DNA, 25 bp, Homo sapien
atcctagggcagtgattgcatttgc

SEQ ID NO: 658951 - DNA, 25 bp, Homo sapien
gaaattcggaagcacacttcaagga

SEQ ID NO: 658952 - DNA, 25 bp, Homo sapien
ggaactaagttcagtgataatcaca

SEQ ID NO: 658953 - DNA, 25 bp, Homo sapien
gattgattttcagtactgtcacagt

SEQ ID NO: 658954 - DNA, 25 bp, Homo sapien
gtactgtcacagtttgagaactatt

SEQ ID NO: 658955 - DNA, 25 bp, Homo sapien
cagtttgagaactatttattgccct

SEQ ID NO: 658956 - DNA, 25 bp, Homo sapien
gctggtacatgctgggtaagcaatg

SEQ ID NO: 658957 - DNA, 25 bp, Homo sapien
ctggtacatgctgggtaagcaatga

SEQ ID NO: 658958 - DNA, 25 bp, Homo sapien
ggtacatgctgggtaagcaatgata

SEQ ID NO: 658959 - DNA, 25 bp, Homo sapien
gtacatgctgggtaagcaatgatag

SEQ ID NO: 658960 - DNA, 25 bp, Homo sapien
tacatgctgggtaagcaatgatagt

SEQ ID NO: 658961 - DNA, 25 bp, Homo sapien
acatgctgggtaagcaatgatagtt

SEQ ID NO: 658962 - DNA, 25 bp, Homo sapien
catgctgggtaagcaatgatagtta

SEQ ID NO: 658963 - DNA, 25 bp, Homo sapien
atgctgggtaagcaatgatagttaa

SEQ ID NO: 658964 - DNA, 25 bp, Homo sapien
gctgggtaagcaatgatagttaagc

SEQ ID NO: 658965 - DNA, 25 bp, Homo sapien
ctgggtaagcaatgatagttaagcc

SEQ ID NO: 658966 - DNA, 25 bp, Homo sapien
tgggtaagcaatgatagttaagccc

SEQ ID NO: 658967 - DNA, 25 bp, Homo sapien
aagggtagttagtgactcgaacagg

SEQ ID NO: 658968 - DNA, 25 bp, Homo sapien
tagttagtgactcgaacagggaaac

SEQ ID NO: 658969 - DNA, 25 bp, Homo sapien
gtgactcgaacagggaaacgatcct

SEQ ID NO: 658970 - DNA, 25 bp, Homo sapien
ggaaacgatcctgagtatgagggtt

SEQ ID NO: 658971 - DNA, 25 bp, Homo sapien
tatgagggttgtgctaatcatcccc

SEQ ID NO: 658972 - DNA, 25 bp, Homo sapien
ctcctgccagctgcgtacggaatgg

SEQ ID NO: 658973 - DNA, 25 bp, Homo sapien
atggcagggagctggctcgtttctc

SEQ ID NO: 658974 - DNA, 25 bp, Homo sapien
ctctttaagagctgccttttacttt

SEQ ID NO: 658975 - DNA, 25 bp, Homo sapien
tttaagagctgccttttacttttct

SEQ ID NO: 658976 - DNA, 25 bp, Homo sapien
aaacttatttcctggccggacgcag

SEQ ID NO: 658977 - DNA, 25 bp, Homo sapien
aacttatttcctggccggacgcagt

SEQ ID NO: 658978 - DNA, 25 bp, Homo sapien
aggctgtgctggacctggcttcatt

SEQ ID NO: 658979 - DNA, 25 bp, Homo sapien
ttcatttctgctccaggatggcagg

SEQ ID NO: 658980 - DNA, 25 bp, Homo sapien
tcttcatggctgcatgaccagcctg

SEQ ID NO: 658981 - DNA, 25 bp, Homo sapien
taggtgtacactgggagccgtgcca

SEQ ID NO: 658982 - DNA, 25 bp, Homo sapien
actgggagccgtgccatgtttcagg

SEQ ID NO: 658983 - DNA, 25 bp, Homo sapien
tgccatgtttcaggccctgtcctgg

SEQ ID NO: 658984 - DNA, 25 bp, Homo sapien
gggtgcgggaccttggtcctccaca

SEQ ID NO: 658985 - DNA, 25 bp, Homo sapien
tgggttgagattcacatgtgctcct

SEQ ID NO: 658986 - DNA, 25 bp, Homo sapien
acatgtgctccttacgaccacgggt

SEQ ID NO: 658987 - DNA, 25 bp, Homo sapien
acccttcgctgtgtgcatattcgtg

SEQ ID NO: 658988 - DNA, 25 bp, Homo sapien
gtgcatattcgtgtgcttatgagtt

SEQ ID NO: 658989 - DNA, 25 bp, Homo sapien
atccccaaatcaccgatgggtcctt

SEQ ID NO: 658990 - DNA, 25 bp, Homo sapien
gagaagcatatctctcgaccacctc

SEQ ID NO: 658991 - DNA, 25 bp, Homo sapien
cgaccccccaaatcgtgatagttga

SEQ ID NO: 658992 - DNA, 25 bp, Homo sapien
tgtgtttttcaacctccaacgttca

SEQ ID NO: 658993 - DNA, 25 bp, Homo sapien
ttcaacctccaacgttcaagtcaag

SEQ ID NO: 658994 - DNA, 25 bp, Homo sapien
ttcaagtcaaggaaccgctgataag

SEQ ID NO: 658995 - DNA, 25 bp, Homo sapien
aatggcaatggcctagcttttattt

SEQ ID NO: 658996 - DNA, 25 bp, Homo sapien
ggcaatggcctagcttttattttag

SEQ ID NO: 658997 - DNA, 25 bp, Homo sapien
aagttgttcagtttttggcacaggg

SEQ ID NO: 658998 - DNA, 25 bp, Homo sapien
tcagtttttggcacagggtcgggac

SEQ ID NO: 658999 - DNA, 25 bp, Homo sapien
gtcgggaccctgagtattgagctct

SEQ ID NO: 659000 - DNA, 25 bp, Homo sapien
taatgagatgccttccatcctgtaa

SEQ ID NO: 659001 - DNA, 25 bp, Homo sapien
atgccttccatcctgtaagtttcaa

SEQ ID NO: 659002 - DNA, 25 bp, Homo sapien
tgtaagtttcaacattgtcatctca

SEQ ID NO: 659003 - DNA, 25 bp, Homo sapien
agataatgatggaccgtttcttacc

SEQ ID NO: 659004 - DNA, 25 bp, Homo sapien
tgatggaccgtttcttaccaaatat

SEQ ID NO: 659005 - DNA, 25 bp, Homo sapien
aattaactcacgaagcttggcctgt

SEQ ID NO: 659006 - DNA, 25 bp, Homo sapien
gaagcttggcctgttcagtcagtat

SEQ ID NO: 659007 - DNA, 25 bp, Homo sapien
ggcctgttcagtcagtatagacact

SEQ ID NO: 659008 - DNA, 25 bp, Homo sapien
tatagacactatgttccggtgcctt

SEQ ID NO: 659009 - DNA, 25 bp, Homo sapien
tccggtgccttggatgtgattagca

SEQ ID NO: 659010 - DNA, 25 bp, Homo sapien
gattagcaagatgtgattcctttaa

SEQ ID NO: 659011 - DNA, 25 bp, Homo sapien
acatgagaaatgaagcttctcacat

SEQ ID NO: 659012 - DNA, 25 bp, Homo sapien
aagcttctcacatcgttgttgggga

SEQ ID NO: 659013 - DNA, 25 bp, Homo sapien
atgacggactgtagttgatgggtta

SEQ ID NO: 659014 - DNA, 25 bp, Homo sapien
actgtagttgatgggttagcggaat

SEQ ID NO: 659015 - DNA, 25 bp, Homo sapien
gttgatgggttagcggaatttcaaa

SEQ ID NO: 659016 - DNA, 25 bp, Homo sapien
agttgaatgcagtcctagtgggaat

SEQ ID NO: 659017 - DNA, 25 bp, Homo sapien
cagtcctagtgggaatctgcctcag

SEQ ID NO: 659018 - DNA, 25 bp, Homo sapien
gtcctagtgggaatctgcctcagga

SEQ ID NO: 659019 - DNA, 25 bp, Homo sapien
tagtgggaatctgcctcaggaagat

SEQ ID NO: 659020 - DNA, 25 bp, Homo sapien
gggaatctgcctcaggaagatgatt

SEQ ID NO: 659021 - DNA, 25 bp, Homo sapien
ctgcctcaggaagatgattgtagtt

SEQ ID NO: 659022 - DNA, 25 bp, Homo sapien
gggaatgctggccaggacgcagagt

SEQ ID NO: 659023 - DNA, 25 bp, Homo sapien
aggacgcagagtgtggccgtgctgt

SEQ ID NO: 659024 - DNA, 25 bp, Homo sapien
tcgggccccaagagtgtctgctggc

SEQ ID NO: 659025 - DNA, 25 bp, Homo sapien
gtctgctggccactcgctgtggcca

SEQ ID NO: 659026 - DNA, 25 bp, Homo sapien
ccagcggctctgctcttggatgagc

SEQ ID NO: 659027 - DNA, 25 bp, Homo sapien
ggaaggagtagtgcatttcagtctc

SEQ ID NO: 659028 - DNA, 25 bp, Homo sapien
atttcagtctcatcgtaggggctgg

SEQ ID NO: 659029 - DNA, 25 bp, Homo sapien
gggctcctggctgggaggcgccaag

SEQ ID NO: 659030 - DNA, 25 bp, Homo sapien
gtggagggaatgatatcttttcaac

SEQ ID NO: 659031 - DNA, 25 bp, Homo sapien
gggaatgatatcttttcaacaagtg

SEQ ID NO: 659032 - DNA, 25 bp, Homo sapien
gtggaattcacgttaataaatcaaa

SEQ ID NO: 659033 - DNA, 25 bp, Homo sapien
atagtaaagtgcacgttttctacct

SEQ ID NO: 659034 - DNA, 25 bp, Homo sapien
tagtaaagtgcacgttttctacctt

SEQ ID NO: 659035 - DNA, 25 bp, Homo sapien
ctttctgactcttctgggtacttga

SEQ ID NO: 659036 - DNA, 25 bp, Homo sapien
ttctgactcttctgggtacttgaca

SEQ ID NO: 659037 - DNA, 25 bp, Homo sapien
tctgactcttctgggtacttgacat

SEQ ID NO: 659038 - DNA, 25 bp, Homo sapien
gggtacttgacatttccaaatcaat

SEQ ID NO: 659039 - DNA, 25 bp, Homo sapien
ttagaatcagattgtcaagtgcaac

SEQ ID NO: 659040 - DNA, 25 bp, Homo sapien
gaatcagattgtcaagtgcaacaaa

SEQ ID NO: 659041 - DNA, 25 bp, Homo sapien
aaatggttgggatttttattatgat

SEQ ID NO: 659042 - DNA, 25 bp, Homo sapien
ttaaaagtgacatcttgggccgggt

SEQ ID NO: 659043 - DNA, 25 bp, Homo sapien
aaagtgacatcttgggccgggtgca

SEQ ID NO: 659044 - DNA, 25 bp, Homo sapien
gtccataatcaaatgggtctccttc

SEQ ID NO: 659045 - DNA, 25 bp, Homo sapien
gtctccttcctagccagtaatactg

SEQ ID NO: 659046 - DNA, 25 bp, Homo sapien
gcagacaaacgagagttccagcaaa

SEQ ID NO: 659047 - DNA, 25 bp, Homo sapien
gttccagcaaacgtcatcgtaatga

SEQ ID NO: 659048 - DNA, 25 bp, Homo sapien
gaagagatcccatccttcatggtca

SEQ ID NO: 659049 - DNA, 25 bp, Homo sapien
atccttcatggtcacactcacagca

SEQ ID NO: 659050 - DNA, 25 bp, Homo sapien
cacagcaatatttcatctactcctc

SEQ ID NO: 659051 - DNA, 25 bp, Homo sapien
tctccttcatctgttgtctgtcttt

SEQ ID NO: 659052 - DNA, 25 bp, Homo sapien
tccttcaaccttcctgtttttgaat

SEQ ID NO: 659053 - DNA, 25 bp, Homo sapien
ataatagctctatgtctccttcact

SEQ ID NO: 659054 - DNA, 25 bp, Homo sapien
tctatgtctccttcactctatataa

SEQ ID NO: 659055 - DNA, 25 bp, Homo sapien
gggttcaggatattcttctgcttca

SEQ ID NO: 659056 - DNA, 25 bp, Homo sapien
ggttcaggatattcttctgcttcag

SEQ ID NO: 659057 - DNA, 25 bp, Homo sapien
accaccgtgcctggcagttatgtgt

SEQ ID NO: 659058 - DNA, 25 bp, Homo sapien
cagttatgtgtgtttccctacaatc

SEQ ID NO: 659059 - DNA, 25 bp, Homo sapien
agttatgtgtgtttccctacaatca

SEQ ID NO: 659060 - DNA, 25 bp, Homo sapien
gtgtgtttccctacaatcaaacaat

SEQ ID NO: 659061 - DNA, 25 bp, Homo sapien
tgtgtttccctacaatcaaacaatg

SEQ ID NO: 659062 - DNA, 25 bp, Homo sapien
gtgtttccctacaatcaaacaatga

SEQ ID NO: 659063 - DNA, 25 bp, Homo sapien
tgtttccctacaatcaaacaatgat

SEQ ID NO: 659064 - DNA, 25 bp, Homo sapien
gtttccctacaatcaaacaatgatt

SEQ ID NO: 659065 - DNA, 25 bp, Homo sapien
ttccctacaatcaaacaatgattta

SEQ ID NO: 659066 - DNA, 25 bp, Homo sapien
aattctgttttgtatctgagaagta

SEQ ID NO: 659067 - DNA, 25 bp, Homo sapien
gatggtgaagtgagcacaattgtaa

SEQ ID NO: 659068 - DNA, 25 bp, Homo sapien
attactttggaggagattgctaggt

SEQ ID NO: 659069 - DNA, 25 bp, Homo sapien
actttggaggagattgctaggtagt

SEQ ID NO: 659070 - DNA, 25 bp, Homo sapien
tgctaggtagtgagacaagtggata

SEQ ID NO: 659071 - DNA, 25 bp, Homo sapien
gataatatcataagtgctagggctg

SEQ ID NO: 659072 - DNA, 25 bp, Homo sapien
tatcataagtgctagggctgagtat

SEQ ID NO: 659073 - DNA, 25 bp, Homo sapien
gctgagtatgaagttccgtgggaac

SEQ ID NO: 659074 - DNA, 25 bp, Homo sapien
gaagttccgtgggaacacaaaggag

SEQ ID NO: 659075 - DNA, 25 bp, Homo sapien
ggaggaaatagctatgaatcttaag

SEQ ID NO: 659076 - DNA, 25 bp, Homo sapien
tatttaaactaaattctttcatgga

SEQ ID NO: 659077 - DNA, 25 bp, Homo sapien
atttattactactttgggccaggtg

SEQ ID NO: 659078 - DNA, 25 bp, Homo sapien
tttattactactttgggccaggtgc

SEQ ID NO: 659079 - DNA, 25 bp, Homo sapien
ttattactactttgggccaggtgcg

SEQ ID NO: 659080 - DNA, 25 bp, Homo sapien
tattactactttgggccaggtgcgg

SEQ ID NO: 659081 - DNA, 25 bp, Homo sapien
attactactttgggccaggtgcggt

SEQ ID NO: 659082 - DNA, 25 bp, Homo sapien
ttactactttgggccaggtgcggtg

SEQ ID NO: 659083 - DNA, 25 bp, Homo sapien
gtggatcgcctgagattgggagttt

SEQ ID NO: 659084 - DNA, 25 bp, Homo sapien
tggatcgcctgagattgggagtttg

SEQ ID NO: 659085 - DNA, 25 bp, Homo sapien
gaaaccccatctcaagtaacaatac

SEQ ID NO: 659086 - DNA, 25 bp, Homo sapien
ccatctcaagtaacaatacaaaaat

SEQ ID NO: 659087 - DNA, 25 bp, Homo sapien
catctcaagtaacaatacaaaaatt

SEQ ID NO: 659088 - DNA, 25 bp, Homo sapien
gagccaatgtccaggctgtgtgttt

SEQ ID NO: 659089 - DNA, 25 bp, Homo sapien
gctgtgtgtttcattctccaaagga

SEQ ID NO: 659090 - DNA, 25 bp, Homo sapien
attctccaaaggacaggaactgaga

SEQ ID NO: 659091 - DNA, 25 bp, Homo sapien
actgagacttatgggccagaagata

SEQ ID NO: 659092 - DNA, 25 bp, Homo sapien
agatggtgtggccttctcttgcaag

SEQ ID NO: 659093 - DNA, 25 bp, Homo sapien
gtggccttctcttgcaagagggaga

SEQ ID NO: 659094 - DNA, 25 bp, Homo sapien
agagccatggagatagtagcagaca

SEQ ID NO: 659095 - DNA, 25 bp, Homo sapien
acaggctgcccaaggtatgaagcag

SEQ ID NO: 659096 - DNA, 25 bp, Homo sapien
gatgagggaccagcactcagtctaa

SEQ ID NO: 659097 - DNA, 25 bp, Homo sapien
agcactcagtctaacatgtaaacat

SEQ ID NO: 659098 - DNA, 25 bp, Homo sapien
tcatacgtaataaaggttgtgtttc

SEQ ID NO: 659099 - DNA, 25 bp, Homo sapien
aaaggcagactaaattatatggtaa

SEQ ID NO: 659100 - DNA, 25 bp, Homo sapien
attatatggtaagtaggctgtttca

SEQ ID NO: 659101 - DNA, 25 bp, Homo sapien
tatatggtaagtaggctgtttcatt

SEQ ID NO: 659102 - DNA, 25 bp, Homo sapien
tggtaagtaggctgtttcattgaac

SEQ ID NO: 659103 - DNA, 25 bp, Homo sapien
ggtaagtaggctgtttcattgaact

SEQ ID NO: 659104 - DNA, 25 bp, Homo sapien
gtaagtaggctgtttcattgaactg

SEQ ID NO: 659105 - DNA, 25 bp, Homo sapien
taagtaggctgtttcattgaactga

SEQ ID NO: 659106 - DNA, 25 bp, Homo sapien
aagtaggctgtttcattgaactgaa

SEQ ID NO: 659107 - DNA, 25 bp, Homo sapien
agtaggctgtttcattgaactgaaa

SEQ ID NO: 659108 - DNA, 25 bp, Homo sapien
gtaggctgtttcattgaactgaaat

SEQ ID NO: 659109 - DNA, 25 bp, Homo sapien
gtaaaccggagatgtaagttgtcac

SEQ ID NO: 659110 - DNA, 25 bp, Homo sapien
tatccatttctaattttgctaaggc

SEQ ID NO: 659111 - DNA, 25 bp, Homo sapien
ttttgctaaggcactacatcagtag

SEQ ID NO: 659112 - DNA, 25 bp, Homo sapien
ggcactacatcagtagcttcagaat

SEQ ID NO: 659113 - DNA, 25 bp, Homo sapien
catcagtagcttcagaatgcaattt

SEQ ID NO: 659114 - DNA, 25 bp, Homo sapien
tttttgtttgtcttggagaggcaaa

SEQ ID NO: 659115 - DNA, 25 bp, Homo sapien
ttgtcttggagaggcaaactgcaat

SEQ ID NO: 659116 - DNA, 25 bp, Homo sapien
gaaagcaaaatgatagcctgaggac

SEQ ID NO: 659117 - DNA, 25 bp, Homo sapien
gcctgaggacagatgtgttgcttat

SEQ ID NO: 659118 - DNA, 25 bp, Homo sapien
aggacagatgtgttgcttatgaaaa

SEQ ID NO: 659119 - DNA, 25 bp, Homo sapien
gtggaaattgtagctctcctgtggc

SEQ ID NO: 659120 - DNA, 25 bp, Homo sapien
attgtagctctcctgtggctgaaaa

SEQ ID NO: 659121 - DNA, 25 bp, Homo sapien
taggctgagtgagccgctaatccaa

SEQ ID NO: 659122 - DNA, 25 bp, Homo sapien
ctgagtgagccgctaatccaacatg

SEQ ID NO: 659123 - DNA, 25 bp, Homo sapien
tgagtgagccgctaatccaacatga

SEQ ID NO: 659124 - DNA, 25 bp, Homo sapien
gagtgagccgctaatccaacatgac

SEQ ID NO: 659125 - DNA, 25 bp, Homo sapien
gggagaataccatgtgaagactgga

SEQ ID NO: 659126 - DNA, 25 bp, Homo sapien
gagttattcagccacaactaaggca

SEQ ID NO: 659127 - DNA, 25 bp, Homo sapien
gttattcagccacaactaaggcatt

SEQ ID NO: 659128 - DNA, 25 bp, Homo sapien
tattcagccacaactaaggcatttc

SEQ ID NO: 659129 - DNA, 25 bp, Homo sapien
tcagccacaactaaggcatttccag

SEQ ID NO: 659130 - DNA, 25 bp, Homo sapien
caactaaggcatttccagaagccag

SEQ ID NO: 659131 - DNA, 25 bp, Homo sapien
tgtgtggccccgctgacactgacct

SEQ ID NO: 659132 - DNA, 25 bp, Homo sapien
gcaacatgcgagacccctgtctcca

SEQ ID NO: 659133 - DNA, 25 bp, Homo sapien
caacatgcgagacccctgtctccaa

SEQ ID NO: 659134 - DNA, 25 bp, Homo sapien
taaaaagccgagagtaggggtgcgt

SEQ ID NO: 659135 - DNA, 25 bp, Homo sapien
agtaggggtgcgtgcctgttgtccc

SEQ ID NO: 659136 - DNA, 25 bp, Homo sapien
gttgtcccagctactaggaagtctt

SEQ ID NO: 659137 - DNA, 25 bp, Homo sapien
ccagctactaggaagtcttgggggt

SEQ ID NO: 659138 - DNA, 25 bp, Homo sapien
gctactaggaagtcttgggggtgta

SEQ ID NO: 659139 - DNA, 25 bp, Homo sapien
cttgggggtgtaggggatcgcttga

SEQ ID NO: 659140 - DNA, 25 bp, Homo sapien
ggtgaggagaccctgtcctaaattt

SEQ ID NO: 659141 - DNA, 25 bp, Homo sapien
gtgaggagaccctgtcctaaattta

SEQ ID NO: 659142 - DNA, 25 bp, Homo sapien
tgaggagaccctgtcctaaatttaa

SEQ ID NO: 659143 - DNA, 25 bp, Homo sapien
ggtgaggtgccaaacacacagagga

SEQ ID NO: 659144 - DNA, 25 bp, Homo sapien
cacggaggaggccatattgtaataa

SEQ ID NO: 659145 - DNA, 25 bp, Homo sapien
gcagtcagaagtcaccccataaaac

SEQ ID NO: 659146 - DNA, 25 bp, Homo sapien
gagcatgaccagcaaagcggtttct

SEQ ID NO: 659147 - DNA, 25 bp, Homo sapien
aaagcggtttcttcttgcggacact

SEQ ID NO: 659148 - DNA, 25 bp, Homo sapien
tttcttcttgcggacactgcatcag

SEQ ID NO: 659149 - DNA, 25 bp, Homo sapien
gcatcagcccagctcaaagtgcatt

SEQ ID NO: 659150 - DNA, 25 bp, Homo sapien
aaagtgcattccattctgatgaaca

SEQ ID NO: 659151 - DNA, 25 bp, Homo sapien
gatgaacatccacaaacagttatga

SEQ ID NO: 659152 - DNA, 25 bp, Homo sapien
gaagacccaaatgtcatgattttgt

SEQ ID NO: 659153 - DNA, 25 bp, Homo sapien
tgattttgttcctctcagataataa

SEQ ID NO: 659154 - DNA, 25 bp, Homo sapien
atttacggctctgtgctacccctag

SEQ ID NO: 659155 - DNA, 25 bp, Homo sapien
tgtgctacccctaggtagcaagaga

SEQ ID NO: 659156 - DNA, 25 bp, Homo sapien
aaggagcaatccatgcacactctgt

SEQ ID NO: 659157 - DNA, 25 bp, Homo sapien
atccatgcacactctgtacagttgt

SEQ ID NO: 659158 - DNA, 25 bp, Homo sapien
cactctgtacagttgtttttctacg

SEQ ID NO: 659159 - DNA, 25 bp, Homo sapien
gtttttctacggttcaacagtctgt

SEQ ID NO: 659160 - DNA, 25 bp, Homo sapien
aacagtctgtttattgtacttccaa

SEQ ID NO: 659161 - DNA, 25 bp, Homo sapien
gtatacgggacatatattttatttc

SEQ ID NO: 659162 - DNA, 25 bp, Homo sapien
tttatttctttgtagctacttgtgt

SEQ ID NO: 659163 - DNA, 25 bp, Homo sapien
agctacttgtgttttattggtatta

SEQ ID NO: 659164 - DNA, 25 bp, Homo sapien
aatttatgcaattggtggtgcttcc

SEQ ID NO: 659165 - DNA, 25 bp, Homo sapien
aagttcctggccatgatgggacagg

SEQ ID NO: 659166 - DNA, 25 bp, Homo sapien
ggaggccaaacacatctcagtatgc

SEQ ID NO: 659167 - DNA, 25 bp, Homo sapien
tatgccccttacttactgactttta

SEQ ID NO: 659168 - DNA, 25 bp, Homo sapien
ttaaccagaattccttcgtaaggag

SEQ ID NO: 659169 - DNA, 25 bp, Homo sapien
agacgactcattcctttattacctt

SEQ ID NO: 659170 - DNA, 25 bp, Homo sapien
attaccttcagccaatcgtgaccat

SEQ ID NO: 659171 - DNA, 25 bp, Homo sapien
agccaatcgtgaccatgccaatgag

SEQ ID NO: 659172 - DNA, 25 bp, Homo sapien
tgccaatgaggccatgaccagactc

SEQ ID NO: 659173 - DNA, 25 bp, Homo sapien
gcagttttgacatgacagctcacca

SEQ ID NO: 659174 - DNA, 25 bp, Homo sapien
gacagctcaccagcttcataatggt

SEQ ID NO: 659175 - DNA, 25 bp, Homo sapien
taatggtatcccttcctaaaaactg

SEQ ID NO: 659176 - DNA, 25 bp, Homo sapien
aagcattcattgaaacaatggccag

SEQ ID NO: 659177 - DNA, 25 bp, Homo sapien
cattgaaacaatggccagtgcttgg

SEQ ID NO: 659178 - DNA, 25 bp, Homo sapien
gtgcttggcagtactgaaacttaaa

SEQ ID NO: 659179 - DNA, 25 bp, Homo sapien
ggcagtactgaaacttaaaagacaa

SEQ ID NO: 659180 - DNA, 25 bp, Homo sapien
caaagttgggcataacctcagcact

SEQ ID NO: 659181 - DNA, 25 bp, Homo sapien
aaagttgggcataacctcagcactt

SEQ ID NO: 659182 - DNA, 25 bp, Homo sapien
gagtggatcacttaaaatcaggatt

SEQ ID NO: 659183 - DNA, 25 bp, Homo sapien
aatcaggatttcaacatggtgaaac

SEQ ID NO: 659184 - DNA, 25 bp, Homo sapien
atacacaccgaaatttagctgggct

SEQ ID NO: 659185 - DNA, 25 bp, Homo sapien
gcaggaaaattccttcacctgggag

SEQ ID NO: 659186 - DNA, 25 bp, Homo sapien
gaaaattccttcacctgggaggtgg

SEQ ID NO: 659187 - DNA, 25 bp, Homo sapien
tctcccatgtttaagcaattctctg

SEQ ID NO: 659188 - DNA, 25 bp, Homo sapien
ctcccatgtttaagcaattctctgt

SEQ ID NO: 659189 - DNA, 25 bp, Homo sapien
tcccatgtttaagcaattctctgtc

SEQ ID NO: 659190 - DNA, 25 bp, Homo sapien
cccatgtttaagcaattctctgtct

SEQ ID NO: 659191 - DNA, 25 bp, Homo sapien
ccatgtttaagcaattctctgtctc

SEQ ID NO: 659192 - DNA, 25 bp, Homo sapien
catgtttaagcaattctctgtctca

SEQ ID NO: 659193 - DNA, 25 bp, Homo sapien
atgtttaagcaattctctgtctcag

SEQ ID NO: 659194 - DNA, 25 bp, Homo sapien
tgtttaagcaattctctgtctcagc

SEQ ID NO: 659195 - DNA, 25 bp, Homo sapien
acctgccaccatgcctgactacttt

SEQ ID NO: 659196 - DNA, 25 bp, Homo sapien
ctgccaccatgcctgactacttttt

SEQ ID NO: 659197 - DNA, 25 bp, Homo sapien
atatccaaactatagaagtggcaaa

SEQ ID NO: 659198 - DNA, 25 bp, Homo sapien
gtggcaaattgacaacatctactta

SEQ ID NO: 659199 - DNA, 25 bp, Homo sapien
gacaacatctacttattcgttcaaa

SEQ ID NO: 659200 - DNA, 25 bp, Homo sapien
gatccatggatgtttcagcttttct

SEQ ID NO: 659201 - DNA, 25 bp, Homo sapien
agcttttctgtgactgaccctgcat

SEQ ID NO: 659202 - DNA, 25 bp, Homo sapien
ttctgtgactgaccctgcatactga

SEQ ID NO: 659203 - DNA, 25 bp, Homo sapien
gtgactgaccctgcatactgaaaag

SEQ ID NO: 659204 - DNA, 25 bp, Homo sapien
gaccctgcatactgaaaagcaataa

SEQ ID NO: 659205 - DNA, 25 bp, Homo sapien
caataaattccttgctaacttaaat

SEQ ID NO: 659206 - DNA, 25 bp, Homo sapien
taatggcagatatgcctaaggccac

SEQ ID NO: 659207 - DNA, 25 bp, Homo sapien
ggcagatatgcctaaggccacaaat

SEQ ID NO: 659208 - DNA, 25 bp, Homo sapien
tgtacctgtctctatgtcacttggc

SEQ ID NO: 659209 - DNA, 25 bp, Homo sapien
ctgtctctatgtcacttggcatatt

SEQ ID NO: 659210 - DNA, 25 bp, Homo sapien
gtcacttggcatattgaattctgaa

SEQ ID NO: 659211 - DNA, 25 bp, Homo sapien
aattctgaattaccatgcatccctc

SEQ ID NO: 659212 - DNA, 25 bp, Homo sapien
attaccatgcatccctcatgtcaaa

SEQ ID NO: 659213 - DNA, 25 bp, Homo sapien
gcatccctcatgtcaaacagaagtt

SEQ ID NO: 659214 - DNA, 25 bp, Homo sapien
tgtctaggcctcttaggaaaggcgt

SEQ ID NO: 659215 - DNA, 25 bp, Homo sapien
gggctttctaagaactgtaactcat

SEQ ID NO: 659216 - DNA, 25 bp, Homo sapien
gtaactcattaatcactatgtcagt

SEQ ID NO: 659217 - DNA, 25 bp, Homo sapien
tgtatttgacaacttcagattttct

SEQ ID NO: 659218 - DNA, 25 bp, Homo sapien
cagattttctggaagcctaaaaata

SEQ ID NO: 659219 - DNA, 25 bp, Homo sapien
gattgggacaaaaatcattccatct

SEQ ID NO: 659220 - DNA, 25 bp, Homo sapien
aaatcattccatctaattacaccaa

SEQ ID NO: 659221 - DNA, 25 bp, Homo sapien
attccatctaattacaccaatcact

SEQ ID NO: 659222 - DNA, 25 bp, Homo sapien
aattacaccaatcactaagaagagt

SEQ ID NO: 659223 - DNA, 25 bp, Homo sapien
gtatatattccctaaaacacatcaa

SEQ ID NO: 659224 - DNA, 25 bp, Homo sapien
atattccctaaaacacatcaaactt

SEQ ID NO: 659225 - DNA, 25 bp, Homo sapien
acttttatccagttgtactcttctt

SEQ ID NO: 659226 - DNA, 25 bp, Homo sapien
ttatccagttgtactcttctttata

SEQ ID NO: 659227 - DNA, 25 bp, Homo sapien
ccagttgtactcttctttatatagc

SEQ ID NO: 659228 - DNA, 25 bp, Homo sapien
gttgtactcttctttatatagctaa

SEQ ID NO: 659229 - DNA, 25 bp, Homo sapien
gtactcttctttatatagctaaatg

SEQ ID NO: 659230 - DNA, 25 bp, Homo sapien
ggaaaatcgggacactcccatcctg

SEQ ID NO: 659231 - DNA, 25 bp, Homo sapien
aaatcgggacactcccatcctgata

SEQ ID NO: 659232 - DNA, 25 bp, Homo sapien
atcctgatactgcacttttccaaag

SEQ ID NO: 659233 - DNA, 25 bp, Homo sapien
ttttccaaaggtcttagcaaatggc

SEQ ID NO: 659234 - DNA, 25 bp, Homo sapien
aggtcttagcaaatggcacaccagg

SEQ ID NO: 659235 - DNA, 25 bp, Homo sapien
ggagcctcgctcactgctagcacag

SEQ ID NO: 659236 - DNA, 25 bp, Homo sapien
tctgagactgaactgcaaggtggca

SEQ ID NO: 659237 - DNA, 25 bp, Homo sapien
tgaactgcaaggtggcaatgaggct

SEQ ID NO: 659238 - DNA, 25 bp, Homo sapien
gggtccaccattgctgacgtttgag

SEQ ID NO: 659239 - DNA, 25 bp, Homo sapien
gtccaccattgctgacgtttgagta

SEQ ID NO: 659240 - DNA, 25 bp, Homo sapien
aggtaaacaaaacactccagcctgg

SEQ ID NO: 659241 - DNA, 25 bp, Homo sapien
tcgagaccagctagatcaacatgga

SEQ ID NO: 659242 - DNA, 25 bp, Homo sapien
cgagaccagctagatcaacatggag

SEQ ID NO: 659243 - DNA, 25 bp, Homo sapien
gagaccagctagatcaacatggaga

SEQ ID NO: 659244 - DNA, 25 bp, Homo sapien
gaccagctagatcaacatggagaaa

SEQ ID NO: 659245 - DNA, 25 bp, Homo sapien
accagctagatcaacatggagaaac

SEQ ID NO: 659246 - DNA, 25 bp, Homo sapien
ccagctagatcaacatggagaaacc

SEQ ID NO: 659247 - DNA, 25 bp, Homo sapien
cctgggaaacaagagtgaaactgtc

SEQ ID NO: 659248 - DNA, 25 bp, Homo sapien
ctgggaaacaagagtgaaactgtct

SEQ ID NO: 659249 - DNA, 25 bp, Homo sapien
tgggaaacaagagtgaaactgtctc

SEQ ID NO: 659250 - DNA, 25 bp, Homo sapien
gagtaggacctacatggtaaagaaa

SEQ ID NO: 659251 - DNA, 25 bp, Homo sapien
gaaaaaatttacgtgcaaggcagat

SEQ ID NO: 659252 - DNA, 25 bp, Homo sapien
tgaggaagtaagagagcatccagcc

SEQ ID NO: 659253 - DNA, 25 bp, Homo sapien
acaacttcattctctgtcttaccga

SEQ ID NO: 659254 - DNA, 25 bp, Homo sapien
acttcattctctgtcttaccgaaag

SEQ ID NO: 659255 - DNA, 25 bp, Homo sapien
ttctctgtcttaccgaaagaatgtg

SEQ ID NO: 659256 - DNA, 25 bp, Homo sapien
gaagatggactaatctccttgtttt

SEQ ID NO: 659257 - DNA, 25 bp, Homo sapien
gaagaacctataagtctctgagcac

SEQ ID NO: 659258 - DNA, 25 bp, Homo sapien
agtctctgagcacatttttctttgg

SEQ ID NO: 659259 - DNA, 25 bp, Homo sapien
tctctgagcacatttttctttggca

SEQ ID NO: 659260 - DNA, 25 bp, Homo sapien
acaaatggtttgtgaatctttagaa

SEQ ID NO: 659261 - DNA, 25 bp, Homo sapien
ttaaaaggtaacatccactattggc

SEQ ID NO: 659262 - DNA, 25 bp, Homo sapien
aaggtaacatccactattggcaaac

SEQ ID NO: 659263 - DNA, 25 bp, Homo sapien
gacatttctgatacactgcttgtgg

SEQ ID NO: 659264 - DNA, 25 bp, Homo sapien
tttctgatacactgcttgtgggagg

SEQ ID NO: 659265 - DNA, 25 bp, Homo sapien
tacactgcttgtgggagggtgaatt

SEQ ID NO: 659266 - DNA, 25 bp, Homo sapien
gggtgaattggtatgacctttctac

SEQ ID NO: 659267 - DNA, 25 bp, Homo sapien
attggtatgacctttctacagggca

SEQ ID NO: 659268 - DNA, 25 bp, Homo sapien
gtatgacctttctacagggcaatct

SEQ ID NO: 659269 - DNA, 25 bp, Homo sapien
gacctttctacagggcaatctgcaa

SEQ ID NO: 659270 - DNA, 25 bp, Homo sapien
ctacagggcaatctgcaatagtaat

SEQ ID NO: 659271 - DNA, 25 bp, Homo sapien
gcaatagtaataaaaggcttaggcc

SEQ ID NO: 659272 - DNA, 25 bp, Homo sapien
aggtgatgacttactattgctattt

SEQ ID NO: 659273 - DNA, 25 bp, Homo sapien
gatgacttactattgctatttttta

SEQ ID NO: 659274 - DNA, 25 bp, Homo sapien
ttctctttcacagttgttttgttcc

SEQ ID NO: 659275 - DNA, 25 bp, Homo sapien
tctttcacagttgttttgttcctct

SEQ ID NO: 659276 - DNA, 25 bp, Homo sapien
tttatttgtcttgtttacccatatg

SEQ ID NO: 659277 - DNA, 25 bp, Homo sapien
gtcttgtttacccatatgtttaata

SEQ ID NO: 659278 - DNA, 25 bp, Homo sapien
gtgttcttacttccttcatgctgtt

SEQ ID NO: 659279 - DNA, 25 bp, Homo sapien
catgctgttatttatttctacttgg

SEQ ID NO: 659280 - DNA, 25 bp, Homo sapien
gctgttatttatttctacttggtat

SEQ ID NO: 659281 - DNA, 25 bp, Homo sapien
ttctacttggtattgtaaattttca

SEQ ID NO: 659282 - DNA, 25 bp, Homo sapien
gttgaatttattttcgcaggtcttc

SEQ ID NO: 659283 - DNA, 25 bp, Homo sapien
gaatgacgaacctggcttatggcca

SEQ ID NO: 659284 - DNA, 25 bp, Homo sapien
ttttctggcaagtttgtgtaaccaa

SEQ ID NO: 659285 - DNA, 25 bp, Homo sapien
tgtgtaaccaaaaggccccagttct

SEQ ID NO: 659286 - DNA, 25 bp, Homo sapien
cagttcttagctcaacatgagagtg

SEQ ID NO: 659287 - DNA, 25 bp, Homo sapien
catgagagtgtaaaacccagcgttc

SEQ ID NO: 659288 - DNA, 25 bp, Homo sapien
aaaacccagcgttcaaggaatgtga

SEQ ID NO: 659289 - DNA, 25 bp, Homo sapien
aggaatgtgaaccaatacctggtat

SEQ ID NO: 659290 - DNA, 25 bp, Homo sapien
caatacctggtatgggcaaggacaa

SEQ ID NO: 659291 - DNA, 25 bp, Homo sapien
tagaaggacccagactaactccaga

SEQ ID NO: 659292 - DNA, 25 bp, Homo sapien
aatggtgagctaagacctttactgc

SEQ ID NO: 659293 - DNA, 25 bp, Homo sapien
gctaagacctttactgcatcacaaa

SEQ ID NO: 659294 - DNA, 25 bp, Homo sapien
ttgctgaccattttccaatgtggtt

SEQ ID NO: 659295 - DNA, 25 bp, Homo sapien
atgtggttgtatactttacattccc

SEQ ID NO: 659296 - DNA, 25 bp, Homo sapien
accagcaatgtatgggagtctattc

SEQ ID NO: 659297 - DNA, 25 bp, Homo sapien
atgggagtctattcctccacattca

SEQ ID NO: 659298 - DNA, 25 bp, Homo sapien
caatgctcgatatggtcagtcttta

SEQ ID NO: 659299 - DNA, 25 bp, Homo sapien
atgtttgtagagtatctcattgtgt

SEQ ID NO: 659300 - DNA, 25 bp, Homo sapien
catgtctttgcatgaacatatgctt

SEQ ID NO: 659301 - DNA, 25 bp, Homo sapien
tatgcttttatttatcttgagtaaa

SEQ ID NO: 659302 - DNA, 25 bp, Homo sapien
agtggctgtatcataaggtagatgt

SEQ ID NO: 659303 - DNA, 25 bp, Homo sapien
aactgtttacgaaacttgctgacca

SEQ ID NO: 659304 - DNA, 25 bp, Homo sapien
gaaacttgctgaccattttccaatg

SEQ ID NO: 659305 - DNA, 25 bp, Homo sapien
cagcctaaccaacaaagcaagacca

SEQ ID NO: 659306 - DNA, 25 bp, Homo sapien
agcctaaccaacaaagcaagaccaa

SEQ ID NO: 659307 - DNA, 25 bp, Homo sapien
gcctaaccaacaaagcaagaccaag

SEQ ID NO: 659308 - DNA, 25 bp, Homo sapien
acaaagcaagaccaagaccccttct

SEQ ID NO: 659309 - DNA, 25 bp, Homo sapien
aaagcaagaccaagaccccttctct

SEQ ID NO: 659310 - DNA, 25 bp, Homo sapien
aagcaagaccaagaccccttctcta

SEQ ID NO: 659311 - DNA, 25 bp, Homo sapien
gttccagctacactagaagctgaag

SEQ ID NO: 659312 - DNA, 25 bp, Homo sapien
ttccagctacactagaagctgaagg

SEQ ID NO: 659313 - DNA, 25 bp, Homo sapien
tccagctacactagaagctgaaggg

SEQ ID NO: 659314 - DNA, 25 bp, Homo sapien
ggaggttcacttgagccccgagttt

SEQ ID NO: 659315 - DNA, 25 bp, Homo sapien
gcagtgagccacattagcgccaccg

SEQ ID NO: 659316 - DNA, 25 bp, Homo sapien
ctttgtggtttatatgcagtttttg

SEQ ID NO: 659317 - DNA, 25 bp, Homo sapien
ggtttatatgcagtttttgtaatct

SEQ ID NO: 659318 - DNA, 25 bp, Homo sapien
agtttttgtaatctgcagtaatgag

SEQ ID NO: 659319 - DNA, 25 bp, Homo sapien
atctgcagtaatgagctaaggatct

SEQ ID NO: 659320 - DNA, 25 bp, Homo sapien
aatgagctaaggatctgaatgctag

SEQ ID NO: 659321 - DNA, 25 bp, Homo sapien
taaggatctgaatgctaggaaacaa

SEQ ID NO: 659322 - DNA, 25 bp, Homo sapien
actattagacttaagaaaaccatat

SEQ ID NO: 659323 - DNA, 25 bp, Homo sapien
gaaaaccatattagagttctcaaac

SEQ ID NO: 659324 - DNA, 25 bp, Homo sapien
tagagttctcaaacttccacatcct

SEQ ID NO: 659325 - DNA, 25 bp, Homo sapien
ttctcaaacttccacatcctgtttt

SEQ ID NO: 659326 - DNA, 25 bp, Homo sapien
tcaaacttccacatcctgttttcca

SEQ ID NO: 659327 - DNA, 25 bp, Homo sapien
aaatcagaggtgctactgaggagtt

SEQ ID NO: 659328 - DNA, 25 bp, Homo sapien
aggagttggtgcccctcattccaga

SEQ ID NO: 659329 - DNA, 25 bp, Homo sapien
gaaggaggccccagtggactctttg

SEQ ID NO: 659330 - DNA, 25 bp, Homo sapien
cagtggactctttgtacccttccta

SEQ ID NO: 659331 - DNA, 25 bp, Homo sapien
tctttgtacccttcctactctcaga

SEQ ID NO: 659332 - DNA, 25 bp, Homo sapien
ggtcctcaaggaacaaagaagataa

SEQ ID NO: 659333 - DNA, 25 bp, Homo sapien
gataaagcacaaatcgcagaacttg

SEQ ID NO: 659334 - DNA, 25 bp, Homo sapien
gcagaacttgaatccaggctgctgc

SEQ ID NO: 659335 - DNA, 25 bp, Homo sapien
aatccaggctgctgctcatcatagt

SEQ ID NO: 659336 - DNA, 25 bp, Homo sapien
tcatcatagtcctgttgctgtctgt

SEQ ID NO: 659337 - DNA, 25 bp, Homo sapien
gttgctgtctgtcctatttatttat

SEQ ID NO: 659338 - DNA, 25 bp, Homo sapien
agtcaaacacaatagaaacccagat

SEQ ID NO: 659339 - DNA, 25 bp, Homo sapien
gaaacccagatacagacgattatat

SEQ ID NO: 659340 - DNA, 25 bp, Homo sapien
acccagatacagacgattatatatg

SEQ ID NO: 659341 - DNA, 25 bp, Homo sapien
cagacgattatatatgtggtcaatt

SEQ ID NO: 659342 - DNA, 25 bp, Homo sapien
atatgtggtcaattgatttgaacaa

SEQ ID NO: 659343 - DNA, 25 bp, Homo sapien
gtcaattgatttgaacaaaggtgct

SEQ ID NO: 659344 - DNA, 25 bp, Homo sapien
gaacaaaggtgctaaggcaattaaa

SEQ ID NO: 659345 - DNA, 25 bp, Homo sapien
atggaaaaaggatagtgctcttaac

SEQ ID NO: 659346 - DNA, 25 bp, Homo sapien
aggatagtgctcttaacaaacagtg

SEQ ID NO: 659347 - DNA, 25 bp, Homo sapien
gatagtgctcttaacaaacagtgtt

SEQ ID NO: 659348 - DNA, 25 bp, Homo sapien
agtgctcttaacaaacagtgttaga

SEQ ID NO: 659349 - DNA, 25 bp, Homo sapien
catctttaacaaacactggagtcta

SEQ ID NO: 659350 - DNA, 25 bp, Homo sapien
tagggcaatttatcagccatttcac

SEQ ID NO: 659351 - DNA, 25 bp, Homo sapien
gccatttcacaacttctactacaat

SEQ ID NO: 659352 - DNA, 25 bp, Homo sapien
actacaattgtatacctcttaagta

SEQ ID NO: 659353 - DNA, 25 bp, Homo sapien
taaattatgttatgctcttagagct

SEQ ID NO: 659354 - DNA, 25 bp, Homo sapien
gagctatttatattggcagcctgct

SEQ ID NO: 659355 - DNA, 25 bp, Homo sapien
gcagcctgctgttcagtgttttaga

SEQ ID NO: 659356 - DNA, 25 bp, Homo sapien
gactgagtcatcatagatctcttaa

SEQ ID NO: 659357 - DNA, 25 bp, Homo sapien
actcttttaggtataattggtgctg

SEQ ID NO: 659358 - DNA, 25 bp, Homo sapien
gggttcttaaatacccagcatttag

SEQ ID NO: 659359 - DNA, 25 bp, Homo sapien
acccagcatttaggcttttcagtag

SEQ ID NO: 659360 - DNA, 25 bp, Homo sapien
ctgctctgtcgagtgagtcttctaa

SEQ ID NO: 659361 - DNA, 25 bp, Homo sapien
ctgtcgagtgagtcttctaaattgc

SEQ ID NO: 659362 - DNA, 25 bp, Homo sapien
gagtgagtcttctaaattgctccaa

SEQ ID NO: 659363 - DNA, 25 bp, Homo sapien
gagtcttctaaattgctccaagata

SEQ ID NO: 659364 - DNA, 25 bp, Homo sapien
cagagactgtctgattccactgctg

SEQ ID NO: 659365 - DNA, 25 bp, Homo sapien
tgattccactgctgccatctcagag

SEQ ID NO: 659366 - DNA, 25 bp, Homo sapien
tccactgctgccatctcagagctag

SEQ ID NO: 659367 - DNA, 25 bp, Homo sapien
cagctgaaggagaaacaaaatgtct

SEQ ID NO: 659368 - DNA, 25 bp, Homo sapien
aatgtcttagacaggttacttaggg

SEQ ID NO: 659369 - DNA, 25 bp, Homo sapien
ttcatcaaagccaaaagtagtaaat

SEQ ID NO: 659370 - DNA, 25 bp, Homo sapien
gtagtaaattacattcttagagaga

SEQ ID NO: 659371 - DNA, 25 bp, Homo sapien
gatatcctacaaaattttgtctcta

SEQ ID NO: 659372 - DNA, 25 bp, Homo sapien
aattttgtctctacacatgttgaag

SEQ ID NO: 659373 - DNA, 25 bp, Homo sapien
tgtctctacacatgttgaagttcat

SEQ ID NO: 659374 - DNA, 25 bp, Homo sapien
ctactctcttacttatgcttcaagc

SEQ ID NO: 659375 - DNA, 25 bp, Homo sapien
ttcttcctaggactcctgttcacca

SEQ ID NO: 659376 - DNA, 25 bp, Homo sapien
ctctacacatagcagatccacgtaa

SEQ ID NO: 659377 - DNA, 25 bp, Homo sapien
atagcagatccacgtaagacacttg

SEQ ID NO: 659378 - DNA, 25 bp, Homo sapien
gatccacgtaagacacttgcatcca

SEQ ID NO: 659379 - DNA, 25 bp, Homo sapien
gtaagacacttgcatccaagacaag

SEQ ID NO: 659380 - DNA, 25 bp, Homo sapien
gcatccaagacaagtcagaatgatt

SEQ ID NO: 659381 - DNA, 25 bp, Homo sapien
gaaagttttaattgcactgtatggg

SEQ ID NO: 659382 - DNA, 25 bp, Homo sapien
gggcccaacatgatcacaagggttc

SEQ ID NO: 659383 - DNA, 25 bp, Homo sapien
acatgatcacaagggttcttagaag

SEQ ID NO: 659384 - DNA, 25 bp, Homo sapien
gtggaatcagatgtcagaaggagaa

SEQ ID NO: 659385 - DNA, 25 bp, Homo sapien
cagaatcatgaaatccaggaaggac

SEQ ID NO: 659386 - DNA, 25 bp, Homo sapien
ggaaggactcaacaagccattgcag

SEQ ID NO: 659387 - DNA, 25 bp, Homo sapien
aacaagccattgcaggccttaccaa

SEQ ID NO: 659388 - DNA, 25 bp, Homo sapien
cattgcaggccttaccaactgaagg

SEQ ID NO: 659389 - DNA, 25 bp, Homo sapien
ttttccctagatcttccagagagga

SEQ ID NO: 659390 - DNA, 25 bp, Homo sapien
ggaatgcaaccgtgctgaaatgttg

SEQ ID NO: 659391 - DNA, 25 bp, Homo sapien
aaccgtgctgaaatgttgattttag

SEQ ID NO: 659392 - DNA, 25 bp, Homo sapien
cagacttctgacctaaagagttgta

SEQ ID NO: 659393 - DNA, 25 bp, Homo sapien
tagatttcgggctttactaagactt

SEQ ID NO: 659394 - DNA, 25 bp, Homo sapien
actaagacttcctacactcaatctc

SEQ ID NO: 659395 - DNA, 25 bp, Homo sapien
agacttcctacactcaatctctgga

SEQ ID NO: 659396 - DNA, 25 bp, Homo sapien
ttcctacactcaatctctggactgt

SEQ ID NO: 659397 - DNA, 25 bp, Homo sapien
cctacactcaatctctggactgtaa

SEQ ID NO: 659398 - DNA, 25 bp, Homo sapien
acactcaatctctggactgtaaatg

SEQ ID NO: 659399 - DNA, 25 bp, Homo sapien
actcaatctctggactgtaaatgct

SEQ ID NO: 659400 - DNA, 25 bp, Homo sapien
caatctctggactgtaaatgctggg

SEQ ID NO: 659401 - DNA, 25 bp, Homo sapien
tcaactctaagacttcaattacaag

SEQ ID NO: 659402 - DNA, 25 bp, Homo sapien
atggcagaacatggctggccttcat

SEQ ID NO: 659403 - DNA, 25 bp, Homo sapien
gctggccttcattcaagtccgaata

SEQ ID NO: 659404 - DNA, 25 bp, Homo sapien
ctttatgtccacatgtttccagcat

SEQ ID NO: 659405 - DNA, 25 bp, Homo sapien
ctcccacttatacgtgagagtatgt

SEQ ID NO: 659406 - DNA, 25 bp, Homo sapien
tctttatccagaacactgttgatag

SEQ ID NO: 659407 - DNA, 25 bp, Homo sapien
ccagaacactgttgataggcatcta

SEQ ID NO: 659408 - DNA, 25 bp, Homo sapien
gaacactgttgataggcatctacat

SEQ ID NO: 659409 - DNA, 25 bp, Homo sapien
acactgttgataggcatctacattg

SEQ ID NO: 659410 - DNA, 25 bp, Homo sapien
gttgataggcatctacattgattcc

SEQ ID NO: 659411 - DNA, 25 bp, Homo sapien
gataggcatctacattgattccatg

SEQ ID NO: 659412 - DNA, 25 bp, Homo sapien
ggcatctacattgattccatgtctt

SEQ ID NO: 659413 - DNA, 25 bp, Homo sapien
gcagcaataaacatgcatggttcaa

SEQ ID NO: 659414 - DNA, 25 bp, Homo sapien
gcaataaacatgcatggttcaactt

SEQ ID NO: 659415 - DNA, 25 bp, Homo sapien
agtgaacaagtgtgcctagccacaa

SEQ ID NO: 659416 - DNA, 25 bp, Homo sapien
tgcctagccacaaatgccaccttaa

SEQ ID NO: 659417 - DNA, 25 bp, Homo sapien
aatgccaccttaaccaagaaatctg

SEQ ID NO: 659418 - DNA, 25 bp, Homo sapien
gaaatctggtaatactacttcaacc

SEQ ID NO: 659419 - DNA, 25 bp, Homo sapien
cttcaaccacagtaatatcttcagt

SEQ ID NO: 659420 - DNA, 25 bp, Homo sapien
tcctgatatgatacaaaggcacatc

SEQ ID NO: 659421 - DNA, 25 bp, Homo sapien
aatggttaactgagtcattagactc

SEQ ID NO: 659422 - DNA, 25 bp, Homo sapien
aaccagagaaatctacaagcagttg

SEQ ID NO: 659423 - DNA, 25 bp, Homo sapien
aagcagttggcctggactcttcaaa

SEQ ID NO: 659424 - DNA, 25 bp, Homo sapien
gcctggactcttcaaacacgtcaat

SEQ ID NO: 659425 - DNA, 25 bp, Homo sapien
actcttcaaacacgtcaatgccatg

SEQ ID NO: 659426 - DNA, 25 bp, Homo sapien
cttccgttgatatgaaatgtccagc

SEQ ID NO: 659427 - DNA, 25 bp, Homo sapien
gtagatgagtaatagccagcggctg

SEQ ID NO: 659428 - DNA, 25 bp, Homo sapien
gagtaatagccagcggctgcagaca

SEQ ID NO: 659429 - DNA, 25 bp, Homo sapien
gtgatgacttaatgggtacagggat

SEQ ID NO: 659430 - DNA, 25 bp, Homo sapien
gacttaatgggtacagggattttat

SEQ ID NO: 659431 - DNA, 25 bp, Homo sapien
atgagacagagctggtggctgcata

SEQ ID NO: 659432 - DNA, 25 bp, Homo sapien
gagctggtggctgcatagagcacta

SEQ ID NO: 659433 - DNA, 25 bp, Homo sapien
tggtggctgcatagagcactatgaa

SEQ ID NO: 659434 - DNA, 25 bp, Homo sapien
cactatgaaagtgctaattgccatt

SEQ ID NO: 659435 - DNA, 25 bp, Homo sapien
agtgctaattgccattgaattattc

SEQ ID NO: 659436 - DNA, 25 bp, Homo sapien
cagttaatttaacgctatgtgaatt

SEQ ID NO: 659437 - DNA, 25 bp, Homo sapien
tcccattcttatttaactttgaaat

SEQ ID NO: 659438 - DNA, 25 bp, Homo sapien
aatgtcccaggttttacatttgaag

SEQ ID NO: 659439 - DNA, 25 bp, Homo sapien
tgtaagagtatcacaacacttcaca

SEQ ID NO: 659440 - DNA, 25 bp, Homo sapien
tacattgcccaatccatccttgaaa

SEQ ID NO: 659441 - DNA, 25 bp, Homo sapien
atccttgaaacagtgctacctattt

SEQ ID NO: 659442 - DNA, 25 bp, Homo sapien
gtgctacctatttgacttaactaag

SEQ ID NO: 659443 - DNA, 25 bp, Homo sapien
gacttaactaagtgccaacctacat

SEQ ID NO: 659444 - DNA, 25 bp, Homo sapien
ctaagtgccaacctacatggaagaa

SEQ ID NO: 659445 - DNA, 25 bp, Homo sapien
gtctttttctatgttgtctgactct

SEQ ID NO: 659446 - DNA, 25 bp, Homo sapien
gttgtctgactctggttcaaacagt

SEQ ID NO: 659447 - DNA, 25 bp, Homo sapien
tggttcaaacagtcccaacctgaaa

SEQ ID NO: 659448 - DNA, 25 bp, Homo sapien
aaatgaaaatatggaagccgggcat

SEQ ID NO: 659449 - DNA, 25 bp, Homo sapien
aatgaaaatatggaagccgggcatg

SEQ ID NO: 659450 - DNA, 25 bp, Homo sapien
gaaaatatggaagccgggcatggtg

SEQ ID NO: 659451 - DNA, 25 bp, Homo sapien
gggtgacagaacaggactgtgtcta

SEQ ID NO: 659452 - DNA, 25 bp, Homo sapien
ggtgacagaacaggactgtgtctaa

SEQ ID NO: 659453 - DNA, 25 bp, Homo sapien
gtgacagaacaggactgtgtctaaa

SEQ ID NO: 659454 - DNA, 25 bp, Homo sapien
tgacagaacaggactgtgtctaaaa

SEQ ID NO: 659455 - DNA, 25 bp, Homo sapien
gacagaacaggactgtgtctaaaaa

SEQ ID NO: 659456 - DNA, 25 bp, Homo sapien
acagaacaggactgtgtctaaaaaa

SEQ ID NO: 659457 - DNA, 25 bp, Homo sapien
agaacaggactgtgtctaaaaaaat

SEQ ID NO: 659458 - DNA, 25 bp, Homo sapien
gaacaggactgtgtctaaaaaaatt

SEQ ID NO: 659459 - DNA, 25 bp, Homo sapien
attgggccgggcgccgtggtgcacg

SEQ ID NO: 659460 - DNA, 25 bp, Homo sapien
ttgggccgggcgccgtggtgcacgc

SEQ ID NO: 659461 - DNA, 25 bp, Homo sapien
tgggccgggcgccgtggtgcacgcc

SEQ ID NO: 659462 - DNA, 25 bp, Homo sapien
gggccgggcgccgtggtgcacgcct

SEQ ID NO: 659463 - DNA, 25 bp, Homo sapien
ggccgggcgccgtggtgcacgcctg

SEQ ID NO: 659464 - DNA, 25 bp, Homo sapien
gccgggcgccgtggtgcacgcctgt

SEQ ID NO: 659465 - DNA, 25 bp, Homo sapien
ccgggcgccgtggtgcacgcctgta

SEQ ID NO: 659466 - DNA, 25 bp, Homo sapien
cgggcgccgtggtgcacgcctgtaa

SEQ ID NO: 659467 - DNA, 25 bp, Homo sapien
aggcatgatggcacgtgcctctaat

SEQ ID NO: 659468 - DNA, 25 bp, Homo sapien
gcatgatggcacgtgcctctaatcc

SEQ ID NO: 659469 - DNA, 25 bp, Homo sapien
catgatggcacgtgcctctaatccc

SEQ ID NO: 659470 - DNA, 25 bp, Homo sapien
agtgacagcagctacatgtctgggt

SEQ ID NO: 659471 - DNA, 25 bp, Homo sapien
gcagctacatgtctgggtccccagg

SEQ ID NO: 659472 - DNA, 25 bp, Homo sapien
agtggcagtgctgagaagccgtcct

SEQ ID NO: 659473 - DNA, 25 bp, Homo sapien
gcagtgctgagaagccgtcctctga

SEQ ID NO: 659474 - DNA, 25 bp, Homo sapien
agaagccgtcctctgacgtggacat

SEQ ID NO: 659475 - DNA, 25 bp, Homo sapien
tgacgtggacatcagcacacacagc

SEQ ID NO: 659476 - DNA, 25 bp, Homo sapien
cagcttgcctttggcacgggagcca

SEQ ID NO: 659477 - DNA, 25 bp, Homo sapien
cacccgccgctgagactgaagaaat

SEQ ID NO: 659478 - DNA, 25 bp, Homo sapien
gccgctgagactgaagaaatccttt

SEQ ID NO: 659479 - DNA, 25 bp, Homo sapien
attttggtgagaaagcctatgtcct

SEQ ID NO: 659480 - DNA, 25 bp, Homo sapien
aaagcctatgtcctccaagcccaag

SEQ ID NO: 659481 - DNA, 25 bp, Homo sapien
aaggctcaagagactgggcaaatta

SEQ ID NO: 659482 - DNA, 25 bp, Homo sapien
attcatatcatttcattagagcaaa

SEQ ID NO: 659483 - DNA, 25 bp, Homo sapien
tcattagagcaaaatttcactgtaa

SEQ ID NO: 659484 - DNA, 25 bp, Homo sapien
gaagttattagctagaccttgaaaa

SEQ ID NO: 659485 - DNA, 25 bp, Homo sapien
ctaatgtgatttgacttgtttataa

SEQ ID NO: 659486 - DNA, 25 bp, Homo sapien
cttaaagctagttttatctgtcata

SEQ ID NO: 659487 - DNA, 25 bp, Homo sapien
gttttatctgtcatagcttattata

SEQ ID NO: 659488 - DNA, 25 bp, Homo sapien
gaggtttcattattgtttttcaaga

SEQ ID NO: 659489 - DNA, 25 bp, Homo sapien
atgccaaattgctaaatctcaatgg

SEQ ID NO: 659490 - DNA, 25 bp, Homo sapien
atgtgtatatgtctgaagagcaaag

SEQ ID NO: 659491 - DNA, 25 bp, Homo sapien
gagcaaagactacatgcatttttat

SEQ ID NO: 659492 - DNA, 25 bp, Homo sapien
gttttcaatttagcagcctttcaaa

SEQ ID NO: 659493 - DNA, 25 bp, Homo sapien
tagcagcctttcaaatgtatatggt

SEQ ID NO: 659494 - DNA, 25 bp, Homo sapien
gcctttcaaatgtatatggttctgg

SEQ ID NO: 659495 - DNA, 25 bp, Homo sapien
caaatgtatatggttctggccacat

SEQ ID NO: 659496 - DNA, 25 bp, Homo sapien
gtatatggttctggccacattaaag

SEQ ID NO: 659497 - DNA, 25 bp, Homo sapien
ggttctggccacattaaagttgcaa

SEQ ID NO: 659498 - DNA, 25 bp, Homo sapien
ttgttacaaccaaaatgcaggctct

SEQ ID NO: 659499 - DNA, 25 bp, Homo sapien
ttacaaccaaaatgcaggctctatt

SEQ ID NO: 659500 - DNA, 25 bp, Homo sapien
aaccaaaatgcaggctctattgttt

SEQ ID NO: 659501 - DNA, 25 bp, Homo sapien
caaaatgcaggctctattgttttca

SEQ ID NO: 659502 - DNA, 25 bp, Homo sapien
gcaggctctattgttttcaatttag

SEQ ID NO: 659503 - DNA, 25 bp, Homo sapien
taggttccatgcctacttcaactaa

SEQ ID NO: 659504 - DNA, 25 bp, Homo sapien
aatgtggacactgccagtttccaga

SEQ ID NO: 659505 - DNA, 25 bp, Homo sapien
agtttccagagccaggacttatgaa

SEQ ID NO: 659506 - DNA, 25 bp, Homo sapien
gaagctggcagtttgtattctccgc

SEQ ID NO: 659507 - DNA, 25 bp, Homo sapien
gcagtttgtattctccgctatttga

SEQ ID NO: 659508 - DNA, 25 bp, Homo sapien
aatactgtctctgggagcaatggac

SEQ ID NO: 659509 - DNA, 25 bp, Homo sapien
ggagcaatggacttcaaactctgaa

SEQ ID NO: 659510 - DNA, 25 bp, Homo sapien
aactctgaagccaccatgctaatgt

SEQ ID NO: 659511 - DNA, 25 bp, Homo sapien
atgtggctgcatgtaggtgttctag

SEQ ID NO: 659512 - DNA, 25 bp, Homo sapien
ggtgttctagccaatagttccaact

SEQ ID NO: 659513 - DNA, 25 bp, Homo sapien
ctcatatgtaagttgctttgctgga

SEQ ID NO: 659514 - DNA, 25 bp, Homo sapien
actcagttggcccatcaccaaatat

SEQ ID NO: 659515 - DNA, 25 bp, Homo sapien
ttggcccatcaccaaatatttcctg

SEQ ID NO: 659516 - DNA, 25 bp, Homo sapien
tttcctgagcactaagtgccaggcc

SEQ ID NO: 659517 - DNA, 25 bp, Homo sapien
taagtgccaggccaagggatcttgc

SEQ ID NO: 659518 - DNA, 25 bp, Homo sapien
ccaagggatcttgcaggaaaccggt

SEQ ID NO: 659519 - DNA, 25 bp, Homo sapien
aaaccggtgggcaagtcaggcaact

SEQ ID NO: 659520 - DNA, 25 bp, Homo sapien
gggcaagtcaggcaactcatgaacc

SEQ ID NO: 659521 - DNA, 25 bp, Homo sapien
actcatgaaccttggaagggaactt

SEQ ID NO: 659522 - DNA, 25 bp, Homo sapien
ggaactttcttcaattaaaattgca

SEQ ID NO: 659523 - DNA, 25 bp, Homo sapien
gtctcagcaggctgggtcttcacca

SEQ ID NO: 659524 - DNA, 25 bp, Homo sapien
cagcaggctgggtcttcaccactgg

SEQ ID NO: 659525 - DNA, 25 bp, Homo sapien
actaagacttcctacactcaatctc

SEQ ID NO: 659526 - DNA, 25 bp, Homo sapien
agacttcctacactcaatctctgga

SEQ ID NO: 659527 - DNA, 25 bp, Homo sapien
ttcctacactcaatctctggactgt

SEQ ID NO: 659528 - DNA, 25 bp, Homo sapien
tcctacactcaatctctggactgta

SEQ ID NO: 659529 - DNA, 25 bp, Homo sapien
ctacactcaatctctggactgtaaa

SEQ ID NO: 659530 - DNA, 25 bp, Homo sapien
acactcaatctctggactgtaaatg

SEQ ID NO: 659531 - DNA, 25 bp, Homo sapien
actcaatctctggactgtaaatgct

SEQ ID NO: 659532 - DNA, 25 bp, Homo sapien
ctcaatctctggactgtaaatgctg

SEQ ID NO: 659533 - DNA, 25 bp, Homo sapien
caatctctggactgtaaatgctggg

SEQ ID NO: 659534 - DNA, 25 bp, Homo sapien
tcaactctaagacttcaattacaag

SEQ ID NO: 659535 - DNA, 25 bp, Homo sapien
aactctaagacttcaattacaagat

SEQ ID NO: 659536 - DNA, 25 bp, Homo sapien
taactgtgtgtttattatatgccca

SEQ ID NO: 659537 - DNA, 25 bp, Homo sapien
gtgtgtttattatatgcccacatat

SEQ ID NO: 659538 - DNA, 25 bp, Homo sapien
cacatattttttcctgctgtctaat

SEQ ID NO: 659539 - DNA, 25 bp, Homo sapien
tttcctgctgtctaattttactttg

SEQ ID NO: 659540 - DNA, 25 bp, Homo sapien
tgctgtctaattttactttggtttt

SEQ ID NO: 659541 - DNA, 25 bp, Homo sapien
ggttttatatacatactcttaggat

SEQ ID NO: 659542 - DNA, 25 bp, Homo sapien
acatactcttaggatctttactcac

SEQ ID NO: 659543 - DNA, 25 bp, Homo sapien
ggatctttactcacctaatgctgta

SEQ ID NO: 659544 - DNA, 25 bp, Homo sapien
gctgtattttgaacactttcctgtg

SEQ ID NO: 659545 - DNA, 25 bp, Homo sapien
ttttgaacactttcctgtgccattt

SEQ ID NO: 659546 - DNA, 25 bp, Homo sapien
caaagatctgtttagcattctgttt

SEQ ID NO: 659547 - DNA, 25 bp, Homo sapien
cagatttcatgcctattgagggcct

SEQ ID NO: 659548 - DNA, 25 bp, Homo sapien
gatttcatgcctattgagggcctgc

SEQ ID NO: 659549 - DNA, 25 bp, Homo sapien
tttcatgcctattgagggcctgctt

SEQ ID NO: 659550 - DNA, 25 bp, Homo sapien
ttcatgcctattgagggcctgcttt

SEQ ID NO: 659551 - DNA, 25 bp, Homo sapien
catgcctattgagggcctgctttct

SEQ ID NO: 659552 - DNA, 25 bp, Homo sapien
ctattgagggcctgctttctgatta

SEQ ID NO: 659553 - DNA, 25 bp, Homo sapien
attgagggcctgctttctgattata

SEQ ID NO: 659554 - DNA, 25 bp, Homo sapien
tgagggcctgctttctgattataga

SEQ ID NO: 659555 - DNA, 25 bp, Homo sapien
gagggcctgctttctgattatagaa

SEQ ID NO: 659556 - DNA, 25 bp, Homo sapien
agggcctgctttctgattatagaag

SEQ ID NO: 659557 - DNA, 25 bp, Homo sapien
gattatagaaggtgacttcttgctg

SEQ ID NO: 659558 - DNA, 25 bp, Homo sapien
taaaaagccgagagtaggggtgcgt

SEQ ID NO: 659559 - DNA, 25 bp, Homo sapien
aaaaagccgagagtaggggtgcgtg

SEQ ID NO: 659560 - DNA, 25 bp, Homo sapien
aaaagccgagagtaggggtgcgtgc

SEQ ID NO: 659561 - DNA, 25 bp, Homo sapien
ccagctactaggaagtcttgggggt

SEQ ID NO: 659562 - DNA, 25 bp, Homo sapien
cagctactaggaagtcttgggggtg

SEQ ID NO: 659563 - DNA, 25 bp, Homo sapien
agctactaggaagtcttgggggtgt

SEQ ID NO: 659564 - DNA, 25 bp, Homo sapien
gctactaggaagtcttgggggtgta

SEQ ID NO: 659565 - DNA, 25 bp, Homo sapien
cttgggggtgtaggggatcgcttga

SEQ ID NO: 659566 - DNA, 25 bp, Homo sapien
ggtgaggagaccctgtcctaaattt

SEQ ID NO: 659567 - DNA, 25 bp, Homo sapien
gtgaggagaccctgtcctaaattta

SEQ ID NO: 659568 - DNA, 25 bp, Homo sapien
atgcagctatttaagatgatgtttt

SEQ ID NO: 659569 - DNA, 25 bp, Homo sapien
aaagaactgtcaatgatgtttgaag

SEQ ID NO: 659570 - DNA, 25 bp, Homo sapien
gatgtttgaagatgttcacaataag

SEQ ID NO: 659571 - DNA, 25 bp, Homo sapien
cagactataaaaccacatgcattat

SEQ ID NO: 659572 - DNA, 25 bp, Homo sapien
aaaccacatgcattatatagtccca

SEQ ID NO: 659573 - DNA, 25 bp, Homo sapien
gcattatatagtcccatttttactt

SEQ ID NO: 659574 - DNA, 25 bp, Homo sapien
aacccctcaagatagatccaaaaca

SEQ ID NO: 659575 - DNA, 25 bp, Homo sapien
gatccaaaacattaccagtggtttg

SEQ ID NO: 659576 - DNA, 25 bp, Homo sapien
cagtggtttgatctgggtgatgaaa

SEQ ID NO: 659577 - DNA, 25 bp, Homo sapien
gattttaaacttgcttcattatgct

SEQ ID NO: 659578 - DNA, 25 bp, Homo sapien
tttaaacttgcttcattatgctttt

SEQ ID NO: 659579 - DNA, 25 bp, Homo sapien
ttttcagttacttccgtcagcccct

SEQ ID NO: 659580 - DNA, 25 bp, Homo sapien
tccctcaccacctttgttagaatat

SEQ ID NO: 659581 - DNA, 25 bp, Homo sapien
ttgtaatacagtgaaatcctcatgt

SEQ ID NO: 659582 - DNA, 25 bp, Homo sapien
gtcataatctgcattctttcctagg

SEQ ID NO: 659583 - DNA, 25 bp, Homo sapien
attctttcctaggataccctgactt

SEQ ID NO: 659584 - DNA, 25 bp, Homo sapien
taggataccctgacttcctgcataa

SEQ ID NO: 659585 - DNA, 25 bp, Homo sapien
cctgacttcctgcataactttttaa

SEQ ID NO: 659586 - DNA, 25 bp, Homo sapien
gtaaagttctacaggatttgataaa

SEQ ID NO: 659587 - DNA, 25 bp, Homo sapien
ggatttgataaatgcataacgtcat

SEQ ID NO: 659588 - DNA, 25 bp, Homo sapien
cataacgtcatgcatccaccattaa

SEQ ID NO: 659589 - DNA, 25 bp, Homo sapien
gtcatgcatccaccattaaagaatc

SEQ ID NO: 659590 - DNA, 25 bp, Homo sapien
gacaatgagtctcatgatctcccta

SEQ ID NO: 659591 - DNA, 25 bp, Homo sapien
acaatgagtctcatgatctccctac

SEQ ID NO: 659592 - DNA, 25 bp, Homo sapien
caatgagtctcatgatctccctacc

SEQ ID NO: 659593 - DNA, 25 bp, Homo sapien
atgagtctcatgatctccctaccca

SEQ ID NO: 659594 - DNA, 25 bp, Homo sapien
atctccctacccagcaccttgtgac

SEQ ID NO: 659595 - DNA, 25 bp, Homo sapien
gagataaccatctttaactgtaact

SEQ ID NO: 659596 - DNA, 25 bp, Homo sapien
tgtgatttgttcctgtcccaccttt

SEQ ID NO: 659597 - DNA, 25 bp, Homo sapien
tgacatttcttctcctggacaatga

SEQ ID NO: 659598 - DNA, 25 bp, Homo sapien
ctcctggacaatgagtctcatgatc

SEQ ID NO: 659599 - DNA, 25 bp, Homo sapien
tcctggacaatgagtctcatgatct

SEQ ID NO: 659600 - DNA, 25 bp, Homo sapien
ggacaatgagtctcatgatctccct

SEQ ID NO: 659601 - DNA, 25 bp, Homo sapien
gccactatgccagccaatatatgta

SEQ ID NO: 659602 - DNA, 25 bp, Homo sapien
aactgctgtgtagtaatcaactgta

SEQ ID NO: 659603 - DNA, 25 bp, Homo sapien
aatcaactgtatgaatattccacat

SEQ ID NO: 659604 - DNA, 25 bp, Homo sapien
tttattcattctcccaccagtagac

SEQ ID NO: 659605 - DNA, 25 bp, Homo sapien
accagtagacaatgtgtgctttcct

SEQ ID NO: 659606 - DNA, 25 bp, Homo sapien
atgtgtgctttcctaatttccatgc

SEQ ID NO: 659607 - DNA, 25 bp, Homo sapien
ttcctaatttccatgcttcttatta

SEQ ID NO: 659608 - DNA, 25 bp, Homo sapien
atattgttgtggaacagccttgtac

SEQ ID NO: 659609 - DNA, 25 bp, Homo sapien
aacagccttgtacaagtctcctgtg

SEQ ID NO: 659610 - DNA, 25 bp, Homo sapien
cctgtgcctatgtttgagttgtatc

SEQ ID NO: 659611 - DNA, 25 bp, Homo sapien
gtatcagagttggaattgctgcttg

SEQ ID NO: 659612 - DNA, 25 bp, Homo sapien
acttacgataatagccttctgcatc

SEQ ID NO: 659613 - DNA, 25 bp, Homo sapien
ataatagccttctgcatcggtccag

SEQ ID NO: 659614 - DNA, 25 bp, Homo sapien
gcatcggtccagttatctctgaggt

SEQ ID NO: 659615 - DNA, 25 bp, Homo sapien
tcggtccagttatctctgaggttgg

SEQ ID NO: 659616 - DNA, 25 bp, Homo sapien
tgaaatcttttccaatgccagcggc

SEQ ID NO: 659617 - DNA, 25 bp, Homo sapien
ttttccaatgccagcggcccgaaga

SEQ ID NO: 659618 - DNA, 25 bp, Homo sapien
ggcccgaagacgagcactctgaaat

SEQ ID NO: 659619 - DNA, 25 bp, Homo sapien
ggcaacatgaacagtttacccactt

SEQ ID NO: 659620 - DNA, 25 bp, Homo sapien
agtttacccacttgtcagacatcta

SEQ ID NO: 659621 - DNA, 25 bp, Homo sapien
acttgtcagacatctaacgcacttc

SEQ ID NO: 659622 - DNA, 25 bp, Homo sapien
gacatctaacgcacttcctttaaaa

SEQ ID NO: 659623 - DNA, 25 bp, Homo sapien
gtccttgagagccagtccttgtgaa

SEQ ID NO: 659624 - DNA, 25 bp, Homo sapien
cttgagagccagtccttgtgaacag

SEQ ID NO: 659625 - DNA, 25 bp, Homo sapien
ttgagagccagtccttgtgaacagg

SEQ ID NO: 659626 - DNA, 25 bp, Homo sapien
cagtccttgtgaacaggggccaaaa

SEQ ID NO: 659627 - DNA, 25 bp, Homo sapien
caggggccaaaaatattctcttaat

SEQ ID NO: 659628 - DNA, 25 bp, Homo sapien
aatattctcttaattttgatgcctt

SEQ ID NO: 659629 - DNA, 25 bp, Homo sapien
attctcttaattttgatgccttatt

SEQ ID NO: 659630 - DNA, 25 bp, Homo sapien
cttaattttgatgccttatttattt

SEQ ID NO: 659631 - DNA, 25 bp, Homo sapien
tttatttatttacagccacgccagt

SEQ ID NO: 659632 - DNA, 25 bp, Homo sapien
tttatttacagccacgccagttcct

SEQ ID NO: 659633 - DNA, 25 bp, Homo sapien
gttcctgggcctgcttaggttgaag

SEQ ID NO: 659634 - DNA, 25 bp, Homo sapien
aattacccgggcttggtggagtgca

SEQ ID NO: 659635 - DNA, 25 bp, Homo sapien
attacccgggcttggtggagtgcac

SEQ ID NO: 659636 - DNA, 25 bp, Homo sapien
ttacccgggcttggtggagtgcacc

SEQ ID NO: 659637 - DNA, 25 bp, Homo sapien
tacccgggcttggtggagtgcacct

SEQ ID NO: 659638 - DNA, 25 bp, Homo sapien
acccgggcttggtggagtgcacctg

SEQ ID NO: 659639 - DNA, 25 bp, Homo sapien
cccgggcttggtggagtgcacctgt

SEQ ID NO: 659640 - DNA, 25 bp, Homo sapien
ttgcagggaacctagatcgtgccat

SEQ ID NO: 659641 - DNA, 25 bp, Homo sapien
tgcagggaacctagatcgtgccatt

SEQ ID NO: 659642 - DNA, 25 bp, Homo sapien
gcagggaacctagatcgtgccattg

SEQ ID NO: 659643 - DNA, 25 bp, Homo sapien
cagggaacctagatcgtgccattgc

SEQ ID NO: 659644 - DNA, 25 bp, Homo sapien
ggagacaagagcaagacgctgtctc

SEQ ID NO: 659645 - DNA, 25 bp, Homo sapien
cagttatgtgtgtttccctacaatc

SEQ ID NO: 659646 - DNA, 25 bp, Homo sapien
agttatgtgtgtttccctacaatca

SEQ ID NO: 659647 - DNA, 25 bp, Homo sapien
gtgtgtttccctacaatcaaacaat

SEQ ID NO: 659648 - DNA, 25 bp, Homo sapien
tgtgtttccctacaatcaaacaatg

SEQ ID NO: 659649 - DNA, 25 bp, Homo sapien
gtgtttccctacaatcaaacaatga

SEQ ID NO: 659650 - DNA, 25 bp, Homo sapien
tgtttccctacaatcaaacaatgat

SEQ ID NO: 659651 - DNA, 25 bp, Homo sapien
gtttccctacaatcaaacaatgatt

SEQ ID NO: 659652 - DNA, 25 bp, Homo sapien
tttccctacaatcaaacaatgattt

SEQ ID NO: 659653 - DNA, 25 bp, Homo sapien
ttccctacaatcaaacaatgattta

SEQ ID NO: 659654 - DNA, 25 bp, Homo sapien
tctactgagtactaagtatggtcgt

SEQ ID NO: 659655 - DNA, 25 bp, Homo sapien
aagtatggtcgttaatagtctaata

SEQ ID NO: 659656 - DNA, 25 bp, Homo sapien
aacagtctctggaaaaagtctttct

SEQ ID NO: 659657 - DNA, 25 bp, Homo sapien
aagtctttctgcaagctttttgaag

SEQ ID NO: 659658 - DNA, 25 bp, Homo sapien
gaagcttcagggattgctacaaaga

SEQ ID NO: 659659 - DNA, 25 bp, Homo sapien
ggaaaatcgatcttgaactcagcct

SEQ ID NO: 659660 - DNA, 25 bp, Homo sapien
ttgaactcagccttttaatttcttt

SEQ ID NO: 659661 - DNA, 25 bp, Homo sapien
atttcttttcatgattactgttctc

SEQ ID NO: 659662 - DNA, 25 bp, Homo sapien
tcatgattactgttctcaaatggag

SEQ ID NO: 659663 - DNA, 25 bp, Homo sapien
ttaatgctgtcttagttcacttgcc

SEQ ID NO: 659664 - DNA, 25 bp, Homo sapien
gtcttagttcacttgcctcaaaata

SEQ ID NO: 659665 - DNA, 25 bp, Homo sapien
gctcagaataaagcgattccacagc

SEQ ID NO: 659666 - DNA, 25 bp, Homo sapien
gggttcatggctccactgtctctaa

SEQ ID NO: 659667 - DNA, 25 bp, Homo sapien
tccactgtctctaaggcagctgagg

SEQ ID NO: 659668 - DNA, 25 bp, Homo sapien
cactgtctctaaggcagctgagggt

SEQ ID NO: 659669 - DNA, 25 bp, Homo sapien
aggagcctccatggtgggctgggcc

SEQ ID NO: 659670 - DNA, 25 bp, Homo sapien
cttggttttcagtgagtgctgcgtc

SEQ ID NO: 659671 - DNA, 25 bp, Homo sapien
gttttcagtgagtgctgcgtcccca

SEQ ID NO: 659672 - DNA, 25 bp, Homo sapien
tcagtgagtgctgcgtccccagtag

SEQ ID NO: 659673 - DNA, 25 bp, Homo sapien
tccccagtagggatggcgcccacag

SEQ ID NO: 659674 - DNA, 25 bp, Homo sapien
tgtgacctcggccagtgtccaccca

SEQ ID NO: 659675 - DNA, 25 bp, Homo sapien
ggggcccagcaccagctcagaataa

SEQ ID NO: 659676 - DNA, 25 bp, Homo sapien
gaggctttcaaattctctgcttcct

SEQ ID NO: 659677 - DNA, 25 bp, Homo sapien
gctttcaaattctctgcttcctgaa

SEQ ID NO: 659678 - DNA, 25 bp, Homo sapien
attctctgcttcctgaattctacta

SEQ ID NO: 659679 - DNA, 25 bp, Homo sapien
ctctgcttcctgaattctactaatt

SEQ ID NO: 659680 - DNA, 25 bp, Homo sapien
ttctactaattcaccaacacaaatt

SEQ ID NO: 659681 - DNA, 25 bp, Homo sapien
acacaaattattattatccatcttt

SEQ ID NO: 659682 - DNA, 25 bp, Homo sapien
ggtgagcatctttcaatatgcttat

SEQ ID NO: 659683 - DNA, 25 bp, Homo sapien
ttatttatatcctttgtccactttt

SEQ ID NO: 659684 - DNA, 25 bp, Homo sapien
taatgagattacttgtgcttttatt

SEQ ID NO: 659685 - DNA, 25 bp, Homo sapien
agattacttgtgcttttattattga

SEQ ID NO: 659686 - DNA, 25 bp, Homo sapien
atatattatagatacaagtgccata

SEQ ID NO: 659687 - DNA, 25 bp, Homo sapien
tagatttttctctacacagaaaatt

SEQ ID NO: 659688 - DNA, 25 bp, Homo sapien
ttttttaaaaataggcagggcatga

SEQ ID NO: 659689 - DNA, 25 bp, Homo sapien
agggcatgatggctgacacctttaa

SEQ ID NO: 659690 - DNA, 25 bp, Homo sapien
gacagggagtatgtgagaaatttct

SEQ ID NO: 659691 - DNA, 25 bp, Homo sapien
gagaaatttctgtactttcccttca

SEQ ID NO: 659692 - DNA, 25 bp, Homo sapien
ctgtactttcccttcaattttgcta

SEQ ID NO: 659693 - DNA, 25 bp, Homo sapien
gtactttcccttcaattttgctatg

SEQ ID NO: 659694 - DNA, 25 bp, Homo sapien
tttgctatgaatccaaaactgcttc

SEQ ID NO: 659695 - DNA, 25 bp, Homo sapien
tgctatgaatccaaaactgcttcaa

SEQ ID NO: 659696 - DNA, 25 bp, Homo sapien
gctatgaatccaaaactgcttcaaa

SEQ ID NO: 659697 - DNA, 25 bp, Homo sapien
atgaatccaaaactgcttcaaaaaa

SEQ ID NO: 659698 - DNA, 25 bp, Homo sapien
aatctggctctgataatttctcctt

SEQ ID NO: 659699 - DNA, 25 bp, Homo sapien
atttctcctttatctccatgtttca

SEQ ID NO: 659700 - DNA, 25 bp, Homo sapien
aactaaggaagcctctcaagcctga

SEQ ID NO: 659701 - DNA, 25 bp, Homo sapien
gaagcctctcaagcctgaataactt

SEQ ID NO: 659702 - DNA, 25 bp, Homo sapien
ggcgatattatcaaccattctaacg

SEQ ID NO: 659703 - DNA, 25 bp, Homo sapien
tctaacggatatgtggtggtaactc

SEQ ID NO: 659704 - DNA, 25 bp, Homo sapien
aactcattgaggttttaactttgca

SEQ ID NO: 659705 - DNA, 25 bp, Homo sapien
tactttttagtgtgcatactggcca

SEQ ID NO: 659706 - DNA, 25 bp, Homo sapien
agtgtgcatactggccattctttta

SEQ ID NO: 659707 - DNA, 25 bp, Homo sapien
taaatcttttgcctattggtgttga

SEQ ID NO: 659708 - DNA, 25 bp, Homo sapien
gcctattggtgttgaattatcttat

SEQ ID NO: 659709 - DNA, 25 bp, Homo sapien
tatgagggagtcagaggctaccatc

SEQ ID NO: 659710 - DNA, 25 bp, Homo sapien
gggagtcagaggctaccatctaaaa

SEQ ID NO: 659711 - DNA, 25 bp, Homo sapien
gaggctaccatctaaaactgaaaga

SEQ ID NO: 659712 - DNA, 25 bp, Homo sapien
cagtgtactgtaaaagctattaata

SEQ ID NO: 659713 - DNA, 25 bp, Homo sapien
gtaagcgtgacgaagactttccaaa

SEQ ID NO: 659714 - DNA, 25 bp, Homo sapien
gcgtgacgaagactttccaaaatac

SEQ ID NO: 659715 - DNA, 25 bp, Homo sapien
agggacaaagaaaaccatgatggaa

SEQ ID NO: 659716 - DNA, 25 bp, Homo sapien
acagtacataatgcataccctaatg

SEQ ID NO: 659717 - DNA, 25 bp, Homo sapien
tgagagcaaacataaaggccaggac

SEQ ID NO: 659718 - DNA, 25 bp, Homo sapien
aaaggccaggacaaatatgtaccag

SEQ ID NO: 659719 - DNA, 25 bp, Homo sapien
tatgtaccaggcaaatagaaacccc

SEQ ID NO: 659720 - DNA, 25 bp, Homo sapien
ccctgccggcaaaacgttgctctta

SEQ ID NO: 659721 - DNA, 25 bp, Homo sapien
cctgccggcaaaacgttgctcttaa

SEQ ID NO: 659722 - DNA, 25 bp, Homo sapien
ctgccggcaaaacgttgctcttaac

SEQ ID NO: 659723 - DNA, 25 bp, Homo sapien
tgccggcaaaacgttgctcttaact

SEQ ID NO: 659724 - DNA, 25 bp, Homo sapien
gccggcaaaacgttgctcttaactt

SEQ ID NO: 659725 - DNA, 25 bp, Homo sapien
cggcaaaacgttgctcttaacttca

SEQ ID NO: 659726 - DNA, 25 bp, Homo sapien
ggcaaaacgttgctcttaacttcac

SEQ ID NO: 659727 - DNA, 25 bp, Homo sapien
gcaaaacgttgctcttaacttcacc

SEQ ID NO: 659728 - DNA, 25 bp, Homo sapien
gttgctcttaacttcaccgcctatc

SEQ ID NO: 659729 - DNA, 25 bp, Homo sapien
aatgataatccaccacccttcgctg

SEQ ID NO: 659730 - DNA, 25 bp, Homo sapien
cacccttcgctgactcttttttcgg

SEQ ID NO: 659731 - DNA, 25 bp, Homo sapien
aagaaagttacctctcaccacactt

SEQ ID NO: 659732 - DNA, 25 bp, Homo sapien
acacttcttttcaccatcatactgg

SEQ ID NO: 659733 - DNA, 25 bp, Homo sapien
ttcttttcaccatcatactggcgtc

SEQ ID NO: 659734 - DNA, 25 bp, Homo sapien
atactggcgtcccatctaatgcaat

SEQ ID NO: 659735 - DNA, 25 bp, Homo sapien
tggcgtcccatctaatgcaataaga

SEQ ID NO: 659736 - DNA, 25 bp, Homo sapien
gatagtctatgtggataatcccaaa

SEQ ID NO: 659737 - DNA, 25 bp, Homo sapien
gtggataatcccaaagaattagcaa

SEQ ID NO: 659738 - DNA, 25 bp, Homo sapien
taaccatctgggaactagtaagtga

SEQ ID NO: 659739 - DNA, 25 bp, Homo sapien
gagtacagcaaggtgtaggatacaa

SEQ ID NO: 659740 - DNA, 25 bp, Homo sapien
aaaagtcaattgcttgcctgtatag

SEQ ID NO: 659741 - DNA, 25 bp, Homo sapien
agcagcattaacctattggaatttg

SEQ ID NO: 659742 - DNA, 25 bp, Homo sapien
gacagtaatttaacctctttcaaga

SEQ ID NO: 659743 - DNA, 25 bp, Homo sapien
ttaacctctttcaagagtttcaggc

SEQ ID NO: 659744 - DNA, 25 bp, Homo sapien
taacctctttcaagagtttcaggcc

SEQ ID NO: 659745 - DNA, 25 bp, Homo sapien
aacctctttcaagagtttcaggccg

SEQ ID NO: 659746 - DNA, 25 bp, Homo sapien
acctctttcaagagtttcaggccgg

SEQ ID NO: 659747 - DNA, 25 bp, Homo sapien
cctctttcaagagtttcaggccggg

SEQ ID NO: 659748 - DNA, 25 bp, Homo sapien
ctctttcaagagtttcaggccgggt

SEQ ID NO: 659749 - DNA, 25 bp, Homo sapien
tctttcaagagtttcaggccgggtg

SEQ ID NO: 659750 - DNA, 25 bp, Homo sapien
ctttcaagagtttcaggccgggtgc

SEQ ID NO: 659751 - DNA, 25 bp, Homo sapien
tttcaagagtttcaggccgggtgca

SEQ ID NO: 659752 - DNA, 25 bp, Homo sapien
cgggaggctggagtcccagttactt

SEQ ID NO: 659753 - DNA, 25 bp, Homo sapien
agctgggagagaaaggacacactct

SEQ ID NO: 659754 - DNA, 25 bp, Homo sapien
agcgatgtactagctgctcacaagc

SEQ ID NO: 659755 - DNA, 25 bp, Homo sapien
gtactagctgctcacaagcctgttc

SEQ ID NO: 659756 - DNA, 25 bp, Homo sapien
tccttcttccattgtagggcatgaa

SEQ ID NO: 659757 - DNA, 25 bp, Homo sapien
gggcatgaagaattcccttatcact

SEQ ID NO: 659758 - DNA, 25 bp, Homo sapien
gaattcccttatcactgggtaagaa

SEQ ID NO: 659759 - DNA, 25 bp, Homo sapien
ggaacagaagtttttctcatgccta

SEQ ID NO: 659760 - DNA, 25 bp, Homo sapien
gaagtttttctcatgcctaattttg

SEQ ID NO: 659761 - DNA, 25 bp, Homo sapien
catgcctaattttgcgttttcagta

SEQ ID NO: 659762 - DNA, 25 bp, Homo sapien
gcgttttcagtaaggtctttttcag

SEQ ID NO: 659763 - DNA, 25 bp, Homo sapien
taaggtctttttcagcttgtccagg

SEQ ID NO: 659764 - DNA, 25 bp, Homo sapien
gcagattagagagcgtttggattta

SEQ ID NO: 659765 - DNA, 25 bp, Homo sapien
tagatactatcctctacagtagtgg

SEQ ID NO: 659766 - DNA, 25 bp, Homo sapien
tcctctacagtagtggtcttcaatg

SEQ ID NO: 659767 - DNA, 25 bp, Homo sapien
cttcaatgtgtgatccagggacccc

SEQ ID NO: 659768 - DNA, 25 bp, Homo sapien
aaggccctctcagaagctccaagag

SEQ ID NO: 659769 - DNA, 25 bp, Homo sapien
aatactgaggcattgtttccccttt

SEQ ID NO: 659770 - DNA, 25 bp, Homo sapien
tttttactacggtgaccatttgtat

SEQ ID NO: 659771 - DNA, 25 bp, Homo sapien
aaactgctggcaccttagcaggaag

SEQ ID NO: 659772 - DNA, 25 bp, Homo sapien
gcaggacggtaatgccaagctgtac

SEQ ID NO: 659773 - DNA, 25 bp, Homo sapien
gctgtaccagcagtcatggtattct

SEQ ID NO: 659774 - DNA, 25 bp, Homo sapien
ggtattcttcattactgtgcagttg

SEQ ID NO: 659775 - DNA, 25 bp, Homo sapien
cctggccaacataaggagacctaag

SEQ ID NO: 659776 - DNA, 25 bp, Homo sapien
ctggccaacataaggagacctaagt

SEQ ID NO: 659777 - DNA, 25 bp, Homo sapien
ggccaacataaggagacctaagtgc

SEQ ID NO: 659778 - DNA, 25 bp, Homo sapien
ccaacataaggagacctaagtgcct

SEQ ID NO: 659779 - DNA, 25 bp, Homo sapien
caacataaggagacctaagtgccta

SEQ ID NO: 659780 - DNA, 25 bp, Homo sapien
aacataaggagacctaagtgcctaa

SEQ ID NO: 659781 - DNA, 25 bp, Homo sapien
acataaggagacctaagtgcctaac

SEQ ID NO: 659782 - DNA, 25 bp, Homo sapien
cataaggagacctaagtgcctaact

SEQ ID NO: 659783 - DNA, 25 bp, Homo sapien
ggtctggatcagagccccccctttt

SEQ ID NO: 659784 - DNA, 25 bp, Homo sapien
cccttttccagtaacaccagcactt

SEQ ID NO: 659785 - DNA, 25 bp, Homo sapien
cactttgtgggaaagacagaggcgg

SEQ ID NO: 659786 - DNA, 25 bp, Homo sapien
gaagcaatgtacttcttaacatata

SEQ ID NO: 659787 - DNA, 25 bp, Homo sapien
cttaacatatattgactgatgtctc

SEQ ID NO: 659788 - DNA, 25 bp, Homo sapien
attgactgatgtctcatgatgtctc

SEQ ID NO: 659789 - DNA, 25 bp, Homo sapien
tgtctcatgatgtctccctaaatgt

SEQ ID NO: 659790 - DNA, 25 bp, Homo sapien
atgtatgaaaccaagctgtgcctga

SEQ ID NO: 659791 - DNA, 25 bp, Homo sapien
tgtgcctgacaaccttggacatatt

SEQ ID NO: 659792 - DNA, 25 bp, Homo sapien
gcctgacaaccttggacatattttg

SEQ ID NO: 659793 - DNA, 25 bp, Homo sapien
gacatattttgtcaagacttccctg

SEQ ID NO: 659794 - DNA, 25 bp, Homo sapien
ttccctgaggctgtcattggtgcat

SEQ ID NO: 659795 - DNA, 25 bp, Homo sapien
ccctgaggctgtcattggtgcatcc

SEQ ID NO: 659796 - DNA, 25 bp, Homo sapien
cattggtgcatcctcaaccttggca

SEQ ID NO: 659797 - DNA, 25 bp, Homo sapien
agaagcatctctgctttaagaacta

SEQ ID NO: 659798 - DNA, 25 bp, Homo sapien
gaagcatctctgctttaagaactag

SEQ ID NO: 659799 - DNA, 25 bp, Homo sapien
aagcatctctgctttaagaactagg

SEQ ID NO: 659800 - DNA, 25 bp, Homo sapien
agcatctctgctttaagaactaggc

SEQ ID NO: 659801 - DNA, 25 bp, Homo sapien
gcatctctgctttaagaactaggcc

SEQ ID NO: 659802 - DNA, 25 bp, Homo sapien
catctctgctttaagaactaggcca

SEQ ID NO: 659803 - DNA, 25 bp, Homo sapien
atctctgctttaagaactaggccag

SEQ ID NO: 659804 - DNA, 25 bp, Homo sapien
tctctgctttaagaactaggccagg

SEQ ID NO: 659805 - DNA, 25 bp, Homo sapien
ctctgctttaagaactaggccaggg

SEQ ID NO: 659806 - DNA, 25 bp, Homo sapien
gtctgggccaggagaggctaatcat

SEQ ID NO: 659807 - DNA, 25 bp, Homo sapien
aatggctaatgcactcacatgattc

SEQ ID NO: 659808 - DNA, 25 bp, Homo sapien
tgcactcacatgattcaaaattcaa

SEQ ID NO: 659809 - DNA, 25 bp, Homo sapien
aaattccaaaagaaccgacagtgca

SEQ ID NO: 659810 - DNA, 25 bp, Homo sapien
gaaccgacagtgcaaagtcgctcct

SEQ ID NO: 659811 - DNA, 25 bp, Homo sapien
agtgcaaagtcgctcctcctttggt

SEQ ID NO: 659812 - DNA, 25 bp, Homo sapien
cctctgcagagggaaccttgttgcc

SEQ ID NO: 659813 - DNA, 25 bp, Homo sapien
accttgttgccagttcttgtgtatt

SEQ ID NO: 659814 - DNA, 25 bp, Homo sapien
ttgttgccagttcttgtgtattctt

SEQ ID NO: 659815 - DNA, 25 bp, Homo sapien
gagatcttctatgtataaaccgtca

SEQ ID NO: 659816 - DNA, 25 bp, Homo sapien
tctatgtataaaccgtcatcctcct

SEQ ID NO: 659817 - DNA, 25 bp, Homo sapien
gttggttgtaccttgagattctgac

SEQ ID NO: 659818 - DNA, 25 bp, Homo sapien
gattctgacatctggttgaagtcca

SEQ ID NO: 659819 - DNA, 25 bp, Homo sapien
agtccaggttcactggcccaggaca

SEQ ID NO: 659820 - DNA, 25 bp, Homo sapien
gcccaggacaggtcattcagctgtt

SEQ ID NO: 659821 - DNA, 25 bp, Homo sapien
ggccatccactgaggtaatctccat

SEQ ID NO: 659822 - DNA, 25 bp, Homo sapien
tgaggtaatctccatgcagcatgaa

SEQ ID NO: 659823 - DNA, 25 bp, Homo sapien
tccatgcagcatgaaccactggttc

SEQ ID NO: 659824 - DNA, 25 bp, Homo sapien
atcaccatacttctcaggaatcgct

SEQ ID NO: 659825 - DNA, 25 bp, Homo sapien
ggaatcgctggtcactagactgaga

SEQ ID NO: 659826 - DNA, 25 bp, Homo sapien
catatcttactaatctctgtgttca

SEQ ID NO: 659827 - DNA, 25 bp, Homo sapien
agggtctagcactgagggagttctc

SEQ ID NO: 659828 - DNA, 25 bp, Homo sapien
gttcagaaagaagttataccgacca

SEQ ID NO: 659829 - DNA, 25 bp, Homo sapien
gaagttataccgaccatgttatata

SEQ ID NO: 659830 - DNA, 25 bp, Homo sapien
gggtcctattcagcttgttaaccat

SEQ ID NO: 659831 - DNA, 25 bp, Homo sapien
cctattcagcttgttaaccatgttt

SEQ ID NO: 659832 - DNA, 25 bp, Homo sapien
attcgagttatttatgatgtggcta

SEQ ID NO: 659833 - DNA, 25 bp, Homo sapien
ataagaagtctcaggaatggaatct

SEQ ID NO: 659834 - DNA, 25 bp, Homo sapien
taaaatctcaagaccttctttggaa

SEQ ID NO: 659835 - DNA, 25 bp, Homo sapien
tcatttagggcttggctgtgatgtc

SEQ ID NO: 659836 - DNA, 25 bp, Homo sapien
ctgtgatgtcaaggtcagccaatga

SEQ ID NO: 659837 - DNA, 25 bp, Homo sapien
atgtcaaggtcagccaatgagctta

SEQ ID NO: 659838 - DNA, 25 bp, Homo sapien
gtcagccaatgagcttagagggaat

SEQ ID NO: 659839 - DNA, 25 bp, Homo sapien
cactgtaggatgaatatggctaact

SEQ ID NO: 659840 - DNA, 25 bp, Homo sapien
ggatgaatatggctaactataattt

SEQ ID NO: 659841 - DNA, 25 bp, Homo sapien
tattgtatactgtcaaaagtctaga

SEQ ID NO: 659842 - DNA, 25 bp, Homo sapien
gtatactgtcaaaagtctagaagaa

SEQ ID NO: 659843 - DNA, 25 bp, Homo sapien
gagataatgcatatctggtttgatt

SEQ ID NO: 659844 - DNA, 25 bp, Homo sapien
atctggtttgattgttatacattgt

SEQ ID NO: 659845 - DNA, 25 bp, Homo sapien
ttaaaatatcactatgtatcccatg

SEQ ID NO: 659846 - DNA, 25 bp, Homo sapien
caatttaacattgtgcttcttagga

SEQ ID NO: 659847 - DNA, 25 bp, Homo sapien
ttaacattgtgcttcttaggatggg

SEQ ID NO: 659848 - DNA, 25 bp, Homo sapien
tgggcagggattggttaatggatac

SEQ ID NO: 659849 - DNA, 25 bp, Homo sapien
gaggaatgagttctggtgttctgga

SEQ ID NO: 659850 - DNA, 25 bp, Homo sapien
ttttacccaggccagtgcagagagg

SEQ ID NO: 659851 - DNA, 25 bp, Homo sapien
gaggtgttaccttttatcacttgat

SEQ ID NO: 659852 - DNA, 25 bp, Homo sapien
aaggtgatgatctttgccatgacag

SEQ ID NO: 659853 - DNA, 25 bp, Homo sapien
tgccatgacagttcccagatgtatt

SEQ ID NO: 659854 - DNA, 25 bp, Homo sapien
gatgtatttcaagcctttcctctaa

SEQ ID NO: 659855 - DNA, 25 bp, Homo sapien
tttcctctaagctctatgccagcat

SEQ ID NO: 659856 - DNA, 25 bp, Homo sapien
tatgccagcatatcttccctgagac

SEQ ID NO: 659857 - DNA, 25 bp, Homo sapien
atcttccctgagactgctctagcag

SEQ ID NO: 659858 - DNA, 25 bp, Homo sapien
gcagcctcctaaattctgtctttaa

SEQ ID NO: 659859 - DNA, 25 bp, Homo sapien
taatctgttctctgctcagcagtta

SEQ ID NO: 659860 - DNA, 25 bp, Homo sapien
aacagttcgattgcttttcataata

SEQ ID NO: 659861 - DNA, 25 bp, Homo sapien
gggacagtttttcctctaactcagg

SEQ ID NO: 659862 - DNA, 25 bp, Homo sapien
actcaggaatgaggatggttcaact

SEQ ID NO: 659863 - DNA, 25 bp, Homo sapien
ggatggttcaactcacactatttca

SEQ ID NO: 659864 - DNA, 25 bp, Homo sapien
tcacactatttcaagccttccaagt

SEQ ID NO: 659865 - DNA, 25 bp, Homo sapien
agccttccaagtaaacagtagttag

SEQ ID NO: 659866 - DNA, 25 bp, Homo sapien
gtaaaaacacaatacctgtctctaa

SEQ ID NO: 659867 - DNA, 25 bp, Homo sapien
acctgtctctaatattacttgccta

SEQ ID NO: 659868 - DNA, 25 bp, Homo sapien
attacttgcctaaatatatggacat

SEQ ID NO: 659869 - DNA, 25 bp, Homo sapien
gtaaatgtaagtcttgcagtcaagc

SEQ ID NO: 659870 - DNA, 25 bp, Homo sapien
tcttgcagtcaagctttagggtatt

SEQ ID NO: 659871 - DNA, 25 bp, Homo sapien
caagctttagggtattgttcaataa

SEQ ID NO: 659872 - DNA, 25 bp, Homo sapien
tcagatttcaaaatctctcctgggc

SEQ ID NO: 659873 - DNA, 25 bp, Homo sapien
cagatttcaaaatctctcctgggct

SEQ ID NO: 659874 - DNA, 25 bp, Homo sapien
agatttcaaaatctctcctgggctg

SEQ ID NO: 659875 - DNA, 25 bp, Homo sapien
gatttcaaaatctctcctgggctgg

SEQ ID NO: 659876 - DNA, 25 bp, Homo sapien
atttcaaaatctctcctgggctggg

SEQ ID NO: 659877 - DNA, 25 bp, Homo sapien
tttcaaaatctctcctgggctgggc

SEQ ID NO: 659878 - DNA, 25 bp, Homo sapien
ttcaaaatctctcctgggctgggca

SEQ ID NO: 659879 - DNA, 25 bp, Homo sapien
tcaaaatctctcctgggctgggcat

SEQ ID NO: 659880 - DNA, 25 bp, Homo sapien
aaaatctctcctgggctgggcatgg

SEQ ID NO: 659881 - DNA, 25 bp, Homo sapien
gcagtaaaccgagagatggtgccac

SEQ ID NO: 659882 - DNA, 25 bp, Homo sapien
cagtaaaccgagagatggtgccact

SEQ ID NO: 659883 - DNA, 25 bp, Homo sapien
aaagtctctaagcaggtgcgggcag

SEQ ID NO: 659884 - DNA, 25 bp, Homo sapien
gactgggctgaggtctaacactccc

SEQ ID NO: 659885 - DNA, 25 bp, Homo sapien
tgaggtctaacactcccaggtaaaa

SEQ ID NO: 659886 - DNA, 25 bp, Homo sapien
ggtaaaacagaatagcttcccctat

SEQ ID NO: 659887 - DNA, 25 bp, Homo sapien
atagcttcccctatatcacctggga

SEQ ID NO: 659888 - DNA, 25 bp, Homo sapien
cccctatatcacctgggaccagata

SEQ ID NO: 659889 - DNA, 25 bp, Homo sapien
ggaccagatagcaggcccacagata

SEQ ID NO: 659890 - DNA, 25 bp, Homo sapien
gcaggcccacagatatggcagtgag

SEQ ID NO: 659891 - DNA, 25 bp, Homo sapien
gtgagaccgtggactgtaatcccca

SEQ ID NO: 659892 - DNA, 25 bp, Homo sapien
gactgtaatccccacttgagtaatt

SEQ ID NO: 659893 - DNA, 25 bp, Homo sapien
atccccacttgagtaattaatacct

SEQ ID NO: 659894 - DNA, 25 bp, Homo sapien
gcaatgtttgacataacatcttgtc

SEQ ID NO: 659895 - DNA, 25 bp, Homo sapien
atcttgtcagacatgtggctgcttc

SEQ ID NO: 659896 - DNA, 25 bp, Homo sapien
tggctgcttctgcatttctagaaaa

SEQ ID NO: 659897 - DNA, 25 bp, Homo sapien
gcaatatgaatggaggctggccaga

SEQ ID NO: 659898 - DNA, 25 bp, Homo sapien
tggcttcagcagctcctgtaatgca

SEQ ID NO: 659899 - DNA, 25 bp, Homo sapien
tgtaatgcagcacaagtcacagtgt

SEQ ID NO: 659900 - DNA, 25 bp, Homo sapien
agacagactgccaggctaccttgat

SEQ ID NO: 659901 - DNA, 25 bp, Homo sapien
tgccaggctaccttgattgccactg

SEQ ID NO: 659902 - DNA, 25 bp, Homo sapien
ttgccactgcactgggattacatac

SEQ ID NO: 659903 - DNA, 25 bp, Homo sapien
aaactttattgcacaggtcatatcg

SEQ ID NO: 659904 - DNA, 25 bp, Homo sapien
gcacaggtcatatcgataatttact

SEQ ID NO: 659905 - DNA, 25 bp, Homo sapien
accagcttttcacctgtaatacctg

SEQ ID NO: 659906 - DNA, 25 bp, Homo sapien
tcacctgtaatacctgtgctgcctg

SEQ ID NO: 659907 - DNA, 25 bp, Homo sapien
acctgtgctgcctgtcagttaatta

SEQ ID NO: 659908 - DNA, 25 bp, Homo sapien
gctgcctgtcagttaattaatacca

SEQ ID NO: 659909 - DNA, 25 bp, Homo sapien
aggttaatgtcatggtctctacaga

SEQ ID NO: 659910 - DNA, 25 bp, Homo sapien
gtcatggtctctacagaaaatctgg

SEQ ID NO: 659911 - DNA, 25 bp, Homo sapien
gaaaatctggagctaatactggttt

SEQ ID NO: 659912 - DNA, 25 bp, Homo sapien
aatactggtttagcaacattgcagc

SEQ ID NO: 659913 - DNA, 25 bp, Homo sapien
gcaacattgcagctacaaaatctat

SEQ ID NO: 659914 - DNA, 25 bp, Homo sapien
agatatgttagacctgcacatcaaa

SEQ ID NO: 659915 - DNA, 25 bp, Homo sapien
tagacctgcacatcaaaaccgcaaa

SEQ ID NO: 659916 - DNA, 25 bp, Homo sapien
cacagaagacaagcagcacattttc

SEQ ID NO: 659917 - DNA, 25 bp, Homo sapien
gaagacaagcagcacattttctcac

SEQ ID NO: 659918 - DNA, 25 bp, Homo sapien
aagacaagcagcacattttctcact

SEQ ID NO: 659919 - DNA, 25 bp, Homo sapien
agcagcacattttctcacttacttg

SEQ ID NO: 659920 - DNA, 25 bp, Homo sapien
cacttacttgtaggacataaaagtc

SEQ ID NO: 659921 - DNA, 25 bp, Homo sapien
aaaagtcaaaatgattgggctcatg

SEQ ID NO: 659922 - DNA, 25 bp, Homo sapien
gtcaaaatgattgggctcatggata

SEQ ID NO: 659923 - DNA, 25 bp, Homo sapien
gattgggctcatggatatagaaagt

SEQ ID NO: 659924 - DNA, 25 bp, Homo sapien
tgggctcatggatatagaaagtgga

SEQ ID NO: 659925 - DNA, 25 bp, Homo sapien
tatagaaagtggaaggatggttacc

SEQ ID NO: 659926 - DNA, 25 bp, Homo sapien
taaagtgtgtaattgagttgtttgt

SEQ ID NO: 659927 - DNA, 25 bp, Homo sapien
tagaggttaggagccaaacatcagc

SEQ ID NO: 659928 - DNA, 25 bp, Homo sapien
aaacatcagctcatctattctccag

SEQ ID NO: 659929 - DNA, 25 bp, Homo sapien
tattctccagctgttgtttgtcctc

SEQ ID NO: 659930 - DNA, 25 bp, Homo sapien
gtcctccatcttcctgcaatagtca

SEQ ID NO: 659931 - DNA, 25 bp, Homo sapien
gcaatagtcaggcacagggtcttat

SEQ ID NO: 659932 - DNA, 25 bp, Homo sapien
aaaaatgggtttgtgctgctgtatg

SEQ ID NO: 659933 - DNA, 25 bp, Homo sapien
gctgctgtatgtttcgcatcaccat

SEQ ID NO: 659934 - DNA, 25 bp, Homo sapien
tgtggtcacctgatctcagcgtcta

SEQ ID NO: 659935 - DNA, 25 bp, Homo sapien
gatctcagcgtctaggtcaactttg

SEQ ID NO: 659936 - DNA, 25 bp, Homo sapien
tcttgccctgatggccggtgacata

SEQ ID NO: 659937 - DNA, 25 bp, Homo sapien
ggtgacatacacagatcccatcgac

SEQ ID NO: 659938 - DNA, 25 bp, Homo sapien
agcccagtaaaaaagcaggagtaca

SEQ ID NO: 659939 - DNA, 25 bp, Homo sapien
agagtggtatctgccttagcagggc

SEQ ID NO: 659940 - DNA, 25 bp, Homo sapien
gtatctgccttagcagggctatcac

SEQ ID NO: 659941 - DNA, 25 bp, Homo sapien
ttagcagggctatcacagatgagtg

SEQ ID NO: 659942 - DNA, 25 bp, Homo sapien
gagtgacagtaggactgaccctgca

SEQ ID NO: 659943 - DNA, 25 bp, Homo sapien
gacagtaggactgaccctgcagaat

SEQ ID NO: 659944 - DNA, 25 bp, Homo sapien
ggactgaccctgcagaattcaggca

SEQ ID NO: 659945 - DNA, 25 bp, Homo sapien
ttcaggcaggcctaggatttagagg

SEQ ID NO: 659946 - DNA, 25 bp, Homo sapien
caagagtgtggcatggagctacaca

SEQ ID NO: 659947 - DNA, 25 bp, Homo sapien
ggagctacacagaggcaagtaattt

SEQ ID NO: 659948 - DNA, 25 bp, Homo sapien
ggcaagtaatttaatgctagccaaa

SEQ ID NO: 659949 - DNA, 25 bp, Homo sapien
ctagagctcggtagattgtggataa

SEQ ID NO: 659950 - DNA, 25 bp, Homo sapien
tctgcctgatggaagttcagtagac

SEQ ID NO: 659951 - DNA, 25 bp, Homo sapien
ggaagttcagtagactccaccttac

SEQ ID NO: 659952 - DNA, 25 bp, Homo sapien
ccgcctcccatggaaaaagtcaatt

SEQ ID NO: 659953 - DNA, 25 bp, Homo sapien
gtcaattttgtgtccattggtaaat

SEQ ID NO: 659954 - DNA, 25 bp, Homo sapien
gaatttcaacgttgctttactctat

SEQ ID NO: 659955 - DNA, 25 bp, Homo sapien
tttcaacgttgctttactctatata

SEQ ID NO: 659956 - DNA, 25 bp, Homo sapien
actctatataaattggtctttgacc

SEQ ID NO: 659957 - DNA, 25 bp, Homo sapien
ttggtctttgaccttgcctttgaac

SEQ ID NO: 659958 - DNA, 25 bp, Homo sapien
gaactggtggtgacctctggctagt

SEQ ID NO: 659959 - DNA, 25 bp, Homo sapien
tgacctctggctagtttccccttta

SEQ ID NO: 659960 - DNA, 25 bp, Homo sapien
tatttacttgctttgtttccctaat

SEQ ID NO: 659961 - DNA, 25 bp, Homo sapien
acttgctttgtttccctaatcgata

SEQ ID NO: 659962 - DNA, 25 bp, Homo sapien
gctttgtttccctaatcgataatga

SEQ ID NO: 659963 - DNA, 25 bp, Homo sapien
gtttccctaatcgataatgactcca

SEQ ID NO: 659964 - DNA, 25 bp, Homo sapien
aatgactccatttccaattctggat

SEQ ID NO: 659965 - DNA, 25 bp, Homo sapien
tccaattctggatactcgcctttta

SEQ ID NO: 659966 - DNA, 25 bp, Homo sapien
attctggatactcgccttttattta

SEQ ID NO: 659967 - DNA, 25 bp, Homo sapien
tggatactcgccttttatttactat

SEQ ID NO: 659968 - DNA, 25 bp, Homo sapien
atcaatctccttatagatgactttg

SEQ ID NO: 659969 - DNA, 25 bp, Homo sapien
tgattaatttagtaggatgcctttg

SEQ ID NO: 659970 - DNA, 25 bp, Homo sapien
aggatgcctttgtgatggtggacac

SEQ ID NO: 659971 - DNA, 25 bp, Homo sapien
cactgaaaatttaaacttgttactg

SEQ ID NO: 659972 - DNA, 25 bp, Homo sapien
cccttattattgatccctgtaagca

SEQ ID NO: 659973 - DNA, 25 bp, Homo sapien
tattgatccctgtaagcaaggataa

SEQ ID NO: 659974 - DNA, 25 bp, Homo sapien
taaaaattgctgtcttcccttgcct

SEQ ID NO: 659975 - DNA, 25 bp, Homo sapien
aaattgctgtcttcccttgcctctt

SEQ ID NO: 659976 - DNA, 25 bp, Homo sapien
tgcctctttgaatgtgcccatagtt

SEQ ID NO: 659977 - DNA, 25 bp, Homo sapien
tgaatgtgcccatagtttactcggc

SEQ ID NO: 659978 - DNA, 25 bp, Homo sapien
gtgtgttccacactacaatgcttac

SEQ ID NO: 659979 - DNA, 25 bp, Homo sapien
ttccacactacaatgcttactcttg

SEQ ID NO: 659980 - DNA, 25 bp, Homo sapien
aatgcttactcttgaatacacttat

SEQ ID NO: 659981 - DNA, 25 bp, Homo sapien
gcttactcttgaatacacttattat

SEQ ID NO: 659982 - DNA, 25 bp, Homo sapien
tcctggattatccaatgggccctaa

SEQ ID NO: 659983 - DNA, 25 bp, Homo sapien
aaatccaatgacaaatgtccttggc

SEQ ID NO: 659984 - DNA, 25 bp, Homo sapien
ccaatgacaaatgtccttggcagag

SEQ ID NO: 659985 - DNA, 25 bp, Homo sapien
tgtgaccacagaggcagcgattgga

SEQ ID NO: 659986 - DNA, 25 bp, Homo sapien
gcagcgattggagtgatgtagtcac

SEQ ID NO: 659987 - DNA, 25 bp, Homo sapien
gtgatgtagtcacaagccaaggagc

SEQ ID NO: 659988 - DNA, 25 bp, Homo sapien
aaggagcaccaacagccaccaggag

SEQ ID NO: 659989 - DNA, 25 bp, Homo sapien
ggaagagcccaagagtatatactaa

SEQ ID NO: 659990 - DNA, 25 bp, Homo sapien
gtatatactaatacctggatttggg

SEQ ID NO: 659991 - DNA, 25 bp, Homo sapien
tgggacttgggacttctggtctcta

SEQ ID NO: 659992 - DNA, 25 bp, Homo sapien
ggacttctggtctctagaagtagga

SEQ ID NO: 659993 - DNA, 25 bp, Homo sapien
aggaccaaagacactgcagaccatg

SEQ ID NO: 659994 - DNA, 25 bp, Homo sapien
agcaggcacttggtgttctgtagtc

SEQ ID NO: 659995 - DNA, 25 bp, Homo sapien
gcacttggtgttctgtagtctgtga

SEQ ID NO: 659996 - DNA, 25 bp, Homo sapien
agaacctggtgtgtgggacaccctc

SEQ ID NO: 659997 - DNA, 25 bp, Homo sapien
tccttcaccggtgttcctgcaggga

SEQ ID NO: 659998 - DNA, 25 bp, Homo sapien
tgcagggaccctccgtctcctgtaa

SEQ ID NO: 659999 - DNA, 25 bp, Homo sapien
agcaagcaagtcctctctcaccttt

SEQ ID NO: 660000 - DNA, 25 bp, Homo sapien
tctcacctttcacctgaagcgatga

SEQ ID NO: 660001 - DNA, 25 bp, Homo sapien
ttcacctgaagcgatgaagcatctt

SEQ ID NO: 660002 - DNA, 25 bp, Homo sapien
gcatcttaaagtttgcctaaagcag

SEQ ID NO: 660003 - DNA, 25 bp, Homo sapien
gcagaagtctacaggagacccacag

SEQ ID NO: 660004 - DNA, 25 bp, Homo sapien
gtgaagcatggatgttttcccatta

SEQ ID NO: 660005 - DNA, 25 bp, Homo sapien
gttttcccattaaggacccatgact

SEQ ID NO: 660006 - DNA, 25 bp, Homo sapien
ggacccatgactttacacttcaata

SEQ ID NO: 660007 - DNA, 25 bp, Homo sapien
acttcaatatttctgcagggctcac

SEQ ID NO: 660008 - DNA, 25 bp, Homo sapien
agggctcacagttcactgagaggct

SEQ ID NO: 660009 - DNA, 25 bp, Homo sapien
agccatgaacccctaggctcctggg

SEQ ID NO: 660010 - DNA, 25 bp, Homo sapien
ggctcctgggctcttggacttaagc

SEQ ID NO: 660011 - DNA, 25 bp, Homo sapien
gggctcttggacttaagctgtcctc

SEQ ID NO: 660012 - DNA, 25 bp, Homo sapien
ctggaactacaatcatgaagcttta

SEQ ID NO: 660013 - DNA, 25 bp, Homo sapien
gaagctttatgttaagtttcatcta

SEQ ID NO: 660014 - DNA, 25 bp, Homo sapien
ttgtagcaactaaaacttgaggact

SEQ ID NO: 660015 - DNA, 25 bp, Homo sapien
gcataatgaccagctagtgccttgt

SEQ ID NO: 660016 - DNA, 25 bp, Homo sapien
atgaccagctagtgccttgtcttct

SEQ ID NO: 660017 - DNA, 25 bp, Homo sapien
gcctcttccatgcttttactgtgat

SEQ ID NO: 660018 - DNA, 25 bp, Homo sapien
tactgtgattctcatccacaggcac

SEQ ID NO: 660019 - DNA, 25 bp, Homo sapien
gggactttctaagcactgtttacat

SEQ ID NO: 660020 - DNA, 25 bp, Homo sapien
gcactgtttacattcttgtcatttt

SEQ ID NO: 660021 - DNA, 25 bp, Homo sapien
ttgcctgtgtttagacttacaaaaa

SEQ ID NO: 660022 - DNA, 25 bp, Homo sapien
atgcatcttaatcatttacaagcaa

SEQ ID NO: 660023 - DNA, 25 bp, Homo sapien
atttacaagcaatcataggccctca

SEQ ID NO: 660024 - DNA, 25 bp, Homo sapien
atcataggccctcatggatttcaag

SEQ ID NO: 660025 - DNA, 25 bp, Homo sapien
gccctcatggatttcaagtaaactt

SEQ ID NO: 660026 - DNA, 25 bp, Homo sapien
gtccttgagagccagtccttgtgaa

SEQ ID NO: 660027 - DNA, 25 bp, Homo sapien
tccttgagagccagtccttgtgaac

SEQ ID NO: 660028 - DNA, 25 bp, Homo sapien
ccttgagagccagtccttgtgaaca

SEQ ID NO: 660029 - DNA, 25 bp, Homo sapien
cttgagagccagtccttgtgaacag

SEQ ID NO: 660030 - DNA, 25 bp, Homo sapien
ttgagagccagtccttgtgaacagg

SEQ ID NO: 660031 - DNA, 25 bp, Homo sapien
cagtccttgtgaacaggggccaaaa

SEQ ID NO: 660032 - DNA, 25 bp, Homo sapien
caggggccaaaaatattctcttaat

SEQ ID NO: 660033 - DNA, 25 bp, Homo sapien
aatattctcttaattttgatgcctt

SEQ ID NO: 660034 - DNA, 25 bp, Homo sapien
attctcttaattttgatgccttatt

SEQ ID NO: 660035 - DNA, 25 bp, Homo sapien
tctcttaattttgatgccttattta

SEQ ID NO: 660036 - DNA, 25 bp, Homo sapien
cttaattttgatgccttatttattt

SEQ ID NO: 660037 - DNA, 25 bp, Homo sapien
atgatgacttggaccataaaagcgg

SEQ ID NO: 660038 - DNA, 25 bp, Homo sapien
gatgacttggaccataaaagcggct

SEQ ID NO: 660039 - DNA, 25 bp, Homo sapien
atgacttggaccataaaagcggctt

SEQ ID NO: 660040 - DNA, 25 bp, Homo sapien
tgacttggaccataaaagcggcttt

SEQ ID NO: 660041 - DNA, 25 bp, Homo sapien
gacttggaccataaaagcggctttg

SEQ ID NO: 660042 - DNA, 25 bp, Homo sapien
acttggaccataaaagcggctttga

SEQ ID NO: 660043 - DNA, 25 bp, Homo sapien
cttggaccataaaagcggctttgaa

SEQ ID NO: 660044 - DNA, 25 bp, Homo sapien
tggaccataaaagcggctttgaaac

SEQ ID NO: 660045 - DNA, 25 bp, Homo sapien
aatacacgggaaattaaagatgcag

SEQ ID NO: 660046 - DNA, 25 bp, Homo sapien
gatgcagtttgaaaggtgcatccac

SEQ ID NO: 660047 - DNA, 25 bp, Homo sapien
ggattcaatgactgatgggatgaga

SEQ ID NO: 660048 - DNA, 25 bp, Homo sapien
cagccgcttgctttagttttctttg

SEQ ID NO: 660049 - DNA, 25 bp, Homo sapien
gttttctttgtcacacttaacatta

SEQ ID NO: 660050 - DNA, 25 bp, Homo sapien
gtcacacttaacattacctggaatt

SEQ ID NO: 660051 - DNA, 25 bp, Homo sapien
tggaattccttctggcttacgggtt

SEQ ID NO: 660052 - DNA, 25 bp, Homo sapien
tgtttgggtgtgtctcccactagaa

SEQ ID NO: 660053 - DNA, 25 bp, Homo sapien
atgtaagggcaggactggctccagt

SEQ ID NO: 660054 - DNA, 25 bp, Homo sapien
gactggctccagtgggcctcattat

SEQ ID NO: 660055 - DNA, 25 bp, Homo sapien
gcctcattatctccagggtctggca

SEQ ID NO: 660056 - DNA, 25 bp, Homo sapien
agggtctggcataaatgggcactca

SEQ ID NO: 660057 - DNA, 25 bp, Homo sapien
taaatgggcactcagctatttgctg

SEQ ID NO: 660058 - DNA, 25 bp, Homo sapien
tgctgaatcaataaacgtgtgtgtc

SEQ ID NO: 660059 - DNA, 25 bp, Homo sapien
agttgtaaagaaatggcagctaggc

SEQ ID NO: 660060 - DNA, 25 bp, Homo sapien
gttgtaaagaaatggcagctaggcc

SEQ ID NO: 660061 - DNA, 25 bp, Homo sapien
ttgtaaagaaatggcagctaggccg

SEQ ID NO: 660062 - DNA, 25 bp, Homo sapien
tgtaaagaaatggcagctaggccgg

SEQ ID NO: 660063 - DNA, 25 bp, Homo sapien
gtaaagaaatggcagctaggccggg

SEQ ID NO: 660064 - DNA, 25 bp, Homo sapien
taaagaaatggcagctaggccggga

SEQ ID NO: 660065 - DNA, 25 bp, Homo sapien
aaagaaatggcagctaggccgggag

SEQ ID NO: 660066 - DNA, 25 bp, Homo sapien
aagaaatggcagctaggccgggagc

SEQ ID NO: 660067 - DNA, 25 bp, Homo sapien
agaaatggcagctaggccgggagca

SEQ ID NO: 660068 - DNA, 25 bp, Homo sapien
gaaatggcagctaggccgggagcag

SEQ ID NO: 660069 - DNA, 25 bp, Homo sapien
attctgagccatagcataatagcga

SEQ ID NO: 660070 - DNA, 25 bp, Homo sapien
gacaaattgtgtgtcctgtgtaatt

SEQ ID NO: 660071 - DNA, 25 bp, Homo sapien
gtgtaatttggatacctctgctcaa

SEQ ID NO: 660072 - DNA, 25 bp, Homo sapien
ggatacctctgctcaataatagctg

SEQ ID NO: 660073 - DNA, 25 bp, Homo sapien
ctgctcaataatagctgaacagatt

SEQ ID NO: 660074 - DNA, 25 bp, Homo sapien
agttaatatatacacatggcacaaa

SEQ ID NO: 660075 - DNA, 25 bp, Homo sapien
ttctgattctttgaatgcagttcga

SEQ ID NO: 660076 - DNA, 25 bp, Homo sapien
atgcagttcgatttactgatttctc

SEQ ID NO: 660077 - DNA, 25 bp, Homo sapien
tactgatttctcatgtagccttaga

SEQ ID NO: 660078 - DNA, 25 bp, Homo sapien
tctcatgtagccttagaaagtattc

SEQ ID NO: 660079 - DNA, 25 bp, Homo sapien
gaaagtattctatgtacttacaaac

SEQ ID NO: 660080 - DNA, 25 bp, Homo sapien
cttaacttctaaagtgacttgctat

SEQ ID NO: 660081 - DNA, 25 bp, Homo sapien
gacttgctatagtcacctaggtttt

SEQ ID NO: 660082 - DNA, 25 bp, Homo sapien
gtcacctaggtttttcatgaattat

SEQ ID NO: 660083 - DNA, 25 bp, Homo sapien
aagagaagaggcctaaaaactgaat

SEQ ID NO: 660084 - DNA, 25 bp, Homo sapien
actgaatttcccaatacctgggaca

SEQ ID NO: 660085 - DNA, 25 bp, Homo sapien
cccaatacctgggacaatgctgatt

SEQ ID NO: 660086 - DNA, 25 bp, Homo sapien
atacctgggacaatgctgatttagt

SEQ ID NO: 660087 - DNA, 25 bp, Homo sapien
attgacatatattaatccattgatt

SEQ ID NO: 660088 - DNA, 25 bp, Homo sapien
taattaatttatgaggcaactgcca

SEQ ID NO: 660089 - DNA, 25 bp, Homo sapien
gaggcaactgccatctacattaaag

SEQ ID NO: 660090 - DNA, 25 bp, Homo sapien
gcaactgccatctacattaaagaat

SEQ ID NO: 660091 - DNA, 25 bp, Homo sapien
actctgggcacacgtccttctcaga

SEQ ID NO: 660092 - DNA, 25 bp, Homo sapien
tcttgcttctgcctggaaggtgtta

SEQ ID NO: 660093 - DNA, 25 bp, Homo sapien
tggaaggtgttatccccagacgttt

SEQ ID NO: 660094 - DNA, 25 bp, Homo sapien
agacgtttccatgcaggcctcattc

SEQ ID NO: 660095 - DNA, 25 bp, Homo sapien
tcattcactcactggctgtcttcaa

SEQ ID NO: 660096 - DNA, 25 bp, Homo sapien
cactggctgtcttcaagtccttggt

SEQ ID NO: 660097 - DNA, 25 bp, Homo sapien
agtccttggtggaacgtcacctgcc

SEQ ID NO: 660098 - DNA, 25 bp, Homo sapien
tgccctgaccatcctatttaatatt

SEQ ID NO: 660099 - DNA, 25 bp, Homo sapien
tttaatattgcagcccatgcctcag

SEQ ID NO: 660100 - DNA, 25 bp, Homo sapien
gattttcattcatagtgtgtctcac

SEQ ID NO: 660101 - DNA, 25 bp, Homo sapien
gtgtctcaccctccaataaactata

SEQ ID NO: 660102 - DNA, 25 bp, Homo sapien
tgctttcaaactgttatcctacaac

SEQ ID NO: 660103 - DNA, 25 bp, Homo sapien
tgttatcctacaaccaaatccattt

SEQ ID NO: 660104 - DNA, 25 bp, Homo sapien
attttggagacacaaggatccacaa

SEQ ID NO: 660105 - DNA, 25 bp, Homo sapien
ggatccacaagattactcaccttca

SEQ ID NO: 660106 - DNA, 25 bp, Homo sapien
gattactcaccttcaggaaaacatg

SEQ ID NO: 660107 - DNA, 25 bp, Homo sapien
aagaattgctagtcttggtacaacc

SEQ ID NO: 660108 - DNA, 25 bp, Homo sapien
aaaagacatagctgagatttcatat

SEQ ID NO: 660109 - DNA, 25 bp, Homo sapien
gaagataacattgagattgcttaga

SEQ ID NO: 660110 - DNA, 25 bp, Homo sapien
aacaatggtatttcttgtcatccct

SEQ ID NO: 660111 - DNA, 25 bp, Homo sapien
ttgtcatccctttctaaatggcata

SEQ ID NO: 660112 - DNA, 25 bp, Homo sapien
gtaatagcttacaaagcttccaata

SEQ ID NO: 660113 - DNA, 25 bp, Homo sapien
gggcacgtgctatttctgtgactga

SEQ ID NO: 660114 - DNA, 25 bp, Homo sapien
tttctgtgactgaagccactagcta

SEQ ID NO: 660115 - DNA, 25 bp, Homo sapien
gtgactgaagccactagctacattg

SEQ ID NO: 660116 - DNA, 25 bp, Homo sapien
aagccactagctacattgatgacct

SEQ ID NO: 660117 - DNA, 25 bp, Homo sapien
gccactagctacattgatgacctct

SEQ ID NO: 660118 - DNA, 25 bp, Homo sapien
gctacattgatgacctctttttacg

SEQ ID NO: 660119 - DNA, 25 bp, Homo sapien
aacatttcagtgtgtgtctgagaga

SEQ ID NO: 660120 - DNA, 25 bp, Homo sapien
gtgtgtctgagagatcattttccca

SEQ ID NO: 660121 - DNA, 25 bp, Homo sapien
tgtgtgttctcttgctgcctcccat

SEQ ID NO: 660122 - DNA, 25 bp, Homo sapien
atccccctcgcattaaaatatcatc

SEQ ID NO: 660123 - DNA, 25 bp, Homo sapien
tatcatcacattcttttacaaacgg

SEQ ID NO: 660124 - DNA, 25 bp, Homo sapien
attttgatagaccttatttattaag

SEQ ID NO: 660125 - DNA, 25 bp, Homo sapien
aaaagattctcttctagttcaagtt

SEQ ID NO: 660126 - DNA, 25 bp, Homo sapien
gattctcttctagttcaagtttggt

SEQ ID NO: 660127 - DNA, 25 bp, Homo sapien
ttctcttctagttcaagtttggtct

SEQ ID NO: 660128 - DNA, 25 bp, Homo sapien
tcttctagttcaagtttggtctaca

SEQ ID NO: 660129 - DNA, 25 bp, Homo sapien
ctagttcaagtttggtctacaagtt

SEQ ID NO: 660130 - DNA, 25 bp, Homo sapien
tcaagtttggtctacaagtttttat

SEQ ID NO: 660131 - DNA, 25 bp, Homo sapien
tggtctacaagtttttattgtgaaa

SEQ ID NO: 660132 - DNA, 25 bp, Homo sapien
tagaaataccttttaatgtgtataa

SEQ ID NO: 660133 - DNA, 25 bp, Homo sapien
atatttggttatctttgtatttcaa

SEQ ID NO: 660134 - DNA, 25 bp, Homo sapien
attatttggttatctttgtatttca

SEQ ID NO: 660135 - DNA, 25 bp, Homo sapien
tggaagcttgtctgtatgtatttct

SEQ ID NO: 660136 - DNA, 25 bp, Homo sapien
gtatttcttaacacagtacagtagt

SEQ ID NO: 660137 - DNA, 25 bp, Homo sapien
cagtacagtagttatttgttttggt

SEQ ID NO: 660138 - DNA, 25 bp, Homo sapien
aaacttctgggacactagatgaact

SEQ ID NO: 660139 - DNA, 25 bp, Homo sapien
gacaatagatggtatttttgctgaa

SEQ ID NO: 660140 - DNA, 25 bp, Homo sapien
tacttgttagatactgttctatcag

SEQ ID NO: 660141 - DNA, 25 bp, Homo sapien
gttctatcagatactgtgctctcat

SEQ ID NO: 660142 - DNA, 25 bp, Homo sapien
gatactgtgctctcataactaagaa

SEQ ID NO: 660143 - DNA, 25 bp, Homo sapien
gtgctctcataactaagaattctaa

SEQ ID NO: 660144 - DNA, 25 bp, Homo sapien
cacttctccattaaaccctacagag

SEQ ID NO: 660145 - DNA, 25 bp, Homo sapien
aaaccctacagagtaattgttgaat

SEQ ID NO: 660146 - DNA, 25 bp, Homo sapien
agggacatttcccttcatttctctg

SEQ ID NO: 660147 - DNA, 25 bp, Homo sapien
tttcccttcatttctctgcttgcca

SEQ ID NO: 660148 - DNA, 25 bp, Homo sapien
ttcagttcacattttactcagtctc

SEQ ID NO: 660149 - DNA, 25 bp, Homo sapien
tcacattttactcagtctcccggtg

SEQ ID NO: 660150 - DNA, 25 bp, Homo sapien
acatccacacacagcgctggttgta

SEQ ID NO: 660151 - DNA, 25 bp, Homo sapien
acacacagcgctggttgtatcctaa

SEQ ID NO: 660152 - DNA, 25 bp, Homo sapien
ggttgtatcctaaccaggaaactca

SEQ ID NO: 660153 - DNA, 25 bp, Homo sapien
aggaaactcaaagcagccttgccca

SEQ ID NO: 660154 - DNA, 25 bp, Homo sapien
ttgcccaccacagtgcgttgaatgg

SEQ ID NO: 660155 - DNA, 25 bp, Homo sapien
acagtgcgttgaatggtgaccctct

SEQ ID NO: 660156 - DNA, 25 bp, Homo sapien
tggtgaccctctaaagatgtgtcct

SEQ ID NO: 660157 - DNA, 25 bp, Homo sapien
aaagggactaccaactctctggagt

SEQ ID NO: 660158 - DNA, 25 bp, Homo sapien
agggactaccaactctctggagtct

SEQ ID NO: 660159 - DNA, 25 bp, Homo sapien
actaccaactctctggagtctcttt

SEQ ID NO: 660160 - DNA, 25 bp, Homo sapien
atgagggcactaattccaattatga

SEQ ID NO: 660161 - DNA, 25 bp, Homo sapien
aatcactgcccaaaggccccatgtt

SEQ ID NO: 660162 - DNA, 25 bp, Homo sapien
aaaggccccatgttctaatgccatc

SEQ ID NO: 660163 - DNA, 25 bp, Homo sapien
tttggaaggacataagcattcaacc

SEQ ID NO: 660164 - DNA, 25 bp, Homo sapien
ataagcattcaaccccctgcacatg

SEQ ID NO: 660165 - DNA, 25 bp, Homo sapien
ctgcacatgtcttctttcctacttc

SEQ ID NO: 660166 - DNA, 25 bp, Homo sapien
ttcctacttcctcaaggttctttct

SEQ ID NO: 660167 - DNA, 25 bp, Homo sapien
tacttcctcaaggttctttctgtcc

SEQ ID NO: 660168 - DNA, 25 bp, Homo sapien
agcctacttttctgtcacaagagcc

SEQ ID NO: 660169 - DNA, 25 bp, Homo sapien
ctacttttctgtcacaagagcccat

SEQ ID NO: 660170 - DNA, 25 bp, Homo sapien
ttctttttatctacttttctccatg

SEQ ID NO: 660171 - DNA, 25 bp, Homo sapien
ttttctccatgaagtttgtcaccat

SEQ ID NO: 660172 - DNA, 25 bp, Homo sapien
gaagtttgtcaccatcaactgttaa

SEQ ID NO: 660173 - DNA, 25 bp, Homo sapien
tgatcagctaaataagtggtctttg

SEQ ID NO: 660174 - DNA, 25 bp, Homo sapien
gtggtctttgaactaattcctctcg

SEQ ID NO: 660175 - DNA, 25 bp, Homo sapien
taattcctctcgtacttcctaaagg

SEQ ID NO: 660176 - DNA, 25 bp, Homo sapien
tatgtatccccttgcacattttcaa

SEQ ID NO: 660177 - DNA, 25 bp, Homo sapien
ttgcacattttcaagcagacaccta

SEQ ID NO: 660178 - DNA, 25 bp, Homo sapien
aagcagacacctaagatttttcatc

SEQ ID NO: 660179 - DNA, 25 bp, Homo sapien
agtcacgttccccatgcttgttcga

SEQ ID NO: 660180 - DNA, 25 bp, Homo sapien
tcacgttccccatgcttgttcgatt

SEQ ID NO: 660181 - DNA, 25 bp, Homo sapien
acgttccccatgcttgttcgattta

SEQ ID NO: 660182 - DNA, 25 bp, Homo sapien
cgttccccatgcttgttcgatttat

SEQ ID NO: 660183 - DNA, 25 bp, Homo sapien
gttccccatgcttgttcgatttatc

SEQ ID NO: 660184 - DNA, 25 bp, Homo sapien
ttccccatgcttgttcgatttatca

SEQ ID NO: 660185 - DNA, 25 bp, Homo sapien
tccccatgcttgttcgatttatcat

SEQ ID NO: 660186 - DNA, 25 bp, Homo sapien
ccccatgcttgttcgatttatcatg

SEQ ID NO: 660187 - DNA, 25 bp, Homo sapien
atgcttgttcgatttatcatgaccc

SEQ ID NO: 660188 - DNA, 25 bp, Homo sapien
tgcttgttcgatttatcatgaccct

SEQ ID NO: 660189 - DNA, 25 bp, Homo sapien
tgatgctcccggctgaataaacctc

SEQ ID NO: 660190 - DNA, 25 bp, Homo sapien
tattcctttgactctgaagaaccgc

SEQ ID NO: 660191 - DNA, 25 bp, Homo sapien
gactctgaagaaccgcccaaaagaa

SEQ ID NO: 660192 - DNA, 25 bp, Homo sapien
gaaccctctaataagtatgcatcta

SEQ ID NO: 660193 - DNA, 25 bp, Homo sapien
gtatgcatctaatattttctataag

SEQ ID NO: 660194 - DNA, 25 bp, Homo sapien
gaacctttgttcctgatatgttatt

SEQ ID NO: 660195 - DNA, 25 bp, Homo sapien
aattcctcagatacaagcaatagtg

SEQ ID NO: 660196 - DNA, 25 bp, Homo sapien
gcaatagtgaaaccactttactctt

SEQ ID NO: 660197 - DNA, 25 bp, Homo sapien
cactttactctttaatcatcatatg

SEQ ID NO: 660198 - DNA, 25 bp, Homo sapien
gatatctaagcaatgatggttcatg

SEQ ID NO: 660199 - DNA, 25 bp, Homo sapien
catgttttgattttccaccattcca

SEQ ID NO: 660200 - DNA, 25 bp, Homo sapien
accattccatcacattctcaaattc

SEQ ID NO: 660201 - DNA, 25 bp, Homo sapien
tctgaggaacacaccgcctgggcaa

SEQ ID NO: 660202 - DNA, 25 bp, Homo sapien
aacacaccgcctgggcaaggatgga

SEQ ID NO: 660203 - DNA, 25 bp, Homo sapien
ggattggccagaaaatcactcagtc

SEQ ID NO: 660204 - DNA, 25 bp, Homo sapien
agtccaaggtagttcttacagccag

SEQ ID NO: 660205 - DNA, 25 bp, Homo sapien
agccagaagaattcacgggtgctct

SEQ ID NO: 660206 - DNA, 25 bp, Homo sapien
acgggtgctcttagtggttctcaga

SEQ ID NO: 660207 - DNA, 25 bp, Homo sapien
tggttctcagacctgcttgtctcat

SEQ ID NO: 660208 - DNA, 25 bp, Homo sapien
ctgcttgtctcatttattgaagctc

SEQ ID NO: 660209 - DNA, 25 bp, Homo sapien
gaagctcaactaatgccttgaaggg

SEQ ID NO: 660210 - DNA, 25 bp, Homo sapien
gaagaaattagctttccatccagtt

SEQ ID NO: 660211 - DNA, 25 bp, Homo sapien
ttaggaatgactgttgtggcctggc

SEQ ID NO: 660212 - DNA, 25 bp, Homo sapien
ttaacctctttcaagagtttcaggc

SEQ ID NO: 660213 - DNA, 25 bp, Homo sapien
taacctctttcaagagtttcaggcc

SEQ ID NO: 660214 - DNA, 25 bp, Homo sapien
aacctctttcaagagtttcaggccg

SEQ ID NO: 660215 - DNA, 25 bp, Homo sapien
acctctttcaagagtttcaggccgg

SEQ ID NO: 660216 - DNA, 25 bp, Homo sapien
cctctttcaagagtttcaggccggg

SEQ ID NO: 660217 - DNA, 25 bp, Homo sapien
ctctttcaagagtttcaggccgggt

SEQ ID NO: 660218 - DNA, 25 bp, Homo sapien
tctttcaagagtttcaggccgggtg

SEQ ID NO: 660219 - DNA, 25 bp, Homo sapien
ctttcaagagtttcaggccgggtgc

SEQ ID NO: 660220 - DNA, 25 bp, Homo sapien
acccctgccggcaaaacgttgctct

SEQ ID NO: 660221 - DNA, 25 bp, Homo sapien
cccctgccggcaaaacgttgctctt

SEQ ID NO: 660222 - DNA, 25 bp, Homo sapien
ccctgccggcaaaacgttgctctta

SEQ ID NO: 660223 - DNA, 25 bp, Homo sapien
cctgccggcaaaacgttgctcttaa

SEQ ID NO: 660224 - DNA, 25 bp, Homo sapien
ctgccggcaaaacgttgctcttaac

SEQ ID NO: 660225 - DNA, 25 bp, Homo sapien
tgccggcaaaacgttgctcttaact

SEQ ID NO: 660226 - DNA, 25 bp, Homo sapien
gccggcaaaacgttgctcttaactt

SEQ ID NO: 660227 - DNA, 25 bp, Homo sapien
cggcaaaacgttgctcttaacttca

SEQ ID NO: 660228 - DNA, 25 bp, Homo sapien
gggcatttaatttccacatttaaca

SEQ ID NO: 660229 - DNA, 25 bp, Homo sapien
ttccacatttaacatttggtactgt

SEQ ID NO: 660230 - DNA, 25 bp, Homo sapien
ggtactgttatgtaagcaactgact

SEQ ID NO: 660231 - DNA, 25 bp, Homo sapien
aatccaaactgtcaacatttttgca

SEQ ID NO: 660232 - DNA, 25 bp, Homo sapien
caatcatagggaggacaagtaagca

SEQ ID NO: 660233 - DNA, 25 bp, Homo sapien
caagacctaaattaatgggcatgtg

SEQ ID NO: 660234 - DNA, 25 bp, Homo sapien
tgggcatgtgaatcatacagaattt

SEQ ID NO: 660235 - DNA, 25 bp, Homo sapien
gtggatgaactatagcacttcattc

SEQ ID NO: 660236 - DNA, 25 bp, Homo sapien
gcacttcattctatattgatgctga

SEQ ID NO: 660237 - DNA, 25 bp, Homo sapien
gatgctgaattagagttcatttgac

SEQ ID NO: 660238 - DNA, 25 bp, Homo sapien
ttcatttgacttatggtagttacta

SEQ ID NO: 660239 - DNA, 25 bp, Homo sapien
gaacagaagtggctgtatgagcttc

SEQ ID NO: 660240 - DNA, 25 bp, Homo sapien
tgagcttctaaaaagccccatctgg

SEQ ID NO: 660241 - DNA, 25 bp, Homo sapien
ctaaaaagccccatctggaagctgg

SEQ ID NO: 660242 - DNA, 25 bp, Homo sapien
catttcctaactcagaggaggccac

SEQ ID NO: 660243 - DNA, 25 bp, Homo sapien
ttgcctgggaccaggtcctcagaaa

SEQ ID NO: 660244 - DNA, 25 bp, Homo sapien
ctgggaccaggtcctcagaaactgt

SEQ ID NO: 660245 - DNA, 25 bp, Homo sapien
tgggaggagggcacctttacaacag

SEQ ID NO: 660246 - DNA, 25 bp, Homo sapien
ggagggcacctttacaacagcaggt

SEQ ID NO: 660247 - DNA, 25 bp, Homo sapien
aggtggagcacctgtaagtcctaag

SEQ ID NO: 660248 - DNA, 25 bp, Homo sapien
gcacctgtaagtcctaagttccctt

SEQ ID NO: 660249 - DNA, 25 bp, Homo sapien
tttggagaagactggagccagcctt

SEQ ID NO: 660250 - DNA, 25 bp, Homo sapien
accagttctctgctttcgaaccctg

SEQ ID NO: 660251 - DNA, 25 bp, Homo sapien
acaatgcatgcacagtgggacatag

SEQ ID NO: 660252 - DNA, 25 bp, Homo sapien
tgcacagtgggacatagacctccat

SEQ ID NO: 660253 - DNA, 25 bp, Homo sapien
cagtgggacatagacctccatcagt

SEQ ID NO: 660254 - DNA, 25 bp, Homo sapien
ggacatagacctccatcagtatttc

SEQ ID NO: 660255 - DNA, 25 bp, Homo sapien
catagacctccatcagtatttctaa

SEQ ID NO: 660256 - DNA, 25 bp, Homo sapien
ctttattgcccgttgaagcatgtaa

SEQ ID NO: 660257 - DNA, 25 bp, Homo sapien
aacttgctgattttgcggctcggcg

SEQ ID NO: 660258 - DNA, 25 bp, Homo sapien
cttgctgattttgcggctcggcgtc

SEQ ID NO: 660259 - DNA, 25 bp, Homo sapien
tgattttgcggctcggcgtcaccat

SEQ ID NO: 660260 - DNA, 25 bp, Homo sapien
tgcggctcggcgtcaccatcacggt

SEQ ID NO: 660261 - DNA, 25 bp, Homo sapien
ggaaaatcgggacactcccatcctg

SEQ ID NO: 660262 - DNA, 25 bp, Homo sapien
gaaaatcgggacactcccatcctga

SEQ ID NO: 660263 - DNA, 25 bp, Homo sapien
aaatcgggacactcccatcctgata

SEQ ID NO: 660264 - DNA, 25 bp, Homo sapien
ttttccaaaggtcttagcaaatggc

SEQ ID NO: 660265 - DNA, 25 bp, Homo sapien
agactgaactgcaaggtggcaatga

SEQ ID NO: 660266 - DNA, 25 bp, Homo sapien
tgaactgcaaggtggcaatgaggct

SEQ ID NO: 660267 - DNA, 25 bp, Homo sapien
gggtccaccattgctgacgtttgag

SEQ ID NO: 660268 - DNA, 25 bp, Homo sapien
ggtccaccattgctgacgtttgagt

SEQ ID NO: 660269 - DNA, 25 bp, Homo sapien
gtccaccattgctgacgtttgagta

SEQ ID NO: 660270 - DNA, 25 bp, Homo sapien
gtaggtaaacaaaacactccagcct

SEQ ID NO: 660271 - DNA, 25 bp, Homo sapien
aggtaaacaaaacactccagcctgg

SEQ ID NO: 660272 - DNA, 25 bp, Homo sapien
ttatttctattatctccctcctttc

SEQ ID NO: 660273 - DNA, 25 bp, Homo sapien
atttctattatctccctcctttcaa

SEQ ID NO: 660274 - DNA, 25 bp, Homo sapien
ctattatctccctcctttcaataaa

SEQ ID NO: 660275 - DNA, 25 bp, Homo sapien
atctccctcctttcaataaaattgt

SEQ ID NO: 660276 - DNA, 25 bp, Homo sapien
taaattacagttcagtgtcccctct

SEQ ID NO: 660277 - DNA, 25 bp, Homo sapien
aaattacagttcagtgtcccctctc

SEQ ID NO: 660278 - DNA, 25 bp, Homo sapien
acacatattagtttttgagattttt

SEQ ID NO: 660279 - DNA, 25 bp, Homo sapien
ttttcttgttgttcttgggttattg

SEQ ID NO: 660280 - DNA, 25 bp, Homo sapien
ttcttgttgttcttgggttattgac

SEQ ID NO: 660281 - DNA, 25 bp, Homo sapien
gttgttcttgggttattgacagcaa

SEQ ID NO: 660282 - DNA, 25 bp, Homo sapien
gttcttgggttattgacagcaaagg

SEQ ID NO: 660283 - DNA, 25 bp, Homo sapien
acctgaggctaggagttggaggcca

SEQ ID NO: 660284 - DNA, 25 bp, Homo sapien
cctgaggctaggagttggaggccag

SEQ ID NO: 660285 - DNA, 25 bp, Homo sapien
ctgaggctaggagttggaggccagc

SEQ ID NO: 660286 - DNA, 25 bp, Homo sapien
tgaggctaggagttggaggccagcc

SEQ ID NO: 660287 - DNA, 25 bp, Homo sapien
aaaattagccaggtcctgtctctac

SEQ ID NO: 660288 - DNA, 25 bp, Homo sapien
aaattagccaggtcctgtctctact

SEQ ID NO: 660289 - DNA, 25 bp, Homo sapien
aattagccaggtcctgtctctacta

SEQ ID NO: 660290 - DNA, 25 bp, Homo sapien
attagccaggtcctgtctctactaa

SEQ ID NO: 660291 - DNA, 25 bp, Homo sapien
aacccagggaggcagaggttacagt

SEQ ID NO: 660292 - DNA, 25 bp, Homo sapien
acccagggaggcagaggttacagtg

SEQ ID NO: 660293 - DNA, 25 bp, Homo sapien
cccagggaggcagaggttacagtga

SEQ ID NO: 660294 - DNA, 25 bp, Homo sapien
gaagcaatgtacttcttaacatata

SEQ ID NO: 660295 - DNA, 25 bp, Homo sapien
cttaacatatattgactgatgtctc

SEQ ID NO: 660296 - DNA, 25 bp, Homo sapien
attgactgatgtctcatgatgtctc

SEQ ID NO: 660297 - DNA, 25 bp, Homo sapien
tgtctcatgatgtctccctaaatgt

SEQ ID NO: 660298 - DNA, 25 bp, Homo sapien
tgtgcctgacaaccttggacatatt

SEQ ID NO: 660299 - DNA, 25 bp, Homo sapien
gtgcctgacaaccttggacatattt

SEQ ID NO: 660300 - DNA, 25 bp, Homo sapien
gcctgacaaccttggacatattttg

SEQ ID NO: 660301 - DNA, 25 bp, Homo sapien
gacatattttgtcaagacttccctg

SEQ ID NO: 660302 - DNA, 25 bp, Homo sapien
ttccctgaggctgtcattggtgcat

SEQ ID NO: 660303 - DNA, 25 bp, Homo sapien
tccctgaggctgtcattggtgcatc

SEQ ID NO: 660304 - DNA, 25 bp, Homo sapien
ccctgaggctgtcattggtgcatcc

SEQ ID NO: 660305 - DNA, 25 bp, Homo sapien
aaaaggcagtaatgaagtgctcctt

SEQ ID NO: 660306 - DNA, 25 bp, Homo sapien
tttcattcctgctcagtggtatcag

SEQ ID NO: 660307 - DNA, 25 bp, Homo sapien
tgctcagtggtatcagagtaggact

SEQ ID NO: 660308 - DNA, 25 bp, Homo sapien
taggactagcggagagtctagactt

SEQ ID NO: 660309 - DNA, 25 bp, Homo sapien
gagtctagacttttaccatcatcca

SEQ ID NO: 660310 - DNA, 25 bp, Homo sapien
aacatctgcccagccataatgagaa

SEQ ID NO: 660311 - DNA, 25 bp, Homo sapien
gagaagtgtaactaagatgccaaca

SEQ ID NO: 660312 - DNA, 25 bp, Homo sapien
agatgccaacagaggctgagtgaac

SEQ ID NO: 660313 - DNA, 25 bp, Homo sapien
tgagtgaacctagtcttctacctgc

SEQ ID NO: 660314 - DNA, 25 bp, Homo sapien
ttctacctgcacctgtcagtaatgg

SEQ ID NO: 660315 - DNA, 25 bp, Homo sapien
cagtaatgggttggtgtctttcctc

SEQ ID NO: 660316 - DNA, 25 bp, Homo sapien
taggctgagtgagccgctaatccaa

SEQ ID NO: 660317 - DNA, 25 bp, Homo sapien
ctgagtgagccgctaatccaacatg

SEQ ID NO: 660318 - DNA, 25 bp, Homo sapien
gagtgagccgctaatccaacatgac

SEQ ID NO: 660319 - DNA, 25 bp, Homo sapien
gggagaataccatgtgaagactgga

SEQ ID NO: 660320 - DNA, 25 bp, Homo sapien
gagttattcagccacaactaaggca

SEQ ID NO: 660321 - DNA, 25 bp, Homo sapien
gttattcagccacaactaaggcatt

SEQ ID NO: 660322 - DNA, 25 bp, Homo sapien
tcagccacaactaaggcatttccag

SEQ ID NO: 660323 - DNA, 25 bp, Homo sapien
caactaaggcatttccagaagccag

SEQ ID NO: 660324 - DNA, 25 bp, Homo sapien
tgtgtggccccgctgacactgacct

SEQ ID NO: 660325 - DNA, 25 bp, Homo sapien
gctgacactgacctcagacttccag

SEQ ID NO: 660326 - DNA, 25 bp, Homo sapien
ttccagcctccagaggtgtgagatg

SEQ ID NO: 660327 - DNA, 25 bp, Homo sapien
tcatatgctgaagtctcctagttct

SEQ ID NO: 660328 - DNA, 25 bp, Homo sapien
agtctcctagttcttcagaatgtga

SEQ ID NO: 660329 - DNA, 25 bp, Homo sapien
tgtgaccatatttgaagataggacc

SEQ ID NO: 660330 - DNA, 25 bp, Homo sapien
attaggccgtatgtttgggctctaa

SEQ ID NO: 660331 - DNA, 25 bp, Homo sapien
ggccgtatgtttgggctctaatcca

SEQ ID NO: 660332 - DNA, 25 bp, Homo sapien
gacagagacatagagggaagaccat

SEQ ID NO: 660333 - DNA, 25 bp, Homo sapien
agaccattggaagacacagggataa

SEQ ID NO: 660334 - DNA, 25 bp, Homo sapien
agaggctcctgaagaaaccggccct

SEQ ID NO: 660335 - DNA, 25 bp, Homo sapien
aagaaaccggccctgccaataccat

SEQ ID NO: 660336 - DNA, 25 bp, Homo sapien
cctgccaataccatcttgtcagata

SEQ ID NO: 660337 - DNA, 25 bp, Homo sapien
cttgtcagatatatggcctccagaa

SEQ ID NO: 660338 - DNA, 25 bp, Homo sapien
gtataatgcaagttttcaagatcca

SEQ ID NO: 660339 - DNA, 25 bp, Homo sapien
gttcaaaattcgaaacacttctgac

SEQ ID NO: 660340 - DNA, 25 bp, Homo sapien
aacacttctgactccaggcattttg

SEQ ID NO: 660341 - DNA, 25 bp, Homo sapien
acttctgactccaggcattttggat

SEQ ID NO: 660342 - DNA, 25 bp, Homo sapien
ctgactccaggcattttggataagg

SEQ ID NO: 660343 - DNA, 25 bp, Homo sapien
agggatacccaacctatattatgaa

SEQ ID NO: 660344 - DNA, 25 bp, Homo sapien
gatacccaacctatattatgaagtg

SEQ ID NO: 660345 - DNA, 25 bp, Homo sapien
ttcagtttatgtatccttttgcgag

SEQ ID NO: 660346 - DNA, 25 bp, Homo sapien
gtttatgtatccttttgcgaggttt

SEQ ID NO: 660347 - DNA, 25 bp, Homo sapien
aatatacgtgggtgtttcagtttat

SEQ ID NO: 660348 - DNA, 25 bp, Homo sapien
atacgtgggtgtttcagtttatgaa

SEQ ID NO: 660349 - DNA, 25 bp, Homo sapien
aaatccaatgacaaatgtccttggc

SEQ ID NO: 660350 - DNA, 25 bp, Homo sapien
ccaatgacaaatgtccttggcagag

SEQ ID NO: 660351 - DNA, 25 bp, Homo sapien
gagggaaggaagtgatgtgaccaca

SEQ ID NO: 660352 - DNA, 25 bp, Homo sapien
tgtgaccacagaggcagcgattgga

SEQ ID NO: 660353 - DNA, 25 bp, Homo sapien
gcagcgattggagtgatgtagtcac

SEQ ID NO: 660354 - DNA, 25 bp, Homo sapien
gtgatgtagtcacaagccaaggagc

SEQ ID NO: 660355 - DNA, 25 bp, Homo sapien
aaggagcaccaacagccaccaggag

SEQ ID NO: 660356 - DNA, 25 bp, Homo sapien
ggaagagcccaagagtatatactaa

SEQ ID NO: 660357 - DNA, 25 bp, Homo sapien
gtatatactaatacctggatttggg

SEQ ID NO: 660358 - DNA, 25 bp, Homo sapien
ggacttctggtctctagaagtagga

SEQ ID NO: 660359 - DNA, 25 bp, Homo sapien
ttctggtctctagaagtaggaaaga

SEQ ID NO: 660360 - DNA, 25 bp, Homo sapien
caggtcaatgttgccttgcctggga

SEQ ID NO: 660361 - DNA, 25 bp, Homo sapien
ttgcctgggaaggaccacccgggca

SEQ ID NO: 660362 - DNA, 25 bp, Homo sapien
tgggaaggaccacccgggcaatctt

SEQ ID NO: 660363 - DNA, 25 bp, Homo sapien
ccacccgggcaatcttatatatcta

SEQ ID NO: 660364 - DNA, 25 bp, Homo sapien
gggcaatcttatatatctactgttc

SEQ ID NO: 660365 - DNA, 25 bp, Homo sapien
aatcttatatatctactgttctcta

SEQ ID NO: 660366 - DNA, 25 bp, Homo sapien
actgttctctaaaaatgccacttag

SEQ ID NO: 660367 - DNA, 25 bp, Homo sapien
gagaattgaaacttccaaacacatg

SEQ ID NO: 660368 - DNA, 25 bp, Homo sapien
ttgaaacttccaaacacatgaaagg

SEQ ID NO: 660369 - DNA, 25 bp, Homo sapien
aggatccaaggaaagtgtcttcaaa

SEQ ID NO: 660370 - DNA, 25 bp, Homo sapien
ggaaagtgtcttcaaacaattacat

SEQ ID NO: 660371 - DNA, 25 bp, Homo sapien
caggttggatggcataaacacttga

SEQ ID NO: 660372 - DNA, 25 bp, Homo sapien
ggttggatggcataaacacttgata

SEQ ID NO: 660373 - DNA, 25 bp, Homo sapien
tggatggcataaacacttgataaat

SEQ ID NO: 660374 - DNA, 25 bp, Homo sapien
acacttgataaatgctggtagaaaa

SEQ ID NO: 660375 - DNA, 25 bp, Homo sapien
aattcttatgagaggtttacattca

SEQ ID NO: 660376 - DNA, 25 bp, Homo sapien
gtttacattcatttactgaagccaa

SEQ ID NO: 660377 - DNA, 25 bp, Homo sapien
agccaaatctggtttaatgtacttt

SEQ ID NO: 660378 - DNA, 25 bp, Homo sapien
taatgtacttttttgcatcaatcaa

SEQ ID NO: 660379 - DNA, 25 bp, Homo sapien
atgtacttttttgcatcaatcaatt

SEQ ID NO: 660380 - DNA, 25 bp, Homo sapien
ttttgacagttgattgtattccatt

SEQ ID NO: 660381 - DNA, 25 bp, Homo sapien
tgacagttgattgtattccattttc

SEQ ID NO: 660382 - DNA, 25 bp, Homo sapien
gggaaagcctccaggccatggctac

SEQ ID NO: 660383 - DNA, 25 bp, Homo sapien
aggccatggctactggtgttaattt

SEQ ID NO: 660384 - DNA, 25 bp, Homo sapien
tgcaaaaagcagtgactgctgctgt

SEQ ID NO: 660385 - DNA, 25 bp, Homo sapien
caggtgtgggccagggtctctccca

SEQ ID NO: 660386 - DNA, 25 bp, Homo sapien
cagggtctctcccagtgccgtcagg

SEQ ID NO: 660387 - DNA, 25 bp, Homo sapien
gtgccgtcaggcttagggccatgat

SEQ ID NO: 660388 - DNA, 25 bp, Homo sapien
aggcttagggccatgattccaggag

SEQ ID NO: 660389 - DNA, 25 bp, Homo sapien
cttagggccatgattccaggaggga

SEQ ID NO: 660390 - DNA, 25 bp, Homo sapien
ggcattggttgaattcagtagcatc

SEQ ID NO: 660391 - DNA, 25 bp, Homo sapien
gtagcatcaatggtcaacattcaat

SEQ ID NO: 660392 - DNA, 25 bp, Homo sapien
gttcatacaccacatatatgcttca

SEQ ID NO: 660393 - DNA, 25 bp, Homo sapien
gcacaaggcattgcagactgtaaca

SEQ ID NO: 660394 - DNA, 25 bp, Homo sapien
gtaacattacatagacagcaaggca

SEQ ID NO: 660395 - DNA, 25 bp, Homo sapien
agacagcaaggcaacccaagaagga

SEQ ID NO: 660396 - DNA, 25 bp, Homo sapien
actattggaaaagtatatggcgaac

SEQ ID NO: 660397 - DNA, 25 bp, Homo sapien
tatggcgaacaaacagggtcctatc

SEQ ID NO: 660398 - DNA, 25 bp, Homo sapien
aacagggtcctatcagtacaaccac

SEQ ID NO: 660399 - DNA, 25 bp, Homo sapien
atcagtacaaccactccaggatgag

SEQ ID NO: 660400 - DNA, 25 bp, Homo sapien
tcaaagcactgggtagagcgttcat

SEQ ID NO: 660401 - DNA, 25 bp, Homo sapien
ctgggtagagcgttcatgcatctga

SEQ ID NO: 660402 - DNA, 25 bp, Homo sapien
atgcatctgaaagctagatctcgga

SEQ ID NO: 660403 - DNA, 25 bp, Homo sapien
agatctcggagaaaatgtgacatga

SEQ ID NO: 660404 - DNA, 25 bp, Homo sapien
tactgtgtaccaagcaggaactgct

SEQ ID NO: 660405 - DNA, 25 bp, Homo sapien
agcaggaactgctgttggtcttcgt

SEQ ID NO: 660406 - DNA, 25 bp, Homo sapien
actgctgttggtcttcgttgaaatc

SEQ ID NO: 660407 - DNA, 25 bp, Homo sapien
gtcttcgttgaaatcctgtctgcaa

SEQ ID NO: 660408 - DNA, 25 bp, Homo sapien
gaaatcctgtctgcaaatctttttg

SEQ ID NO: 660409 - DNA, 25 bp, Homo sapien
gttaaaattaagatgaggctccagt

SEQ ID NO: 660410 - DNA, 25 bp, Homo sapien
gaggctccagtgtgtttagatacaa

SEQ ID NO: 660411 - DNA, 25 bp, Homo sapien
aacaatttctatgagaggacacttc

SEQ ID NO: 660412 - DNA, 25 bp, Homo sapien
atgagaggacacttcattaaaacat

SEQ ID NO: 660413 - DNA, 25 bp, Homo sapien
tttaataacacagcaaactctcagt

SEQ ID NO: 660414 - DNA, 25 bp, Homo sapien
cacagcaaactctcagttatcaaag

SEQ ID NO: 660415 - DNA, 25 bp, Homo sapien
tgagagatctggtcgtttaagtgtg

SEQ ID NO: 660416 - DNA, 25 bp, Homo sapien
cgtttaagtgtgtagcaccagccgg

SEQ ID NO: 660417 - DNA, 25 bp, Homo sapien
gtttaagtgtgtagcaccagccggg

SEQ ID NO: 660418 - DNA, 25 bp, Homo sapien
tttaagtgtgtagcaccagccgggc

SEQ ID NO: 660419 - DNA, 25 bp, Homo sapien
ttaagtgtgtagcaccagccgggcg

SEQ ID NO: 660420 - DNA, 25 bp, Homo sapien
taagtgtgtagcaccagccgggcgc

SEQ ID NO: 660421 - DNA, 25 bp, Homo sapien
aagtgtgtagcaccagccgggcgca

SEQ ID NO: 660422 - DNA, 25 bp, Homo sapien
agtgtgtagcaccagccgggcgcag

SEQ ID NO: 660423 - DNA, 25 bp, Homo sapien
gtgtgtagcaccagccgggcgcagt

SEQ ID NO: 660424 - DNA, 25 bp, Homo sapien
tgtgtagcaccagccgggcgcagtg

SEQ ID NO: 660425 - DNA, 25 bp, Homo sapien
gtgtagcaccagccgggcgcagtgg

SEQ ID NO: 660426 - DNA, 25 bp, Homo sapien
ttctctacacagaaaattatatttt

SEQ ID NO: 660427 - DNA, 25 bp, Homo sapien
ttttaaaaataggcagggcatgatg

SEQ ID NO: 660428 - DNA, 25 bp, Homo sapien
gacagggagtatgtgagaaatttct

SEQ ID NO: 660429 - DNA, 25 bp, Homo sapien
acagggagtatgtgagaaatttctg

SEQ ID NO: 660430 - DNA, 25 bp, Homo sapien
tttgctatgaatccaaaactgcttc

SEQ ID NO: 660431 - DNA, 25 bp, Homo sapien
ttgctatgaatccaaaactgcttca

SEQ ID NO: 660432 - DNA, 25 bp, Homo sapien
tgctatgaatccaaaactgcttcaa

SEQ ID NO: 660433 - DNA, 25 bp, Homo sapien
gctatgaatccaaaactgcttcaaa

SEQ ID NO: 660434 - DNA, 25 bp, Homo sapien
ctatgaatccaaaactgcttcaaaa

SEQ ID NO: 660435 - DNA, 25 bp, Homo sapien
tatgaatccaaaactgcttcaaaaa

SEQ ID NO: 660436 - DNA, 25 bp, Homo sapien
atgaatccaaaactgcttcaaaaaa

SEQ ID NO: 660437 - DNA, 25 bp, Homo sapien
atgggatctggcctgttttttcaaa

SEQ ID NO: 660438 - DNA, 25 bp, Homo sapien
atctggcctgttttttcaaacgatc

SEQ ID NO: 660439 - DNA, 25 bp, Homo sapien
tcaaacgatcacactggttgctgtt

SEQ ID NO: 660440 - DNA, 25 bp, Homo sapien
ctggttgctgttgtttgtgtgacct

SEQ ID NO: 660441 - DNA, 25 bp, Homo sapien
tgtgtgaccttgttggctctctgac

SEQ ID NO: 660442 - DNA, 25 bp, Homo sapien
aaatggcgatgatcatagtacctac

SEQ ID NO: 660443 - DNA, 25 bp, Homo sapien
tacctacctcacaggtggaactgga

SEQ ID NO: 660444 - DNA, 25 bp, Homo sapien
gtggaactggagactgacatatgac

SEQ ID NO: 660445 - DNA, 25 bp, Homo sapien
gtctacagagagcactgagcaatgt

SEQ ID NO: 660446 - DNA, 25 bp, Homo sapien
gagcaatgtgcatttcagtgccgaa

SEQ ID NO: 660447 - DNA, 25 bp, Homo sapien
tcagtgccgaataaagctttgcttt

SEQ ID NO: 660448 - DNA, 25 bp, Homo sapien
ataaggagggcctgtctgagacagc

SEQ ID NO: 660449 - DNA, 25 bp, Homo sapien
tacctcttctggaacaggatgtcct

SEQ ID NO: 660450 - DNA, 25 bp, Homo sapien
gatgtcctgcaacactttagcacag

SEQ ID NO: 660451 - DNA, 25 bp, Homo sapien
tttagcacagtaagctgatgtcccc

SEQ ID NO: 660452 - DNA, 25 bp, Homo sapien
gaaaccccagggtggagcgctccca

SEQ ID NO: 660453 - DNA, 25 bp, Homo sapien
aggctccctcagttgcagtgtgatg

SEQ ID NO: 660454 - DNA, 25 bp, Homo sapien
cctgggcagctttctcgagccatgg

SEQ ID NO: 660455 - DNA, 25 bp, Homo sapien
gcttgccttgagtggtaggcgtcca

SEQ ID NO: 660456 - DNA, 25 bp, Homo sapien
tggtaggcgtccattgtccccgagg

SEQ ID NO: 660457 - DNA, 25 bp, Homo sapien
ccccgaggcctatctgtgagtaata

SEQ ID NO: 660458 - DNA, 25 bp, Homo sapien
tgagtaataaagttgcttcgcttgg

SEQ ID NO: 660459 - DNA, 25 bp, Homo sapien
tctgcaagcccttctcatagccggg

SEQ ID NO: 660460 - DNA, 25 bp, Homo sapien
cctcctgtttgaaccacacaggtaa

SEQ ID NO: 660461 - DNA, 25 bp, Homo sapien
gtaaacagggccaaagcacctccaa

SEQ ID NO: 660462 - DNA, 25 bp, Homo sapien
cacctccaaccttgcatggaaaaaa

SEQ ID NO: 660463 - DNA, 25 bp, Homo sapien
gacggttctcatttccaataggttt

SEQ ID NO: 660464 - DNA, 25 bp, Homo sapien
ggaagggagctctttcttacatttc

SEQ ID NO: 660465 - DNA, 25 bp, Homo sapien
tcccttggagggttcagagattaaa

SEQ ID NO: 660466 - DNA, 25 bp, Homo sapien
gattaaacttataccatcgattaga

SEQ ID NO: 660467 - DNA, 25 bp, Homo sapien
gaatgttttggcctaacggtgctag

SEQ ID NO: 660468 - DNA, 25 bp, Homo sapien
gcctaacggtgctagtatcatttta

SEQ ID NO: 660469 - DNA, 25 bp, Homo sapien
gtgtattcagattcatttgagctat

SEQ ID NO: 660470 - DNA, 25 bp, Homo sapien
gggaatgaaaactaaatggctcttt

SEQ ID NO: 660471 - DNA, 25 bp, Homo sapien
atggctctttcacattggtaggcaa

SEQ ID NO: 660472 - DNA, 25 bp, Homo sapien
tttcacattggtaggcaaagccctt

SEQ ID NO: 660473 - DNA, 25 bp, Homo sapien
gcccttagaaagctttgtcacggtg

SEQ ID NO: 660474 - DNA, 25 bp, Homo sapien
tgtcacggtgtcagcgctatatgat

SEQ ID NO: 660475 - DNA, 25 bp, Homo sapien
gtcagcgctatatgattgttcaatt

SEQ ID NO: 660476 - DNA, 25 bp, Homo sapien
gaaacgcagacttcagtgtgtcttc

SEQ ID NO: 660477 - DNA, 25 bp, Homo sapien
tgtgtcttcttctgtaccttgtgaa

SEQ ID NO: 660478 - DNA, 25 bp, Homo sapien
tctgtaccttgtgaatgtgctgcaa

SEQ ID NO: 660479 - DNA, 25 bp, Homo sapien
gtgctgcaagtgtgttattcctggt

SEQ ID NO: 660480 - DNA, 25 bp, Homo sapien
attcctggtgcgtttattgtgactt

SEQ ID NO: 660481 - DNA, 25 bp, Homo sapien
ttttgaactgtttacaggaacgata

SEQ ID NO: 660482 - DNA, 25 bp, Homo sapien
ttacaggaacgataaaccaaaagtg

SEQ ID NO: 660483 - DNA, 25 bp, Homo sapien
attacttcattattaacttatctgc

SEQ ID NO: 660484 - DNA, 25 bp, Homo sapien
taacttatctgcaaaattccctgag

SEQ ID NO: 660485 - DNA, 25 bp, Homo sapien
attccctgagaatattttaacatta

SEQ ID NO: 660486 - DNA, 25 bp, Homo sapien
ttaacattatagagaagcactgtaa

SEQ ID NO: 660487 - DNA, 25 bp, Homo sapien
gagaagcactgtaaaaccttgataa

SEQ ID NO: 660488 - DNA, 25 bp, Homo sapien
agcactgtaaaaccttgataaatta

SEQ ID NO: 660489 - DNA, 25 bp, Homo sapien
aagaaatatctctaccatcaacttt

SEQ ID NO: 660490 - DNA, 25 bp, Homo sapien
aaatatctctaccatcaactttcag

SEQ ID NO: 660491 - DNA, 25 bp, Homo sapien
atatctctaccatcaactttcagat

SEQ ID NO: 660492 - DNA, 25 bp, Homo sapien
gccaggcacgggactgcaactgtaa

SEQ ID NO: 660493 - DNA, 25 bp, Homo sapien
ctgcaactgtaagctgtgactctgt

SEQ ID NO: 660494 - DNA, 25 bp, Homo sapien
gtgactctgtgtgactccaccggta

SEQ ID NO: 660495 - DNA, 25 bp, Homo sapien
tgactccaccggtacgaacttccag

SEQ ID NO: 660496 - DNA, 25 bp, Homo sapien
gggacagagtatccacaagtggcat

SEQ ID NO: 660497 - DNA, 25 bp, Homo sapien
ccacaagtggcattcagggactgga

SEQ ID NO: 660498 - DNA, 25 bp, Homo sapien
tgattatttcgattgcagtggtggg

SEQ ID NO: 660499 - DNA, 25 bp, Homo sapien
gagggtggacacctgtgccaaactc

SEQ ID NO: 660500 - DNA, 25 bp, Homo sapien
ggacacctgtgccaaactcacttaa

SEQ ID NO: 660501 - DNA, 25 bp, Homo sapien
caaactcacttaaaacggatgtatt

SEQ ID NO: 660502 - DNA, 25 bp, Homo sapien
attatgcctcaatgaaatccattca

SEQ ID NO: 660503 - DNA, 25 bp, Homo sapien
taggagagtagctctgaagccgaac

SEQ ID NO: 660504 - DNA, 25 bp, Homo sapien
tgaagccgaacagcctaggtctaaa

SEQ ID NO: 660505 - DNA, 25 bp, Homo sapien
gaacagcctaggtctaaatcccggt

SEQ ID NO: 660506 - DNA, 25 bp, Homo sapien
ctaaatcccggttctttcatcaata

SEQ ID NO: 660507 - DNA, 25 bp, Homo sapien
ggttctttcatcaataagctccatt

SEQ ID NO: 660508 - DNA, 25 bp, Homo sapien
aataagctccattactgttgataag

SEQ ID NO: 660509 - DNA, 25 bp, Homo sapien
agttatttgaattatcggtgtctta

SEQ ID NO: 660510 - DNA, 25 bp, Homo sapien
cggtgtcttagtatctttccttata

SEQ ID NO: 660511 - DNA, 25 bp, Homo sapien
agaggtgatgattgctcctacctaa

SEQ ID NO: 660512 - DNA, 25 bp, Homo sapien
gattgctcctacctaatagcactgt

SEQ ID NO: 660513 - DNA, 25 bp, Homo sapien
tatgcagagcttatcacactaattg

SEQ ID NO: 660514 - DNA, 25 bp, Homo sapien
gtgctctgccagttcaaagtcaatg

SEQ ID NO: 660515 - DNA, 25 bp, Homo sapien
tgctctgccagttcaaagtcaatgt

SEQ ID NO: 660516 - DNA, 25 bp, Homo sapien
gctctgccagttcaaagtcaatgtg

SEQ ID NO: 660517 - DNA, 25 bp, Homo sapien
ctctgccagttcaaagtcaatgtga

SEQ ID NO: 660518 - DNA, 25 bp, Homo sapien
gccagttcaaagtcaatgtgaagat

SEQ ID NO: 660519 - DNA, 25 bp, Homo sapien
gaagcgtgcggagctcagaagcatt

SEQ ID NO: 660520 - DNA, 25 bp, Homo sapien
aaggagaaagacagccatctgcata

SEQ ID NO: 660521 - DNA, 25 bp, Homo sapien
gagaaagacagccatctgcatacca

SEQ ID NO: 660522 - DNA, 25 bp, Homo sapien
gaaagacagccatctgcataccagg

SEQ ID NO: 660523 - DNA, 25 bp, Homo sapien
tctgctgcatccttgatcttgggct

SEQ ID NO: 660524 - DNA, 25 bp, Homo sapien
tcttgggcttccaacctctagaacc

SEQ ID NO: 660525 - DNA, 25 bp, Homo sapien
cacagaagacaagcagcacattttc

SEQ ID NO: 660526 - DNA, 25 bp, Homo sapien
gaagacaagcagcacattttctcac

SEQ ID NO: 660527 - DNA, 25 bp, Homo sapien
aagacaagcagcacattttctcact

SEQ ID NO: 660528 - DNA, 25 bp, Homo sapien
cacttacttgtaggacataaaagtc

SEQ ID NO: 660529 - DNA, 25 bp, Homo sapien
aaaagtcaaaatgattgggctcatg

SEQ ID NO: 660530 - DNA, 25 bp, Homo sapien
gtcaaaatgattgggctcatggata

SEQ ID NO: 660531 - DNA, 25 bp, Homo sapien
aaatgattgggctcatggatataga

SEQ ID NO: 660532 - DNA, 25 bp, Homo sapien
gattgggctcatggatatagaaagt

SEQ ID NO: 660533 - DNA, 25 bp, Homo sapien
tgggctcatggatatagaaagtgga

SEQ ID NO: 660534 - DNA, 25 bp, Homo sapien
tatagaaagtggaaggatggttacc

SEQ ID NO: 660535 - DNA, 25 bp, Homo sapien
taaagtgtgtaattgagttgtttgt

SEQ ID NO: 660536 - DNA, 25 bp, Homo sapien
acacacacaaacaccaaagcttcag

SEQ ID NO: 660537 - DNA, 25 bp, Homo sapien
aaaggcagactaaattatatggtaa

SEQ ID NO: 660538 - DNA, 25 bp, Homo sapien
attatatggtaagtaggctgtttca

SEQ ID NO: 660539 - DNA, 25 bp, Homo sapien
tggtaagtaggctgtttcattgaac

SEQ ID NO: 660540 - DNA, 25 bp, Homo sapien
ggtaagtaggctgtttcattgaact

SEQ ID NO: 660541 - DNA, 25 bp, Homo sapien
gtaagtaggctgtttcattgaactg

SEQ ID NO: 660542 - DNA, 25 bp, Homo sapien
taagtaggctgtttcattgaactga

SEQ ID NO: 660543 - DNA, 25 bp, Homo sapien
aagtaggctgtttcattgaactgaa

SEQ ID NO: 660544 - DNA, 25 bp, Homo sapien
gtaggctgtttcattgaactgaaat

SEQ ID NO: 660545 - DNA, 25 bp, Homo sapien
aatgcaaaagtaaaccggagatgta

SEQ ID NO: 660546 - DNA, 25 bp, Homo sapien
gtaaaccggagatgtaagttgtcac

SEQ ID NO: 660547 - DNA, 25 bp, Homo sapien
ggatggcaggctacacagtgttgca

SEQ ID NO: 660548 - DNA, 25 bp, Homo sapien
gcaggctacacagtgttgcagattt

SEQ ID NO: 660549 - DNA, 25 bp, Homo sapien
gcacaaaatcttgaaggcctcctat

SEQ ID NO: 660550 - DNA, 25 bp, Homo sapien
gaaggcctcctattcctgtaggaag

SEQ ID NO: 660551 - DNA, 25 bp, Homo sapien
gaaaagatccatacggtcaataagg

SEQ ID NO: 660552 - DNA, 25 bp, Homo sapien
atcaacccagtatatgtatcacaga

SEQ ID NO: 660553 - DNA, 25 bp, Homo sapien
gtatcacagagccaaatgcttccaa

SEQ ID NO: 660554 - DNA, 25 bp, Homo sapien
gaaatgaggcggacctgcactgttt

SEQ ID NO: 660555 - DNA, 25 bp, Homo sapien
atgaggcggacctgcactgtttttt

SEQ ID NO: 660556 - DNA, 25 bp, Homo sapien
ttttttgtacacctggataccattt

SEQ ID NO: 660557 - DNA, 25 bp, Homo sapien
cctggataccatttgattgctgtca

SEQ ID NO: 660558 - DNA, 25 bp, Homo sapien
gacacagtttagttatggcaatgat

SEQ ID NO: 660559 - DNA, 25 bp, Homo sapien
gagcaaagtacgtaagattcttgat

SEQ ID NO: 660560 - DNA, 25 bp, Homo sapien
gtacgtaagattcttgatctcattt

SEQ ID NO: 660561 - DNA, 25 bp, Homo sapien
taagattcttgatctcatttaattc

SEQ ID NO: 660562 - DNA, 25 bp, Homo sapien
agaggaggacgcagcctcccttggc

SEQ ID NO: 660563 - DNA, 25 bp, Homo sapien
ttagctgtaacactctattgcctcc

SEQ ID NO: 660564 - DNA, 25 bp, Homo sapien
agctgtaacactctattgcctccat

SEQ ID NO: 660565 - DNA, 25 bp, Homo sapien
gtaacactctattgcctccataaag

SEQ ID NO: 660566 - DNA, 25 bp, Homo sapien
acactctattgcctccataaagtat

SEQ ID NO: 660567 - DNA, 25 bp, Homo sapien
tattgcctccataaagtatgcttaa

SEQ ID NO: 660568 - DNA, 25 bp, Homo sapien
gcctccataaagtatgcttaattgt

SEQ ID NO: 660569 - DNA, 25 bp, Homo sapien
gccactgaacccagcctatttaaaa

SEQ ID NO: 660570 - DNA, 25 bp, Homo sapien
tgaacccagcctatttaaaacattt

SEQ ID NO: 660571 - DNA, 25 bp, Homo sapien
ggaggctgagaatgtttttaatttc

SEQ ID NO: 660572 - DNA, 25 bp, Homo sapien
ttcatttttgggttgttcgttgcca

SEQ ID NO: 660573 - DNA, 25 bp, Homo sapien
tttgggttgttcgttgccagtgtac

SEQ ID NO: 660574 - DNA, 25 bp, Homo sapien
gggttgttcgttgccagtgtacaga

SEQ ID NO: 660575 - DNA, 25 bp, Homo sapien
gttcgttgccagtgtacagaaatac

SEQ ID NO: 660576 - DNA, 25 bp, Homo sapien
gttgccagtgtacagaaatacaagt

SEQ ID NO: 660577 - DNA, 25 bp, Homo sapien
ttttgtgtgttgatcatggatgcta

SEQ ID NO: 660578 - DNA, 25 bp, Homo sapien
atcatggatgctaattttgtggaat

SEQ ID NO: 660579 - DNA, 25 bp, Homo sapien
ttttgtggaatgtattagctctaat

SEQ ID NO: 660580 - DNA, 25 bp, Homo sapien
ttagatgtggatgtctagttgttcc

SEQ ID NO: 660581 - DNA, 25 bp, Homo sapien
gatgtggatgtctagttgttccaga

SEQ ID NO: 660582 - DNA, 25 bp, Homo sapien
ggatgtctagttgttccagaagtat

SEQ ID NO: 660583 - DNA, 25 bp, Homo sapien
tgtctagttgttccagaagtatctg

SEQ ID NO: 660584 - DNA, 25 bp, Homo sapien
ctagttgttccagaagtatctgtta

SEQ ID NO: 660585 - DNA, 25 bp, Homo sapien
gttgttccagaagtatctgttaaaa

SEQ ID NO: 660586 - DNA, 25 bp, Homo sapien
tttctccattggattattttggcaa

SEQ ID NO: 660587 - DNA, 25 bp, Homo sapien
tctccattggattattttggcaacc

SEQ ID NO: 660588 - DNA, 25 bp, Homo sapien
ccattggattattttggcaacctta

SEQ ID NO: 660589 - DNA, 25 bp, Homo sapien
attggattattttggcaaccttata

SEQ ID NO: 660590 - DNA, 25 bp, Homo sapien
gattattttggcaaccttataaaca

SEQ ID NO: 660591 - DNA, 25 bp, Homo sapien
gtaaactgaaatcaagacatctaaa

SEQ ID NO: 660592 - DNA, 25 bp, Homo sapien
gacatctaaatctaagacctggctc

SEQ ID NO: 660593 - DNA, 25 bp, Homo sapien
ctaaatctaagacctggctccatta

SEQ ID NO: 660594 - DNA, 25 bp, Homo sapien
aatctaagacctggctccattactg

SEQ ID NO: 660595 - DNA, 25 bp, Homo sapien
taagacctggctccattactgtacc

SEQ ID NO: 660596 - DNA, 25 bp, Homo sapien
ggctccattactgtacccctttgga

SEQ ID NO: 660597 - DNA, 25 bp, Homo sapien
tgtgcctggctgataatcctctttt

SEQ ID NO: 660598 - DNA, 25 bp, Homo sapien
gcctggctgataatcctcttttaag

SEQ ID NO: 660599 - DNA, 25 bp, Homo sapien
tggctgataatcctcttttaagaag

SEQ ID NO: 660600 - DNA, 25 bp, Homo sapien
gataatcctcttttaagaagaaggg

SEQ ID NO: 660601 - DNA, 25 bp, Homo sapien
tatatatttacctagggaattccct

SEQ ID NO: 660602 - DNA, 25 bp, Homo sapien
cttaacttttacagcaatctttaga

SEQ ID NO: 660603 - DNA, 25 bp, Homo sapien
aattttgctatatggtctttcttga

SEQ ID NO: 660604 - DNA, 25 bp, Homo sapien
gatttagaaattcccatcaaatttt

SEQ ID NO: 660605 - DNA, 25 bp, Homo sapien
ccatcaattatctgaaatcctttct

SEQ ID NO: 660606 - DNA, 25 bp, Homo sapien
aaatcctttctcagtcaagactgcc

SEQ ID NO: 660607 - DNA, 25 bp, Homo sapien
ctcagtcaagactgcccatgaagcc

SEQ ID NO: 660608 - DNA, 25 bp, Homo sapien
aagtgccttatttgatcctataagc

SEQ ID NO: 660609 - DNA, 25 bp, Homo sapien
gatcctataagcttcactgaaaatc

SEQ ID NO: 660610 - DNA, 25 bp, Homo sapien
aaatcagcagagtctttattaattt

SEQ ID NO: 660611 - DNA, 25 bp, Homo sapien
atgatgggcatgattaactggtctc

SEQ ID NO: 660612 - DNA, 25 bp, Homo sapien
gggcatgattaactggtctcaagtt

SEQ ID NO: 660613 - DNA, 25 bp, Homo sapien
cgtttaagtgtgtagcaccagccgg

SEQ ID NO: 660614 - DNA, 25 bp, Homo sapien
gtttaagtgtgtagcaccagccggg

SEQ ID NO: 660615 - DNA, 25 bp, Homo sapien
tttaagtgtgtagcaccagccgggc

SEQ ID NO: 660616 - DNA, 25 bp, Homo sapien
ttaagtgtgtagcaccagccgggcg

SEQ ID NO: 660617 - DNA, 25 bp, Homo sapien
taagtgtgtagcaccagccgggcgc

SEQ ID NO: 660618 - DNA, 25 bp, Homo sapien
aagtgtgtagcaccagccgggcgca

SEQ ID NO: 660619 - DNA, 25 bp, Homo sapien
agtgtgtagcaccagccgggcgcag

SEQ ID NO: 660620 - DNA, 25 bp, Homo sapien
gtgtgtagcaccagccgggcgcagt

SEQ ID NO: 660621 - DNA, 25 bp, Homo sapien
gagatactgttatatgtgctcatgt

SEQ ID NO: 660622 - DNA, 25 bp, Homo sapien
tatgtgctcatgtaaattgtctggc

SEQ ID NO: 660623 - DNA, 25 bp, Homo sapien
attgtctggcaattagctgcaagag

SEQ ID NO: 660624 - DNA, 25 bp, Homo sapien
tctggcaattagctgcaagaggatt

SEQ ID NO: 660625 - DNA, 25 bp, Homo sapien
aggaagagattctacctatccatct

SEQ ID NO: 660626 - DNA, 25 bp, Homo sapien
tacctatccatctctttacaccatg

SEQ ID NO: 660627 - DNA, 25 bp, Homo sapien
atctctttacaccatgccttctgaa

SEQ ID NO: 660628 - DNA, 25 bp, Homo sapien
tttacaccatgccttctgaagagaa

SEQ ID NO: 660629 - DNA, 25 bp, Homo sapien
gattttcggagagaatccttggatt

SEQ ID NO: 660630 - DNA, 25 bp, Homo sapien
gaatccttggatttagtcaggaata

SEQ ID NO: 660631 - DNA, 25 bp, Homo sapien
gtcaggaatattagatccctaaata

SEQ ID NO: 660632 - DNA, 25 bp, Homo sapien
ttctcccagaaatactgaagaccag

SEQ ID NO: 660633 - DNA, 25 bp, Homo sapien
aaagcattgttcttaaagtgctgaa

SEQ ID NO: 660634 - DNA, 25 bp, Homo sapien
aataacaacccagattccatgtcct

SEQ ID NO: 660635 - DNA, 25 bp, Homo sapien
ttccatgtcctgcaaaactatcttt

SEQ ID NO: 660636 - DNA, 25 bp, Homo sapien
atgtcctgcaaaactatctttttta

SEQ ID NO: 660637 - DNA, 25 bp, Homo sapien
gggacacattttcacctacagactg

SEQ ID NO: 660638 - DNA, 25 bp, Homo sapien
attttcacctacagactgcctaggg

SEQ ID NO: 660639 - DNA, 25 bp, Homo sapien
gggaatttatcccaccagatcttcc

SEQ ID NO: 660640 - DNA, 25 bp, Homo sapien
ccaccagatcttccccataggaaat

SEQ ID NO: 660641 - DNA, 25 bp, Homo sapien
gatcttccccataggaaatgctaaa

SEQ ID NO: 660642 - DNA, 25 bp, Homo sapien
gaatggaaggtcatcgaaaattata

SEQ ID NO: 660643 - DNA, 25 bp, Homo sapien
gtaattatctattccctttaaggca

SEQ ID NO: 660644 - DNA, 25 bp, Homo sapien
ttccctttaaggcacataattttct

SEQ ID NO: 660645 - DNA, 25 bp, Homo sapien
tttcttaatgaacctctaccctact

SEQ ID NO: 660646 - DNA, 25 bp, Homo sapien
tgaacctctaccctactaggtgggt

SEQ ID NO: 660647 - DNA, 25 bp, Homo sapien
gttgggtgagacttaaacttgaaat

SEQ ID NO: 660648 - DNA, 25 bp, Homo sapien
gataatgcctaaagtttgtgcggtt

SEQ ID NO: 660649 - DNA, 25 bp, Homo sapien
atcacctgggccatattggcttcaa

SEQ ID NO: 660650 - DNA, 25 bp, Homo sapien
ccatattggcttcaaattggctata

SEQ ID NO: 660651 - DNA, 25 bp, Homo sapien
ttggctatatttgaagaattgtctt

SEQ ID NO: 660652 - DNA, 25 bp, Homo sapien
tacgttaacactaatgacagctggc

SEQ ID NO: 660653 - DNA, 25 bp, Homo sapien
taacactaatgacagctggctttct

SEQ ID NO: 660654 - DNA, 25 bp, Homo sapien
cgagggccctgcttgtagctggacc

SEQ ID NO: 660655 - DNA, 25 bp, Homo sapien
agggccctgcttgtagctggaccct

SEQ ID NO: 660656 - DNA, 25 bp, Homo sapien
gccctgcttgtagctggaccctgga

SEQ ID NO: 660657 - DNA, 25 bp, Homo sapien
cctgcttgtagctggaccctggaac

SEQ ID NO: 660658 - DNA, 25 bp, Homo sapien
tgcttgtagctggaccctggaacct

SEQ ID NO: 660659 - DNA, 25 bp, Homo sapien
gcttgtagctggaccctggaacctt

SEQ ID NO: 660660 - DNA, 25 bp, Homo sapien
agaagaacaagtaccgagcaccccg

SEQ ID NO: 660661 - DNA, 25 bp, Homo sapien
gaagaacaagtaccgagcaccccga

SEQ ID NO: 660662 - DNA, 25 bp, Homo sapien
agaacaagtaccgagcaccccgagg

SEQ ID NO: 660663 - DNA, 25 bp, Homo sapien
gaacaagtaccgagcaccccgaggg

SEQ ID NO: 660664 - DNA, 25 bp, Homo sapien
caagtaccgagcaccccgagggaag

SEQ ID NO: 660665 - DNA, 25 bp, Homo sapien
tgagaaatcctgctgtatagagaca

SEQ ID NO: 660666 - DNA, 25 bp, Homo sapien
gctgtatagagacaactcccatttc

SEQ ID NO: 660667 - DNA, 25 bp, Homo sapien
caggctccacatgccaagatgagga

SEQ ID NO: 660668 - DNA, 25 bp, Homo sapien
ccacatgccaagatgaggaatattt

SEQ ID NO: 660669 - DNA, 25 bp, Homo sapien
gttgggagcaagactggcttattcc

SEQ ID NO: 660670 - DNA, 25 bp, Homo sapien
gagcaagactggcttattccattaa

SEQ ID NO: 660671 - DNA, 25 bp, Homo sapien
gactggcttattccattaagcatag

SEQ ID NO: 660672 - DNA, 25 bp, Homo sapien
ttattccattaagcatagtagtcta

SEQ ID NO: 660673 - DNA, 25 bp, Homo sapien
catagtagtctaagtgcctgcttgg

SEQ ID NO: 660674 - DNA, 25 bp, Homo sapien
gcctgcttgggacccacaatatttt

SEQ ID NO: 660675 - DNA, 25 bp, Homo sapien
ccacaatattttcaagggcccatga

SEQ ID NO: 660676 - DNA, 25 bp, Homo sapien
atgtccttactctaactgttaccat

SEQ ID NO: 660677 - DNA, 25 bp, Homo sapien
tgtccttactctaactgttaccatt

SEQ ID NO: 660678 - DNA, 25 bp, Homo sapien
gtccttactctaactgttaccattt

SEQ ID NO: 660679 - DNA, 25 bp, Homo sapien
ccaacatttttcaggcttctaaact

SEQ ID NO: 660680 - DNA, 25 bp, Homo sapien
caacatttttcaggcttctaaacta

SEQ ID NO: 660681 - DNA, 25 bp, Homo sapien
acatttttcaggcttctaaactaat

SEQ ID NO: 660682 - DNA, 25 bp, Homo sapien
catttttcaggcttctaaactaata

SEQ ID NO: 660683 - DNA, 25 bp, Homo sapien
ttttcaggcttctaaactaataaca

SEQ ID NO: 660684 - DNA, 25 bp, Homo sapien
tttcaggcttctaaactaataacaa

SEQ ID NO: 660685 - DNA, 25 bp, Homo sapien
ttcaggcttctaaactaataacaag

SEQ ID NO: 660686 - DNA, 25 bp, Homo sapien
caagtctgctttcaaatttcaccaa

SEQ ID NO: 660687 - DNA, 25 bp, Homo sapien
aagtttgctcgcctcctggctgagc

SEQ ID NO: 660688 - DNA, 25 bp, Homo sapien
tggctgagctggagtccagcgcact

SEQ ID NO: 660689 - DNA, 25 bp, Homo sapien
gagtccagcgcacttaagattgctt

SEQ ID NO: 660690 - DNA, 25 bp, Homo sapien
gcgcacttaagattgcttaccgcat

SEQ ID NO: 660691 - DNA, 25 bp, Homo sapien
gcttaccgcattgaacggctggagt

SEQ ID NO: 660692 - DNA, 25 bp, Homo sapien
cagactcgagagtggccaatgcccg

SEQ ID NO: 660693 - DNA, 25 bp, Homo sapien
ggccaatgcccgaggacctggctga

SEQ ID NO: 660694 - DNA, 25 bp, Homo sapien
gcctgaggagggaacttccaaagat

SEQ ID NO: 660695 - DNA, 25 bp, Homo sapien
ccaggattcccacctcctagtgaat

SEQ ID NO: 660696 - DNA, 25 bp, Homo sapien
cccacctcctagtgaatccagagtt

SEQ ID NO: 660697 - DNA, 25 bp, Homo sapien
agttgtagtaaagcctaactgctgc

SEQ ID NO: 660698 - DNA, 25 bp, Homo sapien
ggaaagtttccactcaatagaaatg

SEQ ID NO: 660699 - DNA, 25 bp, Homo sapien
aaagtggctccaggtgagaacaccc

SEQ ID NO: 660700 - DNA, 25 bp, Homo sapien
agagttcaaattccaggtttgtgac

SEQ ID NO: 660701 - DNA, 25 bp, Homo sapien
ggtttgtgactgaccacctctgtga

SEQ ID NO: 660702 - DNA, 25 bp, Homo sapien
gtgaccacaggcacattagacaatg

SEQ ID NO: 660703 - DNA, 25 bp, Homo sapien
atgactctgagcatgttttctcatc

SEQ ID NO: 660704 - DNA, 25 bp, Homo sapien
gacgatttcttattgatcaccaact

SEQ ID NO: 660705 - DNA, 25 bp, Homo sapien
attgatcaccaactacatgccatgt

SEQ ID NO: 660706 - DNA, 25 bp, Homo sapien
catgccatgttctagagaccatgtt

SEQ ID NO: 660707 - DNA, 25 bp, Homo sapien
gaccatgttccacccaagagttgga

SEQ ID NO: 660708 - DNA, 25 bp, Homo sapien
ggtaaataagtcctgcagtttgcct

SEQ ID NO: 660709 - DNA, 25 bp, Homo sapien
ctgctctgtcgagtgagtcttctaa

SEQ ID NO: 660710 - DNA, 25 bp, Homo sapien
gagtgagtcttctaaattgctccaa

SEQ ID NO: 660711 - DNA, 25 bp, Homo sapien
gagtcttctaaattgctccaagata

SEQ ID NO: 660712 - DNA, 25 bp, Homo sapien
aagatgcaaccattagatccctcca

SEQ ID NO: 660713 - DNA, 25 bp, Homo sapien
gatccctccaaggagacaatcagag

SEQ ID NO: 660714 - DNA, 25 bp, Homo sapien
cagagactgtctgattccactgctg

SEQ ID NO: 660715 - DNA, 25 bp, Homo sapien
tgattccactgctgccatctcagag

SEQ ID NO: 660716 - DNA, 25 bp, Homo sapien
actgctgccatctcagagctagaaa

SEQ ID NO: 660717 - DNA, 25 bp, Homo sapien
aatgcattcagaaattcagcagctg

SEQ ID NO: 660718 - DNA, 25 bp, Homo sapien
aatgtcttagacaggttacttaggg

SEQ ID NO: 660719 - DNA, 25 bp, Homo sapien
gtagtaaattacattcttagagaga

SEQ ID NO: 660720 - DNA, 25 bp, Homo sapien
tactatacaggttcccacccttctg

SEQ ID NO: 660721 - DNA, 25 bp, Homo sapien
tacaggttcccacccttctgtagct

SEQ ID NO: 660722 - DNA, 25 bp, Homo sapien
tagctgccagctgttttgagtacca

SEQ ID NO: 660723 - DNA, 25 bp, Homo sapien
gctgccagctgttttgagtaccagc

SEQ ID NO: 660724 - DNA, 25 bp, Homo sapien
tgttttgagtaccagctgtcgcggc

SEQ ID NO: 660725 - DNA, 25 bp, Homo sapien
tttgagtaccagctgtcgcggcctt

SEQ ID NO: 660726 - DNA, 25 bp, Homo sapien
gagtaccagctgtcgcggccttcat

SEQ ID NO: 660727 - DNA, 25 bp, Homo sapien
gctgtcgcggccttcatgttttttg

SEQ ID NO: 660728 - DNA, 25 bp, Homo sapien
acaaaagccacttttacgcgtgcct

SEQ ID NO: 660729 - DNA, 25 bp, Homo sapien
aaaagccacttttacgcgtgcctgt

SEQ ID NO: 660730 - DNA, 25 bp, Homo sapien
aagccacttttacgcgtgcctgtgg

SEQ ID NO: 660731 - DNA, 25 bp, Homo sapien
atgtccaggacaccaaatttctact

SEQ ID NO: 660732 - DNA, 25 bp, Homo sapien
aatttctactgcgaactctaggtcc

SEQ ID NO: 660733 - DNA, 25 bp, Homo sapien
gaactctaggtcctcacgagccttt

SEQ ID NO: 660734 - DNA, 25 bp, Homo sapien
gagcctttctctgcgagtccaaaat

SEQ ID NO: 660735 - DNA, 25 bp, Homo sapien
tctgcgagtccaaaattcagccaca

SEQ ID NO: 660736 - DNA, 25 bp, Homo sapien
gccacatttcctaagaggcacctgt

SEQ ID NO: 660737 - DNA, 25 bp, Homo sapien
aggcacctgtacttgtctatttcaa

SEQ ID NO: 660738 - DNA, 25 bp, Homo sapien
agccagaagctgacaacggcccagg

SEQ ID NO: 660739 - DNA, 25 bp, Homo sapien
tgacaacggcccaggaaccaggact

SEQ ID NO: 660740 - DNA, 25 bp, Homo sapien
gactgctttcaggaggcgctcagaa

SEQ ID NO: 660741 - DNA, 25 bp, Homo sapien
agcaaagtaccctctcaacattagt

SEQ ID NO: 660742 - DNA, 25 bp, Homo sapien
gattttccagaagctacatgatgtg

SEQ ID NO: 660743 - DNA, 25 bp, Homo sapien
aagaaggtaagagatccagcggtct

SEQ ID NO: 660744 - DNA, 25 bp, Homo sapien
agagatccagcggtcttgtactaag

SEQ ID NO: 660745 - DNA, 25 bp, Homo sapien
gatccagcggtcttgtactaagcca

SEQ ID NO: 660746 - DNA, 25 bp, Homo sapien
ccagcggtcttgtactaagccagat

SEQ ID NO: 660747 - DNA, 25 bp, Homo sapien
gcggtcttgtactaagccagatgtt

SEQ ID NO: 660748 - DNA, 25 bp, Homo sapien
gtactaagccagatgttaaagagat

SEQ ID NO: 660749 - DNA, 25 bp, Homo sapien
gcaaaaatagaaaactgcccctctt

SEQ ID NO: 660750 - DNA, 25 bp, Homo sapien
tagaaaactgcccctcttttcactt

SEQ ID NO: 660751 - DNA, 25 bp, Homo sapien
ttttcattagagaacgttaacatct

SEQ ID NO: 660752 - DNA, 25 bp, Homo sapien
gagaacgttaacatctaatgggttt

SEQ ID NO: 660753 - DNA, 25 bp, Homo sapien
ggtgacacaagcctatagtcttaac

SEQ ID NO: 660754 - DNA, 25 bp, Homo sapien
gacacaagcctatagtcttaactac

SEQ ID NO: 660755 - DNA, 25 bp, Homo sapien
acaagcctatagtcttaactactcg

SEQ ID NO: 660756 - DNA, 25 bp, Homo sapien
aagcctatagtcttaactactcgga

SEQ ID NO: 660757 - DNA, 25 bp, Homo sapien
gcctatagtcttaactactcggagg

SEQ ID NO: 660758 - DNA, 25 bp, Homo sapien
tatagtcttaactactcggaggcca

SEQ ID NO: 660759 - DNA, 25 bp, Homo sapien
atagtcttaactactcggaggccaa

SEQ ID NO: 660760 - DNA, 25 bp, Homo sapien
tagtcttaactactcggaggccaag

SEQ ID NO: 660761 - DNA, 25 bp, Homo sapien
agtcttaactactcggaggccaaga

SEQ ID NO: 660762 - DNA, 25 bp, Homo sapien
ttaactactcggaggccaagacagg

SEQ ID NO: 660763 - DNA, 25 bp, Homo sapien
tgtgattgcaccacttgtaactcca

SEQ ID NO: 660764 - DNA, 25 bp, Homo sapien
gaacctcagagtaggatgagctatt

SEQ ID NO: 660765 - DNA, 25 bp, Homo sapien
aagatttctcaatgttgcacccttc

SEQ ID NO: 660766 - DNA, 25 bp, Homo sapien
acaccctgatgacctggtaaatatt

SEQ ID NO: 660767 - DNA, 25 bp, Homo sapien
cctcacttttctcttacatcgtatg

SEQ ID NO: 660768 - DNA, 25 bp, Homo sapien
ttttctcttacatcgtatggcagga

SEQ ID NO: 660769 - DNA, 25 bp, Homo sapien
cttacatcgtatggcaggaagcaga

SEQ ID NO: 660770 - DNA, 25 bp, Homo sapien
tagaaagactatgggctttggaatc

SEQ ID NO: 660771 - DNA, 25 bp, Homo sapien
gggattgaattccatttctgctatt

SEQ ID NO: 660772 - DNA, 25 bp, Homo sapien
ttccatttctgctattctgaactct

SEQ ID NO: 660773 - DNA, 25 bp, Homo sapien
tctgaactctataatattgggcaag

SEQ ID NO: 660774 - DNA, 25 bp, Homo sapien
gatagtaatagctacattttagggc

SEQ ID NO: 660775 - DNA, 25 bp, Homo sapien
gatgtgatactcttattcagtgcac

SEQ ID NO: 660776 - DNA, 25 bp, Homo sapien
gtgcacattctacataactctacgt

SEQ ID NO: 660777 - DNA, 25 bp, Homo sapien
aactctacgtagcaaccctgtaggc

SEQ ID NO: 660778 - DNA, 25 bp, Homo sapien
aaatacccacatagtggacaccagt

SEQ ID NO: 660779 - DNA, 25 bp, Homo sapien
ggacaccagtccactttgaaacagt

SEQ ID NO: 660780 - DNA, 25 bp, Homo sapien
agttcaagtcttttctgacccatct

SEQ ID NO: 660781 - DNA, 25 bp, Homo sapien
catctctcatatttctgccacagag

SEQ ID NO: 660782 - DNA, 25 bp, Homo sapien
aatgctttcaccaatattggacatg

SEQ ID NO: 660783 - DNA, 25 bp, Homo sapien
tggacatgttagatgtgctcatcct

SEQ ID NO: 660784 - DNA, 25 bp, Homo sapien
aaaaatgacaatgccagctggagaa

SEQ ID NO: 660785 - DNA, 25 bp, Homo sapien
ggaaccaaccatattttaatacctg

SEQ ID NO: 660786 - DNA, 25 bp, Homo sapien
atccccaatattggaggcagggcct

SEQ ID NO: 660787 - DNA, 25 bp, Homo sapien
ttgatcatgggagtggatgcctcat

SEQ ID NO: 660788 - DNA, 25 bp, Homo sapien
agtggatgcctcatggcttggtgtt

SEQ ID NO: 660789 - DNA, 25 bp, Homo sapien
tcatggcttggtgttgtctttacaa

SEQ ID NO: 660790 - DNA, 25 bp, Homo sapien
gtctttacaatagggagttagttct

SEQ ID NO: 660791 - DNA, 25 bp, Homo sapien
agttagttctcatgcgatctggttg

SEQ ID NO: 660792 - DNA, 25 bp, Homo sapien
tgctttcaccatgtgatgtgccttc

SEQ ID NO: 660793 - DNA, 25 bp, Homo sapien
cttctgcagtgattgtaagctttat

SEQ ID NO: 660794 - DNA, 25 bp, Homo sapien
gtaagctttatgagacatccccaga

SEQ ID NO: 660795 - DNA, 25 bp, Homo sapien
gagacatccccagaagttgagcaga

SEQ ID NO: 660796 - DNA, 25 bp, Homo sapien
atactgcctgtaaagcctacagaac

SEQ ID NO: 660797 - DNA, 25 bp, Homo sapien
attgaaaacaatagagcctgcattt

SEQ ID NO: 660798 - DNA, 25 bp, Homo sapien
aatagagcctgcattttggttgtaa

SEQ ID NO: 660799 - DNA, 25 bp, Homo sapien
gagcctgcattttggttgtaacaat

SEQ ID NO: 660800 - DNA, 25 bp, Homo sapien
ggttgtaacaatccattctgtgtat

SEQ ID NO: 660801 - DNA, 25 bp, Homo sapien
aacaatccattctgtgtatttgcat

SEQ ID NO: 660802 - DNA, 25 bp, Homo sapien
ccattctgtgtatttgcatgtgatt

SEQ ID NO: 660803 - DNA, 25 bp, Homo sapien
gttatttgcaactttaatgtggcca

SEQ ID NO: 660804 - DNA, 25 bp, Homo sapien
tgcaactttaatgtggccagaacca

SEQ ID NO: 660805 - DNA, 25 bp, Homo sapien
atgtggccagaaccatatacatttg

SEQ ID NO: 660806 - DNA, 25 bp, Homo sapien
gaaccatatacatttgaaaggctgc

SEQ ID NO: 660807 - DNA, 25 bp, Homo sapien
tgaaaggctgctaaattgaaaacaa

SEQ ID NO: 660808 - DNA, 25 bp, Homo sapien
ctgtttcttgttggctcctctacca

SEQ ID NO: 660809 - DNA, 25 bp, Homo sapien
gctcctctaccacccggttgataat

SEQ ID NO: 660810 - DNA, 25 bp, Homo sapien
tctaccacccggttgataattcagg

SEQ ID NO: 660811 - DNA, 25 bp, Homo sapien
taccacccggttgataattcaggtt

SEQ ID NO: 660812 - DNA, 25 bp, Homo sapien
cccggttgataattcaggtttctgt

SEQ ID NO: 660813 - DNA, 25 bp, Homo sapien
ttcaggtttctgtgaccagtagctt

SEQ ID NO: 660814 - DNA, 25 bp, Homo sapien
ggtttctgtgaccagtagctttgga

SEQ ID NO: 660815 - DNA, 25 bp, Homo sapien
ttctgtgaccagtagctttggaatg

SEQ ID NO: 660816 - DNA, 25 bp, Homo sapien
gtgaccagtagctttggaatggctt

SEQ ID NO: 660817 - DNA, 25 bp, Homo sapien
gaccagtagctttggaatggcttat

SEQ ID NO: 660818 - DNA, 25 bp, Homo sapien
tagctttggaatggcttatgcttgt

SEQ ID NO: 660819 - DNA, 25 bp, Homo sapien
tctgtttgcggttggaccagtaaag

SEQ ID NO: 660820 - DNA, 25 bp, Homo sapien
tgcggttggaccagtaaagaccctt

SEQ ID NO: 660821 - DNA, 25 bp, Homo sapien
agacagaaactaaaatccatgattt

SEQ ID NO: 660822 - DNA, 25 bp, Homo sapien
ggttggacgagcttggtctacagca

SEQ ID NO: 660823 - DNA, 25 bp, Homo sapien
ggacgagcttggtctacagcagtat

SEQ ID NO: 660824 - DNA, 25 bp, Homo sapien
cttggtctacagcagtatgttttat

SEQ ID NO: 660825 - DNA, 25 bp, Homo sapien
tatttggttctcatggaggtattcc

SEQ ID NO: 660826 - DNA, 25 bp, Homo sapien
ggttctcatggaggtattccactgt

SEQ ID NO: 660827 - DNA, 25 bp, Homo sapien
tgtttttctttcaacatactgttgc

SEQ ID NO: 660828 - DNA, 25 bp, Homo sapien
tttcaacatactgttgctggcttga

SEQ ID NO: 660829 - DNA, 25 bp, Homo sapien
gttgctggcttgaatcatggagata

SEQ ID NO: 660830 - DNA, 25 bp, Homo sapien
acaagaaaattgcacgtggaataag

SEQ ID NO: 660831 - DNA, 25 bp, Homo sapien
gatagaagtttacagtcctccagtg

SEQ ID NO: 660832 - DNA, 25 bp, Homo sapien
tcctccagtgtttggtctcagcgtt

SEQ ID NO: 660833 - DNA, 25 bp, Homo sapien
ccagtgtttggtctcagcgtttttg

SEQ ID NO: 660834 - DNA, 25 bp, Homo sapien
tggtctcagcgtttttggtcccttt

SEQ ID NO: 660835 - DNA, 25 bp, Homo sapien
tcagcgtttttggtccctttacaat

SEQ ID NO: 660836 - DNA, 25 bp, Homo sapien
tggtccctttacaatcttaaaaatg

SEQ ID NO: 660837 - DNA, 25 bp, Homo sapien
aaaatgatcgatctttggtttttgt

SEQ ID NO: 660838 - DNA, 25 bp, Homo sapien
tttgtgggtcaaaacattggtattt

SEQ ID NO: 660839 - DNA, 25 bp, Homo sapien
agtgacactaataaagcaaaccatt

SEQ ID NO: 660840 - DNA, 25 bp, Homo sapien
ctaataaagcaaaccattacgtact

SEQ ID NO: 660841 - DNA, 25 bp, Homo sapien
agtcacgttccccatgcttgttcga

SEQ ID NO: 660842 - DNA, 25 bp, Homo sapien
tcacgttccccatgcttgttcgatt

SEQ ID NO: 660843 - DNA, 25 bp, Homo sapien
acgttccccatgcttgttcgattta

SEQ ID NO: 660844 - DNA, 25 bp, Homo sapien
cgttccccatgcttgttcgatttat

SEQ ID NO: 660845 - DNA, 25 bp, Homo sapien
gttccccatgcttgttcgatttatc

SEQ ID NO: 660846 - DNA, 25 bp, Homo sapien
ttccccatgcttgttcgatttatca

SEQ ID NO: 660847 - DNA, 25 bp, Homo sapien
tccccatgcttgttcgatttatcat

SEQ ID NO: 660848 - DNA, 25 bp, Homo sapien
ccccatgcttgttcgatttatcatg

SEQ ID NO: 660849 - DNA, 25 bp, Homo sapien
cccatgcttgttcgatttatcatga

SEQ ID NO: 660850 - DNA, 25 bp, Homo sapien
atgcttgttcgatttatcatgaccc

SEQ ID NO: 660851 - DNA, 25 bp, Homo sapien
tgcttgttcgatttatcatgaccct

SEQ ID NO: 660852 - DNA, 25 bp, Homo sapien
tatcaagccctttaacatacccagt

SEQ ID NO: 660853 - DNA, 25 bp, Homo sapien
ttaacatacccagtttgtgctccca

SEQ ID NO: 660854 - DNA, 25 bp, Homo sapien
ttgtgctcccagacgtaagatctct

SEQ ID NO: 660855 - DNA, 25 bp, Homo sapien
gtaagatctctttggccatgtatgt

SEQ ID NO: 660856 - DNA, 25 bp, Homo sapien
ttggccatgtatgtgggattcccat

SEQ ID NO: 660857 - DNA, 25 bp, Homo sapien
gagaagcttcatttccagcaagaat

SEQ ID NO: 660858 - DNA, 25 bp, Homo sapien
cagcaagaatctggcttccacctag

SEQ ID NO: 660859 - DNA, 25 bp, Homo sapien
ctggcttccacctagacttgggaaa

SEQ ID NO: 660860 - DNA, 25 bp, Homo sapien
gcatattgctgatcaactagacaac

SEQ ID NO: 660861 - DNA, 25 bp, Homo sapien
tagacaacctacttccactcttgat

SEQ ID NO: 660862 - DNA, 25 bp, Homo sapien
gtaatccatctagaacagccagagc

SEQ ID NO: 660863 - DNA, 25 bp, Homo sapien
gggctgtcgaccacaggtaccaacc

SEQ ID NO: 660864 - DNA, 25 bp, Homo sapien
tgccctcccctacagagtatgtgac

SEQ ID NO: 660865 - DNA, 25 bp, Homo sapien
gcacagccaatgactgcatcccagt

SEQ ID NO: 660866 - DNA, 25 bp, Homo sapien
atcccagtgcttcgaccagtcacag

SEQ ID NO: 660867 - DNA, 25 bp, Homo sapien
ccagtgcttcgaccagtcacagggt

SEQ ID NO: 660868 - DNA, 25 bp, Homo sapien
gtgcttcgaccagtcacagggtcaa

SEQ ID NO: 660869 - DNA, 25 bp, Homo sapien
ttcgaccagtcacagggtcaagggt

SEQ ID NO: 660870 - DNA, 25 bp, Homo sapien
ccagtcacagggtcaagggtgcagt

SEQ ID NO: 660871 - DNA, 25 bp, Homo sapien
agcactttggagtcccaagcaggca

SEQ ID NO: 660872 - DNA, 25 bp, Homo sapien
tttggagtcccaagcaggcagatcg

SEQ ID NO: 660873 - DNA, 25 bp, Homo sapien
ttggagtcccaagcaggcagatcgc

SEQ ID NO: 660874 - DNA, 25 bp, Homo sapien
agaaaggagacctgagccactaagt

SEQ ID NO: 660875 - DNA, 25 bp, Homo sapien
gagccactaagtaagaagtccagtt

SEQ ID NO: 660876 - DNA, 25 bp, Homo sapien
agaagtccagttaccctgttggata

SEQ ID NO: 660877 - DNA, 25 bp, Homo sapien
gttaccctgttggataaaccacatg

SEQ ID NO: 660878 - DNA, 25 bp, Homo sapien
aaaggccctgagatacttggagaga

SEQ ID NO: 660879 - DNA, 25 bp, Homo sapien
accggctgactgcaaacacatcagt

SEQ ID NO: 660880 - DNA, 25 bp, Homo sapien
tgcaaacacatcagtgaccaccagt

SEQ ID NO: 660881 - DNA, 25 bp, Homo sapien
agtgaccaccagtaagaccagcaga

SEQ ID NO: 660882 - DNA, 25 bp, Homo sapien
aagaccagcagagctgcacagccaa

SEQ ID NO: 660883 - DNA, 25 bp, Homo sapien
agcagagctgcacagccaagcccag

SEQ ID NO: 660884 - DNA, 25 bp, Homo sapien
gcccagattgcagaattgtgagcaa

SEQ ID NO: 660885 - DNA, 25 bp, Homo sapien
ggagcaggattcaaacgcaggcaat

SEQ ID NO: 660886 - DNA, 25 bp, Homo sapien
aacgcaggcaatcaaaaccccgagt

SEQ ID NO: 660887 - DNA, 25 bp, Homo sapien
caggcaatcaaaaccccgagtcatg

SEQ ID NO: 660888 - DNA, 25 bp, Homo sapien
tcaaaaccccgagtcatgctcttaa

SEQ ID NO: 660889 - DNA, 25 bp, Homo sapien
aaaccccgagtcatgctcttaacca

SEQ ID NO: 660890 - DNA, 25 bp, Homo sapien
gctcttaaccactacgccacgagtt

SEQ ID NO: 660891 - DNA, 25 bp, Homo sapien
actacgccacgagttctcaaagcgt

SEQ ID NO: 660892 - DNA, 25 bp, Homo sapien
acgagttctcaaagcgtgacctgca

SEQ ID NO: 660893 - DNA, 25 bp, Homo sapien
agttctcaaagcgtgacctgcacac

SEQ ID NO: 660894 - DNA, 25 bp, Homo sapien
caaagcgtgacctgcacacccttgg

SEQ ID NO: 660895 - DNA, 25 bp, Homo sapien
ttggaatcctcaagaccctttcagg

SEQ ID NO: 660896 - DNA, 25 bp, Homo sapien
tgaggtcccagctgacaggccgcat

SEQ ID NO: 660897 - DNA, 25 bp, Homo sapien
tgacaggccgcatcaaatcgccaag

SEQ ID NO: 660898 - DNA, 25 bp, Homo sapien
ggccgcatcaaatcgccaaggatgt

SEQ ID NO: 660899 - DNA, 25 bp, Homo sapien
atgacaatggtggacgtctcattca

SEQ ID NO: 660900 - DNA, 25 bp, Homo sapien
tggacgtctcattcatcctggaaga

SEQ ID NO: 660901 - DNA, 25 bp, Homo sapien
acgtctcattcatcctggaagactg

SEQ ID NO: 660902 - DNA, 25 bp, Homo sapien
agactgacagaggagacagcttcaa

SEQ ID NO: 660903 - DNA, 25 bp, Homo sapien
acagcttcaaggcaagcagggcttt

SEQ ID NO: 660904 - DNA, 25 bp, Homo sapien
catcaaccagccaatcacaaaatca

SEQ ID NO: 660905 - DNA, 25 bp, Homo sapien
gatactacatggcaactaaccttta

SEQ ID NO: 660906 - DNA, 25 bp, Homo sapien
gaaactactgcttgtcaaattttgt

SEQ ID NO: 660907 - DNA, 25 bp, Homo sapien
tgaagagccctccaaagacgtcatc

SEQ ID NO: 660908 - DNA, 25 bp, Homo sapien
acgtcatcttgtactgtctccagaa

SEQ ID NO: 660909 - DNA, 25 bp, Homo sapien
aaacttctgcaaagtgacttagggc

SEQ ID NO: 660910 - DNA, 25 bp, Homo sapien
gacttagggctagagcacccacggt

SEQ ID NO: 660911 - DNA, 25 bp, Homo sapien
gcacccacggtgaatgaacgacatg

SEQ ID NO: 660912 - DNA, 25 bp, Homo sapien
aacgacatgggccatcagcctgcag

SEQ ID NO: 660913 - DNA, 25 bp, Homo sapien
cagcctgcagtgtctgatagaactc

SEQ ID NO: 660914 - DNA, 25 bp, Homo sapien
gatagaactctcattgttacacttt

SEQ ID NO: 660915 - DNA, 25 bp, Homo sapien
aattgtccgtatccttaggcacgtt

SEQ ID NO: 660916 - DNA, 25 bp, Homo sapien
aggcacgttatgtaggccacggtac

SEQ ID NO: 660917 - DNA, 25 bp, Homo sapien
taggccacggtacatctccaactta

SEQ ID NO: 660918 - DNA, 25 bp, Homo sapien
aatacagtactgcataatcccactt

SEQ ID NO: 660919 - DNA, 25 bp, Homo sapien
acagtactgcataatcccacttaga

SEQ ID NO: 660920 - DNA, 25 bp, Homo sapien
gtactgcataatcccacttagaata

SEQ ID NO: 660921 - DNA, 25 bp, Homo sapien
gcataatcccacttagaataaattc

SEQ ID NO: 660922 - DNA, 25 bp, Homo sapien
aacaagtgcaactaatacattttaa

SEQ ID NO: 660923 - DNA, 25 bp, Homo sapien
gatgattgcaaagggcataagggaa

SEQ ID NO: 660924 - DNA, 25 bp, Homo sapien
gggatggtgatggaagttcatcttt

SEQ ID NO: 660925 - DNA, 25 bp, Homo sapien
ggaagttcatctttggtatgacaat

SEQ ID NO: 660926 - DNA, 25 bp, Homo sapien
gttcatctttggtatgacaatgtct

SEQ ID NO: 660927 - DNA, 25 bp, Homo sapien
atgacaatgtctatacttctccaaa

SEQ ID NO: 660928 - DNA, 25 bp, Homo sapien
acaatgtctatacttctccaaactc

SEQ ID NO: 660929 - DNA, 25 bp, Homo sapien
agttgtaaagaaatggcagctaggc

SEQ ID NO: 660930 - DNA, 25 bp, Homo sapien
gttgtaaagaaatggcagctaggcc

SEQ ID NO: 660931 - DNA, 25 bp, Homo sapien
ttgtaaagaaatggcagctaggccg

SEQ ID NO: 660932 - DNA, 25 bp, Homo sapien
taaagaaatggcagctaggccggga

SEQ ID NO: 660933 - DNA, 25 bp, Homo sapien
aaagaaatggcagctaggccgggag

SEQ ID NO: 660934 - DNA, 25 bp, Homo sapien
aagaaatggcagctaggccgggagc

SEQ ID NO: 660935 - DNA, 25 bp, Homo sapien
agaaatggcagctaggccgggagca

SEQ ID NO: 660936 - DNA, 25 bp, Homo sapien
gaaatggcagctaggccgggagcag

SEQ ID NO: 660937 - DNA, 25 bp, Homo sapien
aaatggcagctaggccgggagcagt

SEQ ID NO: 660938 - DNA, 25 bp, Homo sapien
aatggcagctaggccgggagcagtg

SEQ ID NO: 660939 - DNA, 25 bp, Homo sapien
actccagcctgtccagcccgggcga

SEQ ID NO: 660940 - DNA, 25 bp, Homo sapien
gtgtcacagtttcctagtctctaaa

SEQ ID NO: 660941 - DNA, 25 bp, Homo sapien
aacagataatagtgacctaccttat

SEQ ID NO: 660942 - DNA, 25 bp, Homo sapien
gtgacctaccttatagactgttatg

SEQ ID NO: 660943 - DNA, 25 bp, Homo sapien
atgttagccattgttattgctccta

SEQ ID NO: 660944 - DNA, 25 bp, Homo sapien
attgttattgctcctattgacctga

SEQ ID NO: 660945 - DNA, 25 bp, Homo sapien
attgctcctattgacctgaagtata

SEQ ID NO: 660946 - DNA, 25 bp, Homo sapien
aaacagaaatgtgaccctggtcctt

SEQ ID NO: 660947 - DNA, 25 bp, Homo sapien
aaatgtgaccctggtccttgacctt

SEQ ID NO: 660948 - DNA, 25 bp, Homo sapien
tggtccttgaccttgggtggcatca

SEQ ID NO: 660949 - DNA, 25 bp, Homo sapien
ggtggcatcaccagataagcaatag

SEQ ID NO: 660950 - DNA, 25 bp, Homo sapien
aaatgtttgtactgggtattttcat

SEQ ID NO: 660951 - DNA, 25 bp, Homo sapien
tgaatccagctccaatcaataattg

SEQ ID NO: 660952 - DNA, 25 bp, Homo sapien
taagcagagagtgcctaatctcttc

SEQ ID NO: 660953 - DNA, 25 bp, Homo sapien
aatctcttcaattctcaagatcatg

SEQ ID NO: 660954 - DNA, 25 bp, Homo sapien
aagatcatgcttaacatgaccacat

SEQ ID NO: 660955 - DNA, 25 bp, Homo sapien
aacatgaccacattaattacagcag

SEQ ID NO: 660956 - DNA, 25 bp, Homo sapien
attacagcagagtgagacaggcaca

SEQ ID NO: 660957 - DNA, 25 bp, Homo sapien
gagggacttggaacctgacctaaat

SEQ ID NO: 660958 - DNA, 25 bp, Homo sapien
gaacctgacctaaatacagaagtgt

SEQ ID NO: 660959 - DNA, 25 bp, Homo sapien
gaagtgtcaagcctagaaggaagta

SEQ ID NO: 660960 - DNA, 25 bp, Homo sapien
taacaacccaacaacatctgacatt

SEQ ID NO: 660961 - DNA, 25 bp, Homo sapien
acaacatctgacattatggaatact

SEQ ID NO: 660962 - DNA, 25 bp, Homo sapien
cctggccaacataaggagacctaag

SEQ ID NO: 660963 - DNA, 25 bp, Homo sapien
ctggccaacataaggagacctaagt

SEQ ID NO: 660964 - DNA, 25 bp, Homo sapien
ggccaacataaggagacctaagtgc

SEQ ID NO: 660965 - DNA, 25 bp, Homo sapien
caacataaggagacctaagtgccta

SEQ ID NO: 660966 - DNA, 25 bp, Homo sapien
acataaggagacctaagtgcctaac

SEQ ID NO: 660967 - DNA, 25 bp, Homo sapien
cataaggagacctaagtgcctaact

SEQ ID NO: 660968 - DNA, 25 bp, Homo sapien
gcatgagatcaaagagacctctctt

SEQ ID NO: 660969 - DNA, 25 bp, Homo sapien
ggtctggatcagagccccccctttt

SEQ ID NO: 660970 - DNA, 25 bp, Homo sapien
cccttttccagtaacaccagcactt

SEQ ID NO: 660971 - DNA, 25 bp, Homo sapien
aacaccagcactttgtgggaaagac

SEQ ID NO: 660972 - DNA, 25 bp, Homo sapien
agcactttgtgggaaagacagaggc

SEQ ID NO: 660973 - DNA, 25 bp, Homo sapien
ctttatgtccacatgtttccagcat

SEQ ID NO: 660974 - DNA, 25 bp, Homo sapien
ctcccacttatacgtgagagtatgt

SEQ ID NO: 660975 - DNA, 25 bp, Homo sapien
cgtgagagtatgtggtatttgtttt

SEQ ID NO: 660976 - DNA, 25 bp, Homo sapien
tctgtgtctgcattaatttacttag

SEQ ID NO: 660977 - DNA, 25 bp, Homo sapien
tgatggcttccagctgcatcttttg

SEQ ID NO: 660978 - DNA, 25 bp, Homo sapien
tctttatccagaacactgttgatag

SEQ ID NO: 660979 - DNA, 25 bp, Homo sapien
gaacactgttgataggcatctacat

SEQ ID NO: 660980 - DNA, 25 bp, Homo sapien
gataggcatctacattgattccatg

SEQ ID NO: 660981 - DNA, 25 bp, Homo sapien
ggcatctacattgattccatgtctt

SEQ ID NO: 660982 - DNA, 25 bp, Homo sapien
atctacattgattccatgtcttggc

SEQ ID NO: 660983 - DNA, 25 bp, Homo sapien
gcaataaacatgcatggttcaactt

SEQ ID NO: 660984 - DNA, 25 bp, Homo sapien
atgtgtgggaggtcctggtgtccac

SEQ ID NO: 660985 - DNA, 25 bp, Homo sapien
ctggtgtccaccgtgaggatggtca

SEQ ID NO: 660986 - DNA, 25 bp, Homo sapien
gtgaggatggtcacaccccatagct

SEQ ID NO: 660987 - DNA, 25 bp, Homo sapien
gtcacaccccatagctttgttgatg

SEQ ID NO: 660988 - DNA, 25 bp, Homo sapien
atagctttgttgatgctgtggctgt

SEQ ID NO: 660989 - DNA, 25 bp, Homo sapien
atgctgtggctgtagcaggcccagt

SEQ ID NO: 660990 - DNA, 25 bp, Homo sapien
cctagcaccagtgcccagtgaagtg

SEQ ID NO: 660991 - DNA, 25 bp, Homo sapien
ggctggacataggtggcctcagttc

SEQ ID NO: 660992 - DNA, 25 bp, Homo sapien
acataggtggcctcagttcctggga

SEQ ID NO: 660993 - DNA, 25 bp, Homo sapien
tgctcccaggcttcaggtggacgag

SEQ ID NO: 660994 - DNA, 25 bp, Homo sapien
cttcaggtggacgagttagtgacca

SEQ ID NO: 660995 - DNA, 25 bp, Homo sapien
gagggcatgtcggtgatgaaactat

SEQ ID NO: 660996 - DNA, 25 bp, Homo sapien
gatgaaactatcactactgttcaag

SEQ ID NO: 660997 - DNA, 25 bp, Homo sapien
tatcactactgttcaaggtgccaga

SEQ ID NO: 660998 - DNA, 25 bp, Homo sapien
ctactgttcaaggtgccagaagttt

SEQ ID NO: 660999 - DNA, 25 bp, Homo sapien
gtgccagaagtttgacttaccatcg

SEQ ID NO: 661000 - DNA, 25 bp, Homo sapien
gaagtttgacttaccatcgcttttg

SEQ ID NO: 661001 - DNA, 25 bp, Homo sapien
gtttgacttaccatcgcttttgaac

SEQ ID NO: 661002 - DNA, 25 bp, Homo sapien
gacttaccatcgcttttgaacaatc

SEQ ID NO: 661003 - DNA, 25 bp, Homo sapien
atcgcttttgaacaatcatcactac

SEQ ID NO: 661004 - DNA, 25 bp, Homo sapien
aatcatcactacatgtcagcgtggg

SEQ ID NO: 661005 - DNA, 25 bp, Homo sapien
atcactacatgtcagcgtgggaaaa

SEQ ID NO: 661006 - DNA, 25 bp, Homo sapien
gaatattagaatgattcccatttct

SEQ ID NO: 661007 - DNA, 25 bp, Homo sapien
agaatgattcccatttctagcaggt

SEQ ID NO: 661008 - DNA, 25 bp, Homo sapien
gaatgattcccatttctagcaggta

SEQ ID NO: 661009 - DNA, 25 bp, Homo sapien
aatgattcccatttctagcaggtac

SEQ ID NO: 661010 - DNA, 25 bp, Homo sapien
atgattcccatttctagcaggtacc

SEQ ID NO: 661011 - DNA, 25 bp, Homo sapien
tatatgacaaatgcctaatactctg

SEQ ID NO: 661012 - DNA, 25 bp, Homo sapien
atgacaaatgcctaatactctgatt

SEQ ID NO: 661013 - DNA, 25 bp, Homo sapien
gacaaatgcctaatactctgattat

SEQ ID NO: 661014 - DNA, 25 bp, Homo sapien
aaatgcctaatactctgattatatg

SEQ ID NO: 661015 - DNA, 25 bp, Homo sapien
gcctaatactctgattatatgatga

SEQ ID NO: 661016 - DNA, 25 bp, Homo sapien
ctctgattatatgatgagtacttat

SEQ ID NO: 661017 - DNA, 25 bp, Homo sapien
tcatattttgtagccttaaccccca

SEQ ID NO: 661018 - DNA, 25 bp, Homo sapien
ttaacccccagtaccttgatatgtg

SEQ ID NO: 661019 - DNA, 25 bp, Homo sapien
cccagtaccttgatatgtgactgta

SEQ ID NO: 661020 - DNA, 25 bp, Homo sapien
gtaaattatcttgttagggccctca

SEQ ID NO: 661021 - DNA, 25 bp, Homo sapien
attatcttgttagggccctcagggt

SEQ ID NO: 661022 - DNA, 25 bp, Homo sapien
cagggtcggtccctaatccaatatg

SEQ ID NO: 661023 - DNA, 25 bp, Homo sapien
tcaggaatgcgggtgcacagagaaa

SEQ ID NO: 661024 - DNA, 25 bp, Homo sapien
atctgcaaggcaagaagcggcctca

SEQ ID NO: 661025 - DNA, 25 bp, Homo sapien
aggactgctgacatctgcatcttga

SEQ ID NO: 661026 - DNA, 25 bp, Homo sapien
gactgctgacatctgcatcttgaac

SEQ ID NO: 661027 - DNA, 25 bp, Homo sapien
ctgacatctgcatcttgaacttcca

SEQ ID NO: 661028 - DNA, 25 bp, Homo sapien
ggcaggaaaatagatctaacacagg

SEQ ID NO: 661029 - DNA, 25 bp, Homo sapien
agatgttgcaatgaggtgagatcag

SEQ ID NO: 661030 - DNA, 25 bp, Homo sapien
ttcttccataacatgctgtatacct

SEQ ID NO: 661031 - DNA, 25 bp, Homo sapien
taacatgctgtatacctcaaagaat

SEQ ID NO: 661032 - DNA, 25 bp, Homo sapien
acctcaaagaatactgccactaatt

SEQ ID NO: 661033 - DNA, 25 bp, Homo sapien
gccactaatttgactacagcttctg

SEQ ID NO: 661034 - DNA, 25 bp, Homo sapien
atttgactacagcttctggtgcatt

SEQ ID NO: 661035 - DNA, 25 bp, Homo sapien
gactacagcttctggtgcattacta

SEQ ID NO: 661036 - DNA, 25 bp, Homo sapien
acagcttctggtgcattactagtga

SEQ ID NO: 661037 - DNA, 25 bp, Homo sapien
gcttctggtgcattactagtgaata

SEQ ID NO: 661038 - DNA, 25 bp, Homo sapien
gtgcattactagtgaataaactcca

SEQ ID NO: 661039 - DNA, 25 bp, Homo sapien
tatactgactttatatcctgtgacc

SEQ ID NO: 661040 - DNA, 25 bp, Homo sapien
tcctgtgaccttgctaaacttgtat

SEQ ID NO: 661041 - DNA, 25 bp, Homo sapien
tgttaaactccttgagattttctac

SEQ ID NO: 661042 - DNA, 25 bp, Homo sapien
ctttcttttcaaactgtatggatct

SEQ ID NO: 661043 - DNA, 25 bp, Homo sapien
ttgcactggctaggaccaccagcat

SEQ ID NO: 661044 - DNA, 25 bp, Homo sapien
ggctaggaccaccagcataatctga

SEQ ID NO: 661045 - DNA, 25 bp, Homo sapien
ggaccaccagcataatctgactaga

SEQ ID NO: 661046 - DNA, 25 bp, Homo sapien
ctagaagtgatgaccttgttcccaa

SEQ ID NO: 661047 - DNA, 25 bp, Homo sapien
tgttcccaaccttagggtaaagcat

SEQ ID NO: 661048 - DNA, 25 bp, Homo sapien
aagcattcagtatttcaccattaaa

SEQ ID NO: 661049 - DNA, 25 bp, Homo sapien
atctgatgttaactgtaggcttttg

SEQ ID NO: 661050 - DNA, 25 bp, Homo sapien
taatcttattttaagccttggcttg

SEQ ID NO: 661051 - DNA, 25 bp, Homo sapien
cttattttaagccttggcttgggat

SEQ ID NO: 661052 - DNA, 25 bp, Homo sapien
tgcctccctaaaataggatagtgca

SEQ ID NO: 661053 - DNA, 25 bp, Homo sapien
taaaataggatagtgcacattgcat

SEQ ID NO: 661054 - DNA, 25 bp, Homo sapien
gatagtgcacattgcataaaatgac

SEQ ID NO: 661055 - DNA, 25 bp, Homo sapien
cataaaagcctgatacttaagtagt

SEQ ID NO: 661056 - DNA, 25 bp, Homo sapien
cttaagtagtttgaatctggtgatt

SEQ ID NO: 661057 - DNA, 25 bp, Homo sapien
tagtttgaatctggtgatttattcc

SEQ ID NO: 661058 - DNA, 25 bp, Homo sapien
gtgatttattccatgacttaaccta

SEQ ID NO: 661059 - DNA, 25 bp, Homo sapien
gatttattccatgacttaacctatt

SEQ ID NO: 661060 - DNA, 25 bp, Homo sapien
gacttaacctattcatatttgtata

SEQ ID NO: 661061 - DNA, 25 bp, Homo sapien
aaatcaagcaggatgtggatacaga

SEQ ID NO: 661062 - DNA, 25 bp, Homo sapien
gtggatacagagactgatggcaaca

SEQ ID NO: 661063 - DNA, 25 bp, Homo sapien
atacagagactgatggcaacaaaat

SEQ ID NO: 661064 - DNA, 25 bp, Homo sapien
agactgatggcaacaaaatgctggg

SEQ ID NO: 661065 - DNA, 25 bp, Homo sapien
tgtcctcagtggcaaaggtcacatt

SEQ ID NO: 661066 - DNA, 25 bp, Homo sapien
tcctcagtggcaaaggtcacattga

SEQ ID NO: 661067 - DNA, 25 bp, Homo sapien
ggtcacattgagcagagacctgtga

SEQ ID NO: 661068 - DNA, 25 bp, Homo sapien
ttgagcagagacctgtgacaagaga

SEQ ID NO: 661069 - DNA, 25 bp, Homo sapien
aggatacttggagtagtagttgcaa

SEQ ID NO: 661070 - DNA, 25 bp, Homo sapien
agtagtagttgcaaaggcttacagc

SEQ ID NO: 661071 - DNA, 25 bp, Homo sapien
agtagttgcaaaggcttacagcagg

SEQ ID NO: 661072 - DNA, 25 bp, Homo sapien
gtactttgttttcttggaagatgaa

SEQ ID NO: 661073 - DNA, 25 bp, Homo sapien
gaaagaagtcaccttacttcctcca

SEQ ID NO: 661074 - DNA, 25 bp, Homo sapien
ttacttcctccaatccagtcatatc

SEQ ID NO: 661075 - DNA, 25 bp, Homo sapien
agtcatatccctgaacccaatcatg

SEQ ID NO: 661076 - DNA, 25 bp, Homo sapien
aacccaatcatgaccagcagaggtt

SEQ ID NO: 661077 - DNA, 25 bp, Homo sapien
taatcccttatacctcgtattatgt

SEQ ID NO: 661078 - DNA, 25 bp, Homo sapien
acctcgtattatgtagacccctgtg

SEQ ID NO: 661079 - DNA, 25 bp, Homo sapien
tgtagacccctgtgtttccaagtta

SEQ ID NO: 661080 - DNA, 25 bp, Homo sapien
tgtgtttccaagttacctttgtaat

SEQ ID NO: 661081 - DNA, 25 bp, Homo sapien
gtaatttaggtaagtgagcacgaaa

SEQ ID NO: 661082 - DNA, 25 bp, Homo sapien
agttaccaggtaagttcaaatatag

SEQ ID NO: 661083 - DNA, 25 bp, Homo sapien
ttcgagaccccggtttgcagagcgc

SEQ ID NO: 661084 - DNA, 25 bp, Homo sapien
agaccccggtttgcagagcgcaaga

SEQ ID NO: 661085 - DNA, 25 bp, Homo sapien
cccggtttgcagagcgcaagactga

SEQ ID NO: 661086 - DNA, 25 bp, Homo sapien
tgcagagcgcaagactgaggcccag

SEQ ID NO: 661087 - DNA, 25 bp, Homo sapien
gcagtcaggcaggaaacggcgctcc

SEQ ID NO: 661088 - DNA, 25 bp, Homo sapien
aaacggcgctcctggcggatggaac

SEQ ID NO: 661089 - DNA, 25 bp, Homo sapien
gcgctcctggcggatggaacagcac

SEQ ID NO: 661090 - DNA, 25 bp, Homo sapien
tggcggatggaacagcacgggcaaa

SEQ ID NO: 661091 - DNA, 25 bp, Homo sapien
ggctgactgcagacttgaactcgtg

SEQ ID NO: 661092 - DNA, 25 bp, Homo sapien
gactgcagacttgaactcgtggatg

SEQ ID NO: 661093 - DNA, 25 bp, Homo sapien
cttgaactcgtggatgcaagccatt

SEQ ID NO: 661094 - DNA, 25 bp, Homo sapien
gttggtgagtggtcagaagcccagt

SEQ ID NO: 661095 - DNA, 25 bp, Homo sapien
gggcctttgagtaggtcttatggac

SEQ ID NO: 661096 - DNA, 25 bp, Homo sapien
taggtcttatggacggaaggagcat

SEQ ID NO: 661097 - DNA, 25 bp, Homo sapien
acctggaagaagtgagtctcctctc

SEQ ID NO: 661098 - DNA, 25 bp, Homo sapien
aagaagtgagtctcctctcagatcc

SEQ ID NO: 661099 - DNA, 25 bp, Homo sapien
aagtgagtctcctctcagatcctgg

SEQ ID NO: 661100 - DNA, 25 bp, Homo sapien
gggccttgtgatgggctttctccca

SEQ ID NO: 661101 - DNA, 25 bp, Homo sapien
cctgccaagggctgaaatggcctca

SEQ ID NO: 661102 - DNA, 25 bp, Homo sapien
tgaaatggcctcagctgtttctcca

SEQ ID NO: 661103 - DNA, 25 bp, Homo sapien
tgtttctccagactccctttgatgt

SEQ ID NO: 661104 - DNA, 25 bp, Homo sapien
tctccagactccctttgatgttaaa

SEQ ID NO: 661105 - DNA, 25 bp, Homo sapien
tgcaatcacagctcatggctcatta

SEQ ID NO: 661106 - DNA, 25 bp, Homo sapien
gcaatcacagctcatggctcattac

SEQ ID NO: 661107 - DNA, 25 bp, Homo sapien
atcacagctcatggctcattacagc

SEQ ID NO: 661108 - DNA, 25 bp, Homo sapien
ttgacttctggggtctggtgatccc

SEQ ID NO: 661109 - DNA, 25 bp, Homo sapien
caagtgactcacctgccttgtcttc

SEQ ID NO: 661110 - DNA, 25 bp, Homo sapien
acaggcctgacccactgtggccggc

SEQ ID NO: 661111 - DNA, 25 bp, Homo sapien
tgtggccggcctatccctgataact

SEQ ID NO: 661112 - DNA, 25 bp, Homo sapien
tggccggcctatccctgataacttt

SEQ ID NO: 661113 - DNA, 25 bp, Homo sapien
gccggcctatccctgataacttttc

SEQ ID NO: 661114 - DNA, 25 bp, Homo sapien
tccctgataacttttccttcattga

SEQ ID NO: 661115 - DNA, 25 bp, Homo sapien
ccctgataacttttccttcattgaa

SEQ ID NO: 661116 - DNA, 25 bp, Homo sapien
ggctcagtagtgattatccctcttt

SEQ ID NO: 661117 - DNA, 25 bp, Homo sapien
ataaatgtcatctctcctttgttct

SEQ ID NO: 661118 - DNA, 25 bp, Homo sapien
tcctttgttcttgattagcctggct

SEQ ID NO: 661119 - DNA, 25 bp, Homo sapien
ttagcctggctataagttcatcact

SEQ ID NO: 661120 - DNA, 25 bp, Homo sapien
gatatagacctttgctgactatcta

SEQ ID NO: 661121 - DNA, 25 bp, Homo sapien
gactatctatttatgctcgtgtgag

SEQ ID NO: 661122 - DNA, 25 bp, Homo sapien
tgctcgtgtgagttttggtagttta

SEQ ID NO: 661123 - DNA, 25 bp, Homo sapien
gagttttggtagtttatgtctttca

SEQ ID NO: 661124 - DNA, 25 bp, Homo sapien
gtctttcaagaaatttgtcccattt

SEQ ID NO: 661125 - DNA, 25 bp, Homo sapien
agaaatttgtcccatttatctaagt

SEQ ID NO: 661126 - DNA, 25 bp, Homo sapien
tctcatgtctttgggctcagtagtg

SEQ ID NO: 661127 - DNA, 25 bp, Homo sapien
ttttcccttaatgtttcatatcaaa

SEQ ID NO: 661128 - DNA, 25 bp, Homo sapien
aaatggaagccatgtttttcatcat

SEQ ID NO: 661129 - DNA, 25 bp, Homo sapien
atcatttcattcaagacataaaacc

SEQ ID NO: 661130 - DNA, 25 bp, Homo sapien
ggaggaaatgaggaattgtcgttta

SEQ ID NO: 661131 - DNA, 25 bp, Homo sapien
gaggaattgtcgtttagtggatata

SEQ ID NO: 661132 - DNA, 25 bp, Homo sapien
tgtcgtttagtggatatagagtttt

SEQ ID NO: 661133 - DNA, 25 bp, Homo sapien
cacaacagtgtgaaagtatttagca

SEQ ID NO: 661134 - DNA, 25 bp, Homo sapien
gtatttagcactcctaaactgtgca

SEQ ID NO: 661135 - DNA, 25 bp, Homo sapien
tttagcactcctaaactgtgcactt

SEQ ID NO: 661136 - DNA, 25 bp, Homo sapien
actcctaaactgtgcacttcaaatg

SEQ ID NO: 661137 - DNA, 25 bp, Homo sapien
tcctaaactgtgcacttcaaatggt

SEQ ID NO: 661138 - DNA, 25 bp, Homo sapien
aactgggtgccagtttgtcccaact

SEQ ID NO: 661139 - DNA, 25 bp, Homo sapien
gtttgtcccaactaattctgtgcta

SEQ ID NO: 661140 - DNA, 25 bp, Homo sapien
gctatgttggataattgcctgctat

SEQ ID NO: 661141 - DNA, 25 bp, Homo sapien
tccactaaaagtccactttggagtg

SEQ ID NO: 661142 - DNA, 25 bp, Homo sapien
tggagtgttttgaagaaccacgacc

SEQ ID NO: 661143 - DNA, 25 bp, Homo sapien
gaaccacgaccagaggtaaacaagt

SEQ ID NO: 661144 - DNA, 25 bp, Homo sapien
gtaaacaagtatagctagaacctct

SEQ ID NO: 661145 - DNA, 25 bp, Homo sapien
gctagaacctctacatgcacttgat

SEQ ID NO: 661146 - DNA, 25 bp, Homo sapien
atgcacttgatcaccccaagagttg

SEQ ID NO: 661147 - DNA, 25 bp, Homo sapien
gatcaccccaagagttgccacacag

SEQ ID NO: 661148 - DNA, 25 bp, Homo sapien
acacagaccttcttgcctcatcatt

SEQ ID NO: 661149 - DNA, 25 bp, Homo sapien
gggcacgtgctatttctgtgactga

SEQ ID NO: 661150 - DNA, 25 bp, Homo sapien
tttctgtgactgaagccactagcta

SEQ ID NO: 661151 - DNA, 25 bp, Homo sapien
gtgactgaagccactagctacattg

SEQ ID NO: 661152 - DNA, 25 bp, Homo sapien
aagccactagctacattgatgacct

SEQ ID NO: 661153 - DNA, 25 bp, Homo sapien
gccactagctacattgatgacctct

SEQ ID NO: 661154 - DNA, 25 bp, Homo sapien
actagctacattgatgacctctttt

SEQ ID NO: 661155 - DNA, 25 bp, Homo sapien
gctacattgatgacctctttttacg

SEQ ID NO: 661156 - DNA, 25 bp, Homo sapien
aacatttcagtgtgtgtctgagaga

SEQ ID NO: 661157 - DNA, 25 bp, Homo sapien
ttcagtgtgtgtctgagagatcatt

SEQ ID NO: 661158 - DNA, 25 bp, Homo sapien
atccccctcgcattaaaatatcatc

SEQ ID NO: 661159 - DNA, 25 bp, Homo sapien
tatcatcacattcttttacaaacgg

SEQ ID NO: 661160 - DNA, 25 bp, Homo sapien
attccataagatacccaaacaactt

SEQ ID NO: 661161 - DNA, 25 bp, Homo sapien
gatacccaaacaacttctgaaagag

SEQ ID NO: 661162 - DNA, 25 bp, Homo sapien
aaaaagtctttgtctcagtttctgc

SEQ ID NO: 661163 - DNA, 25 bp, Homo sapien
aaagtctttgtctcagtttctgctc

SEQ ID NO: 661164 - DNA, 25 bp, Homo sapien
tctttgtctcagtttctgctctcca

SEQ ID NO: 661165 - DNA, 25 bp, Homo sapien
ccaaagaggtaaggaacccagtgag

SEQ ID NO: 661166 - DNA, 25 bp, Homo sapien
gaaacagatcctaaacctgttttgt

SEQ ID NO: 661167 - DNA, 25 bp, Homo sapien
ttgaaaacattcaaaccacctgtat

SEQ ID NO: 661168 - DNA, 25 bp, Homo sapien
aaacattcaaaccacctgtattggt

SEQ ID NO: 661169 - DNA, 25 bp, Homo sapien
aaaccacctgtattggtggctgtta

SEQ ID NO: 661170 - DNA, 25 bp, Homo sapien
cacctgtattggtggctgttattat

SEQ ID NO: 661171 - DNA, 25 bp, Homo sapien
gagggagtttagctcattggttaaa

SEQ ID NO: 661172 - DNA, 25 bp, Homo sapien
tggcctgtttatttaccccgtatgt

SEQ ID NO: 661173 - DNA, 25 bp, Homo sapien
tatttaccccgtatgtcactttcct

SEQ ID NO: 661174 - DNA, 25 bp, Homo sapien
cactttcctttatctgtaactggaa

SEQ ID NO: 661175 - DNA, 25 bp, Homo sapien
cgaagagcttaatacaatgactgat

SEQ ID NO: 661176 - DNA, 25 bp, Homo sapien
gactgatacacagtgagttctccat

SEQ ID NO: 661177 - DNA, 25 bp, Homo sapien
gtgagttctccataaatgttagtta

SEQ ID NO: 661178 - DNA, 25 bp, Homo sapien
gtgggtttatatttcagcgtcctga

SEQ ID NO: 661179 - DNA, 25 bp, Homo sapien
agcgtcctgagaaacactcatcctg

SEQ ID NO: 661180 - DNA, 25 bp, Homo sapien
gaaacactcatcctgaacaatggga

SEQ ID NO: 661181 - DNA, 25 bp, Homo sapien
aatgggaacattggccacatccgcc

SEQ ID NO: 661182 - DNA, 25 bp, Homo sapien
gataacttggatgctagatatttgc

SEQ ID NO: 661183 - DNA, 25 bp, Homo sapien
tagatatttgcataccagccagtgt

SEQ ID NO: 661184 - DNA, 25 bp, Homo sapien
ttgcataccagccagtgttgtccag

SEQ ID NO: 661185 - DNA, 25 bp, Homo sapien
agtgttgtccagcactttcgttcaa

SEQ ID NO: 661186 - DNA, 25 bp, Homo sapien
agcactttcgttcaactctttgaca

SEQ ID NO: 661187 - DNA, 25 bp, Homo sapien
gacaactatcgtcacattcctatac

SEQ ID NO: 661188 - DNA, 25 bp, Homo sapien
cattcctatactgcttgtgctatca

SEQ ID NO: 661189 - DNA, 25 bp, Homo sapien
tactgcttgtgctatcatttgatta

SEQ ID NO: 661190 - DNA, 25 bp, Homo sapien
atttgtctcaacttttagcttgtgt

SEQ ID NO: 661191 - DNA, 25 bp, Homo sapien
ggaagcatttgcatctctaccataa

SEQ ID NO: 661192 - DNA, 25 bp, Homo sapien
gaaataatgttattcccctaagaat

SEQ ID NO: 661193 - DNA, 25 bp, Homo sapien
taaagccttagctaattccaacaaa

SEQ ID NO: 661194 - DNA, 25 bp, Homo sapien
aagccttagctaattccaacaaaat

SEQ ID NO: 661195 - DNA, 25 bp, Homo sapien
gccttagctaattccaacaaaatat

SEQ ID NO: 661196 - DNA, 25 bp, Homo sapien
acaaaatattgattactgtgggaga

SEQ ID NO: 661197 - DNA, 25 bp, Homo sapien
gagagtggtaaatcttattttgtac

SEQ ID NO: 661198 - DNA, 25 bp, Homo sapien
gagtggtaaatcttattttgtacct

SEQ ID NO: 661199 - DNA, 25 bp, Homo sapien
aatataagtgagatgcttgctataa

SEQ ID NO: 661200 - DNA, 25 bp, Homo sapien
taagtgagatgcttgctataagttt

SEQ ID NO: 661201 - DNA, 25 bp, Homo sapien
aaagtattgttttgcatctaatgtt

SEQ ID NO: 661202 - DNA, 25 bp, Homo sapien
gtattgttttgcatctaatgttaaa

SEQ ID NO: 661203 - DNA, 25 bp, Homo sapien
taaaatgcttctaagtattagtact

SEQ ID NO: 661204 - DNA, 25 bp, Homo sapien
ttacaagttaaagtgctgcagcata

SEQ ID NO: 661205 - DNA, 25 bp, Homo sapien
aataatcatttatgccattttcaat

SEQ ID NO: 661206 - DNA, 25 bp, Homo sapien
tcaaaaccctttacacttggaatat

SEQ ID NO: 661207 - DNA, 25 bp, Homo sapien
acacttggaatattgtcaaatctca

SEQ ID NO: 661208 - DNA, 25 bp, Homo sapien
aatttttaccttgctgagatctacg

SEQ ID NO: 661209 - DNA, 25 bp, Homo sapien
tgagatctacgaccaccttttgaaa

SEQ ID NO: 661210 - DNA, 25 bp, Homo sapien
gaccaccttttgaaactgagacagt

SEQ ID NO: 661211 - DNA, 25 bp, Homo sapien
gacagtgtaggtatgattactccct

SEQ ID NO: 661212 - DNA, 25 bp, Homo sapien
gattactccctgtatactcaagggt

SEQ ID NO: 661213 - DNA, 25 bp, Homo sapien
tggaaaagaaccgtgagcccctcaa

SEQ ID NO: 661214 - DNA, 25 bp, Homo sapien
gtgagcccctcaagaatggtggctt

SEQ ID NO: 661215 - DNA, 25 bp, Homo sapien
aatacaatgcggaagattttctttc

SEQ ID NO: 661216 - DNA, 25 bp, Homo sapien
ggaatccatccattcccggcgtgtt

SEQ ID NO: 661217 - DNA, 25 bp, Homo sapien
gggttaatgtttgccttatgaccaa

SEQ ID NO: 661218 - DNA, 25 bp, Homo sapien
gtttgccttatgaccaagtctctgt

SEQ ID NO: 661219 - DNA, 25 bp, Homo sapien
tatgaccaagtctctgtgtccgtgc

SEQ ID NO: 661220 - DNA, 25 bp, Homo sapien
tgtgtccgtgcctctctccattttc

SEQ ID NO: 661221 - DNA, 25 bp, Homo sapien
caacttagaaaacggctgtagcgga

SEQ ID NO: 661222 - DNA, 25 bp, Homo sapien
ctgctttgttctcccgccaaaggag

SEQ ID NO: 661223 - DNA, 25 bp, Homo sapien
gttctcccgccaaaggagccaaaag

SEQ ID NO: 661224 - DNA, 25 bp, Homo sapien
aaaagggacaaactgctgcgctctg

SEQ ID NO: 661225 - DNA, 25 bp, Homo sapien
ggacaaactgctgcgctctgggatg

SEQ ID NO: 661226 - DNA, 25 bp, Homo sapien
ggcatgattcatgtcattttagggt

SEQ ID NO: 661227 - DNA, 25 bp, Homo sapien
attcatgtcattttagggtacctag

SEQ ID NO: 661228 - DNA, 25 bp, Homo sapien
gggtacctagataattaagtctcag

SEQ ID NO: 661229 - DNA, 25 bp, Homo sapien
aagtctcagggctagacgtattcca

SEQ ID NO: 661230 - DNA, 25 bp, Homo sapien
tcagggctagacgtattccaaatat

SEQ ID NO: 661231 - DNA, 25 bp, Homo sapien
ggctagacgtattccaaatatttgg

SEQ ID NO: 661232 - DNA, 25 bp, Homo sapien
caaagtaatttgcacagacatagta

SEQ ID NO: 661233 - DNA, 25 bp, Homo sapien
gtgtttttgtacttataagcttgtg

SEQ ID NO: 661234 - DNA, 25 bp, Homo sapien
gtacttataagcttgtgaactaaca

SEQ ID NO: 661235 - DNA, 25 bp, Homo sapien
aagcttgtgaactaacaaaccataa

SEQ ID NO: 661236 - DNA, 25 bp, Homo sapien
tgaaaatatactgcactgagctctg

SEQ ID NO: 661237 - DNA, 25 bp, Homo sapien
gggcccttggcacttactgttgtgt

SEQ ID NO: 661238 - DNA, 25 bp, Homo sapien
cacttactgttgtgttcttggcctt

SEQ ID NO: 661239 - DNA, 25 bp, Homo sapien
ttactgttgtgttcttggcctttgg

SEQ ID NO: 661240 - DNA, 25 bp, Homo sapien
gccttggccaagagtcaggtggaaa

SEQ ID NO: 661241 - DNA, 25 bp, Homo sapien
ggaaagagttccaccctaacatctt

SEQ ID NO: 661242 - DNA, 25 bp, Homo sapien
aagagttccaccctaacatcttctc

SEQ ID NO: 661243 - DNA, 25 bp, Homo sapien
aggctccttagggaattacttcatg

SEQ ID NO: 661244 - DNA, 25 bp, Homo sapien
aaatatttactaggcacttaacacg

SEQ ID NO: 661245 - DNA, 25 bp, Homo sapien
actaggcacttaacacgtacgcaga

SEQ ID NO: 661246 - DNA, 25 bp, Homo sapien
cgtacgcagaaatttaccagtggct

SEQ ID NO: 661247 - DNA, 25 bp, Homo sapien
aagtgggtaatagggatgtatcaat

SEQ ID NO: 661248 - DNA, 25 bp, Homo sapien
tttccctacttgtagaagggagttg

SEQ ID NO: 661249 - DNA, 25 bp, Homo sapien
ttccctacttgtagaagggagttgc

SEQ ID NO: 661250 - DNA, 25 bp, Homo sapien
cctacttgtagaagggagttgctac

SEQ ID NO: 661251 - DNA, 25 bp, Homo sapien
ctacttgtagaagggagttgctacc

SEQ ID NO: 661252 - DNA, 25 bp, Homo sapien
acttgtagaagggagttgctaccct

SEQ ID NO: 661253 - DNA, 25 bp, Homo sapien
cttgtagaagggagttgctaccctt

SEQ ID NO: 661254 - DNA, 25 bp, Homo sapien
ttgtagaagggagttgctaccctta

SEQ ID NO: 661255 - DNA, 25 bp, Homo sapien
tgtagaagggagttgctacccttag

SEQ ID NO: 661256 - DNA, 25 bp, Homo sapien
gtagaagggagttgctacccttagt

SEQ ID NO: 661257 - DNA, 25 bp, Homo sapien
tagaagggagttgctacccttagta

SEQ ID NO: 661258 - DNA, 25 bp, Homo sapien
agaagggagttgctacccttagtag

SEQ ID NO: 661259 - DNA, 25 bp, Homo sapien
atatccttcaatttggatgtgtctg

SEQ ID NO: 661260 - DNA, 25 bp, Homo sapien
gatgtgtctgtttcctcaagattag

SEQ ID NO: 661261 - DNA, 25 bp, Homo sapien
gaaattacatgaacttcttggctaa

SEQ ID NO: 661262 - DNA, 25 bp, Homo sapien
aacttcttggctaacttctccattt

SEQ ID NO: 661263 - DNA, 25 bp, Homo sapien
atatattactctttcccatgtcctg

SEQ ID NO: 661264 - DNA, 25 bp, Homo sapien
agattttgtttggatgcagtgtgat

SEQ ID NO: 661265 - DNA, 25 bp, Homo sapien
gatgcagtgtgatttggacttaggt

SEQ ID NO: 661266 - DNA, 25 bp, Homo sapien
cttaggtgtgtgtatctgaacttca

SEQ ID NO: 661267 - DNA, 25 bp, Homo sapien
ctgaacttcatcctttgtcatcaaa

SEQ ID NO: 661268 - DNA, 25 bp, Homo sapien
atgtagcttaagaaatccaggcact

SEQ ID NO: 661269 - DNA, 25 bp, Homo sapien
atccaggcacttgagagccactgta

SEQ ID NO: 661270 - DNA, 25 bp, Homo sapien
aggtgtgtggatatacaggcatact

SEQ ID NO: 661271 - DNA, 25 bp, Homo sapien
acaggcatacttagttttacatttt

SEQ ID NO: 661272 - DNA, 25 bp, Homo sapien
gtaagaagttgtccataccccttga

SEQ ID NO: 661273 - DNA, 25 bp, Homo sapien
aagttgtccataccccttgattcaa

SEQ ID NO: 661274 - DNA, 25 bp, Homo sapien
ccataccccttgattcaacaactta

SEQ ID NO: 661275 - DNA, 25 bp, Homo sapien
gattcaacaacttagcttcttggaa

SEQ ID NO: 661276 - DNA, 25 bp, Homo sapien
caacttagcttcttggaattatcca

SEQ ID NO: 661277 - DNA, 25 bp, Homo sapien
ggaattatccatatagaaatgctta

SEQ ID NO: 661278 - DNA, 25 bp, Homo sapien
gaacgtatgtacaaagaagcactat

SEQ ID NO: 661279 - DNA, 25 bp, Homo sapien
attgggaaactttaatgcctaacat

SEQ ID NO: 661280 - DNA, 25 bp, Homo sapien
aactttaatgcctaacatttggaat

SEQ ID NO: 661281 - DNA, 25 bp, Homo sapien
gggcatctcatctttgggtcataga

SEQ ID NO: 661282 - DNA, 25 bp, Homo sapien
ggcatctcatctttgggtcatagaa

SEQ ID NO: 661283 - DNA, 25 bp, Homo sapien
gcatctcatctttgggtcatagaag

SEQ ID NO: 661284 - DNA, 25 bp, Homo sapien
catctcatctttgggtcatagaagc

SEQ ID NO: 661285 - DNA, 25 bp, Homo sapien
tctcatctttgggtcatagaagcta

SEQ ID NO: 661286 - DNA, 25 bp, Homo sapien
ctcatctttgggtcatagaagctat

SEQ ID NO: 661287 - DNA, 25 bp, Homo sapien
catctttgggtcatagaagctattg

SEQ ID NO: 661288 - DNA, 25 bp, Homo sapien
ctttgggtcatagaagctattggca

SEQ ID NO: 661289 - DNA, 25 bp, Homo sapien
ggtcatagaagctattggcaggttt

SEQ ID NO: 661290 - DNA, 25 bp, Homo sapien
catagaagctattggcaggtttatt

SEQ ID NO: 661291 - DNA, 25 bp, Homo sapien
agctattggcaggtttatttattta

SEQ ID NO: 661292 - DNA, 25 bp, Homo sapien
gatggcgctggagaacacaggcttc

SEQ ID NO: 661293 - DNA, 25 bp, Homo sapien
ctggagaacacaggcttcgctaggg

SEQ ID NO: 661294 - DNA, 25 bp, Homo sapien
gctttgcatctttaaggaggcagcc

SEQ ID NO: 661295 - DNA, 25 bp, Homo sapien
gaggcagcctggtgtagtcagatat

SEQ ID NO: 661296 - DNA, 25 bp, Homo sapien
tggtgtagtcagatatccccgcatc

SEQ ID NO: 661297 - DNA, 25 bp, Homo sapien
cgcatccgagtcttagttttaccac

SEQ ID NO: 661298 - DNA, 25 bp, Homo sapien
cgagtcttagttttaccactgacag

SEQ ID NO: 661299 - DNA, 25 bp, Homo sapien
aacttcaagcttttttcctcatctg

SEQ ID NO: 661300 - DNA, 25 bp, Homo sapien
aaaatcctaatttgtggtggtgtca

SEQ ID NO: 661301 - DNA, 25 bp, Homo sapien
ggtggtgtcatgaaaattaaggcta

SEQ ID NO: 661302 - DNA, 25 bp, Homo sapien
tatttagtacagtactcagcacaga

SEQ ID NO: 661303 - DNA, 25 bp, Homo sapien
ggataatttatcttgcgagcaactg

SEQ ID NO: 661304 - DNA, 25 bp, Homo sapien
gcgagcaactgttcagggcaggaat

SEQ ID NO: 661305 - DNA, 25 bp, Homo sapien
atagctcagatcatgcaaatacttg

SEQ ID NO: 661306 - DNA, 25 bp, Homo sapien
aaatacttgcccacaactggactcg

SEQ ID NO: 661307 - DNA, 25 bp, Homo sapien
actggactcgtactctgagactctt

SEQ ID NO: 661308 - DNA, 25 bp, Homo sapien
tgagactctttgtgctaccctacac

SEQ ID NO: 661309 - DNA, 25 bp, Homo sapien
gggctagagcccaatctttagttat

SEQ ID NO: 661310 - DNA, 25 bp, Homo sapien
gttattcatcaccttacctgttttg

SEQ ID NO: 661311 - DNA, 25 bp, Homo sapien
gaataaatagcaccatctttgagaa

SEQ ID NO: 661312 - DNA, 25 bp, Homo sapien
ttgagaaatccaggttatggccctc

SEQ ID NO: 661313 - DNA, 25 bp, Homo sapien
tcattaccccgacccgcaaagttgg

SEQ ID NO: 661314 - DNA, 25 bp, Homo sapien
ttttctatatgcctgctgcaatgca

SEQ ID NO: 661315 - DNA, 25 bp, Homo sapien
gctgcaatgcatatcttttcctgtt

SEQ ID NO: 661316 - DNA, 25 bp, Homo sapien
aatgcatatcttttcctgttactta

SEQ ID NO: 661317 - DNA, 25 bp, Homo sapien
tcctgttacttattttccttgaact

SEQ ID NO: 661318 - DNA, 25 bp, Homo sapien
attttccttgaactcatggattaga

SEQ ID NO: 661319 - DNA, 25 bp, Homo sapien
catggattagagtttctcttctata

SEQ ID NO: 661320 - DNA, 25 bp, Homo sapien
tcaccttcaattaacttgtttggct

SEQ ID NO: 661321 - DNA, 25 bp, Homo sapien
caaaacctttggaattcttgcacat

SEQ ID NO: 661322 - DNA, 25 bp, Homo sapien
cttgcacatgcaaaactgttactat

SEQ ID NO: 661323 - DNA, 25 bp, Homo sapien
aaaactgttactatgatgctctcac

SEQ ID NO: 661324 - DNA, 25 bp, Homo sapien
actatgatgctctcacatatgtttg

SEQ ID NO: 661325 - DNA, 25 bp, Homo sapien
aatgtttactaagcaatttagattt

SEQ ID NO: 661326 - DNA, 25 bp, Homo sapien
ttactaagcaatttagatttttcat

SEQ ID NO: 661327 - DNA, 25 bp, Homo sapien
gatttttcatcataagattacatag

SEQ ID NO: 661328 - DNA, 25 bp, Homo sapien
tcatcataagattacatagcaaacg

SEQ ID NO: 661329 - DNA, 25 bp, Homo sapien
atcataagattacatagcaaacgac

SEQ ID NO: 661330 - DNA, 25 bp, Homo sapien
tcataagattacatagcaaacgact

SEQ ID NO: 661331 - DNA, 25 bp, Homo sapien
cataagattacatagcaaacgactg

SEQ ID NO: 661332 - DNA, 25 bp, Homo sapien
ataagattacatagcaaacgactgt

SEQ ID NO: 661333 - DNA, 25 bp, Homo sapien
taagattacatagcaaacgactgta

SEQ ID NO: 661334 - DNA, 25 bp, Homo sapien
aagattacatagcaaacgactgtaa

SEQ ID NO: 661335 - DNA, 25 bp, Homo sapien
tacatagcaaacgactgtaatccca

SEQ ID NO: 661336 - DNA, 25 bp, Homo sapien
atagatgcatcttaagacaagaaag

SEQ ID NO: 661337 - DNA, 25 bp, Homo sapien
aaaacaaacgttaatatgctgtact

SEQ ID NO: 661338 - DNA, 25 bp, Homo sapien
cagaacaaaccttaccagtggcttt

SEQ ID NO: 661339 - DNA, 25 bp, Homo sapien
caaaccttaccagtggctttagagg

SEQ ID NO: 661340 - DNA, 25 bp, Homo sapien
agcaatcacaggtcaaagaaggaaa

SEQ ID NO: 661341 - DNA, 25 bp, Homo sapien
caactatcagaaaatgtatgtcata

SEQ ID NO: 661342 - DNA, 25 bp, Homo sapien
tgtcatagtacatcttctgctgctg

SEQ ID NO: 661343 - DNA, 25 bp, Homo sapien
gctgctgctgacagattaaccaaag

SEQ ID NO: 661344 - DNA, 25 bp, Homo sapien
gctgctgacagattaaccaaagaaa

SEQ ID NO: 661345 - DNA, 25 bp, Homo sapien
attgggaaaacgtatcctcagcaaa

SEQ ID NO: 661346 - DNA, 25 bp, Homo sapien
tatcctcagcaaatttcccaagaaa

SEQ ID NO: 661347 - DNA, 25 bp, Homo sapien
ggaacagcgagagcacggcaaccca

SEQ ID NO: 661348 - DNA, 25 bp, Homo sapien
agggcctcatcctgctgaagagccc

SEQ ID NO: 661349 - DNA, 25 bp, Homo sapien
gagaagctggcctgagactgctgac

SEQ ID NO: 661350 - DNA, 25 bp, Homo sapien
tgagactgctgaccgcatcttcttc

SEQ ID NO: 661351 - DNA, 25 bp, Homo sapien
gcatcttcttcctcgtgtatgtggt

SEQ ID NO: 661352 - DNA, 25 bp, Homo sapien
gtgctgtgcacccaattcgtctttg

SEQ ID NO: 661353 - DNA, 25 bp, Homo sapien
gcacccaattcgtctttgcaggaat

SEQ ID NO: 661354 - DNA, 25 bp, Homo sapien
attcgtctttgcaggaatctggatg

SEQ ID NO: 661355 - DNA, 25 bp, Homo sapien
gatgtgggcagcgtgcaagtctgac

SEQ ID NO: 661356 - DNA, 25 bp, Homo sapien
aagtctgacgcagcccctggagagg

SEQ ID NO: 661357 - DNA, 25 bp, Homo sapien
tgcaccccatggcaggcggcctaga

SEQ ID NO: 661358 - DNA, 25 bp, Homo sapien
tttcctccacagttcagagtcttct

SEQ ID NO: 661359 - DNA, 25 bp, Homo sapien
cagaaacagaagtccctgagccgtt

SEQ ID NO: 661360 - DNA, 25 bp, Homo sapien
cagaagtccctgagccgttgttttt

SEQ ID NO: 661361 - DNA, 25 bp, Homo sapien
ttttaccttaaaatacttcatgatg

SEQ ID NO: 661362 - DNA, 25 bp, Homo sapien
aatacttcatgatgtatcttctaag

SEQ ID NO: 661363 - DNA, 25 bp, Homo sapien
cagacatctgtctacatagccagga

SEQ ID NO: 661364 - DNA, 25 bp, Homo sapien
gtctacatagccaggacttcatatc

SEQ ID NO: 661365 - DNA, 25 bp, Homo sapien
atagccaggacttcatatcacatct

SEQ ID NO: 661366 - DNA, 25 bp, Homo sapien
gccaggacttcatatcacatctaag

SEQ ID NO: 661367 - DNA, 25 bp, Homo sapien
ggacttcatatcacatctaagaatt

SEQ ID NO: 661368 - DNA, 25 bp, Homo sapien
ctaatatatgattcctattcagatt

SEQ ID NO: 661369 - DNA, 25 bp, Homo sapien
agctttattgcttgtgatctttggc

SEQ ID NO: 661370 - DNA, 25 bp, Homo sapien
gatctttggcaagctacttgtgcta

SEQ ID NO: 661371 - DNA, 25 bp, Homo sapien
ggcaagctacttgtgctatcagttt

SEQ ID NO: 661372 - DNA, 25 bp, Homo sapien
ctacttgtgctatcagttttctcat

SEQ ID NO: 661373 - DNA, 25 bp, Homo sapien
aacttggtaagtaatgctggtagat

SEQ ID NO: 661374 - DNA, 25 bp, Homo sapien
gattgaatactctccatctctcatg

SEQ ID NO: 661375 - DNA, 25 bp, Homo sapien
tccatctctcatgatcctagaactt

SEQ ID NO: 661376 - DNA, 25 bp, Homo sapien
tcatgatcctagaacttccttcgtt

SEQ ID NO: 661377 - DNA, 25 bp, Homo sapien
tcctagaacttccttcgtttctttg

SEQ ID NO: 661378 - DNA, 25 bp, Homo sapien
gtgattggtttatagtgtagtgatt

SEQ ID NO: 661379 - DNA, 25 bp, Homo sapien
gggatctgaagacaatttcagcttt

SEQ ID NO: 661380 - DNA, 25 bp, Homo sapien
ctcttcacactaatttgaatatatc

SEQ ID NO: 661381 - DNA, 25 bp, Homo sapien
tatcatcaatttttactaacagatt

SEQ ID NO: 661382 - DNA, 25 bp, Homo sapien
aacagatttgatatgatggtaaaga

SEQ ID NO: 661383 - DNA, 25 bp, Homo sapien
gaaaggctaagttgaaatatgtaca

SEQ ID NO: 661384 - DNA, 25 bp, Homo sapien
gttgaaatatgtacattagcagatg

SEQ ID NO: 661385 - DNA, 25 bp, Homo sapien
gatgtttgtttattcagttgccagt

SEQ ID NO: 661386 - DNA, 25 bp, Homo sapien
tgtttgtttattcagttgccagtaa

SEQ ID NO: 661387 - DNA, 25 bp, Homo sapien
tttgtttattcagttgccagtaatt

SEQ ID NO: 661388 - DNA, 25 bp, Homo sapien
ttttaaataattccaagtgatgcat

SEQ ID NO: 661389 - DNA, 25 bp, Homo sapien
aattccaagtgatgcatattatttc

SEQ ID NO: 661390 - DNA, 25 bp, Homo sapien
gattatatacatctataggatacaa

SEQ ID NO: 661391 - DNA, 25 bp, Homo sapien
atgcccagcctacacttgggcttct

SEQ ID NO: 661392 - DNA, 25 bp, Homo sapien
ctacacttgggcttcttaggcacaa

SEQ ID NO: 661393 - DNA, 25 bp, Homo sapien
ttgggcttcttaggcacaagatcca

SEQ ID NO: 661394 - DNA, 25 bp, Homo sapien
ggcttcttaggcacaagatccagta

SEQ ID NO: 661395 - DNA, 25 bp, Homo sapien
aggcacaagatccagtaagccctcc

SEQ ID NO: 661396 - DNA, 25 bp, Homo sapien
ttttctttacactagtgttttctgt

SEQ ID NO: 661397 - DNA, 25 bp, Homo sapien
gtgttttctgtaatcctgcaacaga

SEQ ID NO: 661398 - DNA, 25 bp, Homo sapien
atcctgcaacagaaagagtcctaac

SEQ ID NO: 661399 - DNA, 25 bp, Homo sapien
agagtcctaactgatatatttgtga

SEQ ID NO: 661400 - DNA, 25 bp, Homo sapien
ctaactgatatatttgtgaccattt

SEQ ID NO: 661401 - DNA, 25 bp, Homo sapien
tgtgaccatttctaaaatctccaaa

SEQ ID NO: 661402 - DNA, 25 bp, Homo sapien
tacaagataacctgggccgtgcgcc

SEQ ID NO: 661403 - DNA, 25 bp, Homo sapien
ataacctgggccgtgcgccgagagc

SEQ ID NO: 661404 - DNA, 25 bp, Homo sapien
gccgagagctgagagcgtccccaaa

SEQ ID NO: 661405 - DNA, 25 bp, Homo sapien
agctgagagcgtccccaaatgctga

SEQ ID NO: 661406 - DNA, 25 bp, Homo sapien
atgtgttcaaccaagcgggaaactc

SEQ ID NO: 661407 - DNA, 25 bp, Homo sapien
tcaaccaagcgggaaactctccggg

SEQ ID NO: 661408 - DNA, 25 bp, Homo sapien
caagcgggaaactctccgggtagag

SEQ ID NO: 661409 - DNA, 25 bp, Homo sapien
aactctccgggtagagtgaaatccg

SEQ ID NO: 661410 - DNA, 25 bp, Homo sapien
gtgaaatccgaagttgctatgctac

SEQ ID NO: 661411 - DNA, 25 bp, Homo sapien
aatccgaagttgctatgctacaaga

SEQ ID NO: 661412 - DNA, 25 bp, Homo sapien
tatgctacaagataacctgggccgt

SEQ ID NO: 661413 - DNA, 25 bp, Homo sapien
tcagctctgcatgtactattgtggg

SEQ ID NO: 661414 - DNA, 25 bp, Homo sapien
actattgtgggttctggtccgtgga

SEQ ID NO: 661415 - DNA, 25 bp, Homo sapien
gggaagtgcctttcagacacatcca

SEQ ID NO: 661416 - DNA, 25 bp, Homo sapien
gacacatccaagaaatgacccttaa

SEQ ID NO: 661417 - DNA, 25 bp, Homo sapien
gacccttaatcctccaagctaagag

SEQ ID NO: 661418 - DNA, 25 bp, Homo sapien
gagatcatctggactagacgtggta

SEQ ID NO: 661419 - DNA, 25 bp, Homo sapien
agtgacataggctagcagtctgtat

SEQ ID NO: 661420 - DNA, 25 bp, Homo sapien
cagtctgtattgtctgcaaacccag

SEQ ID NO: 661421 - DNA, 25 bp, Homo sapien
aacccagaactgtccttggctggcc

SEQ ID NO: 661422 - DNA, 25 bp, Homo sapien
ttggctggccaatgtaaatgtgttt

SEQ ID NO: 661423 - DNA, 25 bp, Homo sapien
tgtgttttaatagccacacacacgg

SEQ ID NO: 661424 - DNA, 25 bp, Homo sapien
agcaaatattgtatgttctcactca

SEQ ID NO: 661425 - DNA, 25 bp, Homo sapien
tatagtgtacactgcttgggtgaca

SEQ ID NO: 661426 - DNA, 25 bp, Homo sapien
acactgcttgggtgacaggtgcact

SEQ ID NO: 661427 - DNA, 25 bp, Homo sapien
aggtgcactaatatctcagacacag

SEQ ID NO: 661428 - DNA, 25 bp, Homo sapien
ggtgcactaatatctcagacacaga

SEQ ID NO: 661429 - DNA, 25 bp, Homo sapien
gtgcactaatatctcagacacagac

SEQ ID NO: 661430 - DNA, 25 bp, Homo sapien
gcactaatatctcagacacagacat

SEQ ID NO: 661431 - DNA, 25 bp, Homo sapien
agacacagacatcaccactaaaaaa

SEQ ID NO: 661432 - DNA, 25 bp, Homo sapien
gacacagacatcaccactaaaaaat

SEQ ID NO: 661433 - DNA, 25 bp, Homo sapien
gacatcaccactaaaaaatcttatc

SEQ ID NO: 661434 - DNA, 25 bp, Homo sapien
caccactaaaaaatcttatccccat

SEQ ID NO: 661435 - DNA, 25 bp, Homo sapien
tgtgcccagccaaggtgagggttta

SEQ ID NO: 661436 - DNA, 25 bp, Homo sapien
cagccaaggtgagggtttaaacaga

SEQ ID NO: 661437 - DNA, 25 bp, Homo sapien
gccaaggtgagggtttaaacagaca

SEQ ID NO: 661438 - DNA, 25 bp, Homo sapien
caaggtgagggtttaaacagacaga

SEQ ID NO: 661439 - DNA, 25 bp, Homo sapien
ggtgagggtttaaacagacagaaag

SEQ ID NO: 661440 - DNA, 25 bp, Homo sapien
gacagaaagacagacacagacacag

SEQ ID NO: 661441 - DNA, 25 bp, Homo sapien
atagacaaagacaccgagagacaga

SEQ ID NO: 661442 - DNA, 25 bp, Homo sapien
tagacaaagacaccgagagacagag

SEQ ID NO: 661443 - DNA, 25 bp, Homo sapien
agaggaatcaggaccacaatgtgct

SEQ ID NO: 661444 - DNA, 25 bp, Homo sapien
acaatgtgctcccaccctagtggat

SEQ ID NO: 661445 - DNA, 25 bp, Homo sapien
agaagggagttgctacccttagtag

SEQ ID NO: 661446 - DNA, 25 bp, Homo sapien
aacacttcaagaggcctacacggga

SEQ ID NO: 661447 - DNA, 25 bp, Homo sapien
acttcaagaggcctacacgggagaa

SEQ ID NO: 661448 - DNA, 25 bp, Homo sapien
cttcaagaggcctacacgggagaat

SEQ ID NO: 661449 - DNA, 25 bp, Homo sapien
ttcaagaggcctacacgggagaata

SEQ ID NO: 661450 - DNA, 25 bp, Homo sapien
caagaggcctacacgggagaataac

SEQ ID NO: 661451 - DNA, 25 bp, Homo sapien
aggcctacacgggagaataacttga

SEQ ID NO: 661452 - DNA, 25 bp, Homo sapien
gcctacacgggagaataacttgaga

SEQ ID NO: 661453 - DNA, 25 bp, Homo sapien
tacacgggagaataacttgagacta

SEQ ID NO: 661454 - DNA, 25 bp, Homo sapien
tgtggtcccaactatatatatgtga

SEQ ID NO: 661455 - DNA, 25 bp, Homo sapien
gtggtcccaactatatatatgtgaa

SEQ ID NO: 661456 - DNA, 25 bp, Homo sapien
ggtcccaactatatatatgtgaagc

SEQ ID NO: 661457 - DNA, 25 bp, Homo sapien
tcttcttgaactgtcaaaattcagt

SEQ ID NO: 661458 - DNA, 25 bp, Homo sapien
gaactgtcaaaattcagtgtctgat

SEQ ID NO: 661459 - DNA, 25 bp, Homo sapien
attcagtgtctgatattaaggatat

SEQ ID NO: 661460 - DNA, 25 bp, Homo sapien
ggatataaattactcagctctactg

SEQ ID NO: 661461 - DNA, 25 bp, Homo sapien
taaattactcagctctactgccatg

SEQ ID NO: 661462 - DNA, 25 bp, Homo sapien
aaattactcagctctactgccatga

SEQ ID NO: 661463 - DNA, 25 bp, Homo sapien
attactcagctctactgccatgagg

SEQ ID NO: 661464 - DNA, 25 bp, Homo sapien
ttactcagctctactgccatgaggt

SEQ ID NO: 661465 - DNA, 25 bp, Homo sapien
actcagctctactgccatgaggtca

SEQ ID NO: 661466 - DNA, 25 bp, Homo sapien
cagctctactgccatgaggtcagga

SEQ ID NO: 661467 - DNA, 25 bp, Homo sapien
agctctactgccatgaggtcaggag

SEQ ID NO: 661468 - DNA, 25 bp, Homo sapien
caccctcaccgcaagtgttttcacc

SEQ ID NO: 661469 - DNA, 25 bp, Homo sapien
tccaatggatccatatgcaaaaatg

SEQ ID NO: 661470 - DNA, 25 bp, Homo sapien
caatggatccatatgcaaaaatggt

SEQ ID NO: 661471 - DNA, 25 bp, Homo sapien
atggatccatatgcaaaaatggttg

SEQ ID NO: 661472 - DNA, 25 bp, Homo sapien
ggatccatatgcaaaaatggttggt

SEQ ID NO: 661473 - DNA, 25 bp, Homo sapien
catatgcaaaaatggttggtacccc

SEQ ID NO: 661474 - DNA, 25 bp, Homo sapien
atatgcaaaaatggttggtacccct

SEQ ID NO: 661475 - DNA, 25 bp, Homo sapien
tatgcaaaaatggttggtacccctc

SEQ ID NO: 661476 - DNA, 25 bp, Homo sapien
atgcaaaaatggttggtacccctcg

SEQ ID NO: 661477 - DNA, 25 bp, Homo sapien
tgcaaaaatggttggtacccctcga

SEQ ID NO: 661478 - DNA, 25 bp, Homo sapien
cagtggaaaactgtacacctttatc

SEQ ID NO: 661479 - DNA, 25 bp, Homo sapien
ggtaaaccaccttgggaagctgcaa

SEQ ID NO: 661480 - DNA, 25 bp, Homo sapien
gaagctgcaacacacccaaagggtt

SEQ ID NO: 661481 - DNA, 25 bp, Homo sapien
aggaggtagtagtcaccgaacgtga

SEQ ID NO: 661482 - DNA, 25 bp, Homo sapien
gaacgtgacaagttgacctgtagct

SEQ ID NO: 661483 - DNA, 25 bp, Homo sapien
gacctgtagctgaacatttttccat

SEQ ID NO: 661484 - DNA, 25 bp, Homo sapien
gctgaacatttttccatgtctgtat

SEQ ID NO: 661485 - DNA, 25 bp, Homo sapien
tacactgtaatttaaccaatctata

SEQ ID NO: 661486 - DNA, 25 bp, Homo sapien
catttagatgttttcagtttttcac

SEQ ID NO: 661487 - DNA, 25 bp, Homo sapien
tcagtttttcacaatgtacagtcgt

SEQ ID NO: 661488 - DNA, 25 bp, Homo sapien
cagtcgtgattttgatatggtttcc

SEQ ID NO: 661489 - DNA, 25 bp, Homo sapien
atatggtttccatcctagttttagg

SEQ ID NO: 661490 - DNA, 25 bp, Homo sapien
gatgttttttgtgttgtattcaaga

SEQ ID NO: 661491 - DNA, 25 bp, Homo sapien
tcaagaaatctttgtcatgcaaagg

SEQ ID NO: 661492 - DNA, 25 bp, Homo sapien
agaaatctttgtcatgcaaaggtca

SEQ ID NO: 661493 - DNA, 25 bp, Homo sapien
aaatctttgtcatgcaaaggtcact

SEQ ID NO: 661494 - DNA, 25 bp, Homo sapien
aatctttgtcatgcaaaggtcactt

SEQ ID NO: 661495 - DNA, 25 bp, Homo sapien
atctttgtcatgcaaaggtcactta

SEQ ID NO: 661496 - DNA, 25 bp, Homo sapien
tttgtcatgcaaaggtcacttaaga

SEQ ID NO: 661497 - DNA, 25 bp, Homo sapien
ttgtcatgcaaaggtcacttaagat

SEQ ID NO: 661498 - DNA, 25 bp, Homo sapien
tgtcatgcaaaggtcacttaagatt

SEQ ID NO: 661499 - DNA, 25 bp, Homo sapien
gtcatgcaaaggtcacttaagattt

SEQ ID NO: 661500 - DNA, 25 bp, Homo sapien
catgcaaaggtcacttaagattttc

SEQ ID NO: 661501 - DNA, 25 bp, Homo sapien
aaatgttttcttgccaggaatggtg

SEQ ID NO: 661502 - DNA, 25 bp, Homo sapien
tcttgccaggaatggtggtgtgcac

SEQ ID NO: 661503 - DNA, 25 bp, Homo sapien
ggaggacaactgagcccatgggtct

SEQ ID NO: 661504 - DNA, 25 bp, Homo sapien
gaggacaactgagcccatgggtcta

SEQ ID NO: 661505 - DNA, 25 bp, Homo sapien
gacaactgagcccatgggtctagcc

SEQ ID NO: 661506 - DNA, 25 bp, Homo sapien
aactgagcccatgggtctagcctgg

SEQ ID NO: 661507 - DNA, 25 bp, Homo sapien
tattttataaaacagctgggcatgg

SEQ ID NO: 661508 - DNA, 25 bp, Homo sapien
gctgcagggagctattatttattgt

SEQ ID NO: 661509 - DNA, 25 bp, Homo sapien
tattgtacctgtgaagaaccccctg

SEQ ID NO: 661510 - DNA, 25 bp, Homo sapien
tacctgtgaagaaccccctgcattg

SEQ ID NO: 661511 - DNA, 25 bp, Homo sapien
tgaagaaccccctgcattgcagcct

SEQ ID NO: 661512 - DNA, 25 bp, Homo sapien
tttttcccattatgaaagtcatcaa

SEQ ID NO: 661513 - DNA, 25 bp, Homo sapien
gaaagtcatcaatgctcattataga

SEQ ID NO: 661514 - DNA, 25 bp, Homo sapien
tatttgatatattcatccttaatcc

SEQ ID NO: 661515 - DNA, 25 bp, Homo sapien
catccttaatccttaatcttttact

SEQ ID NO: 661516 - DNA, 25 bp, Homo sapien
aatccttaatcttttactatgttat

SEQ ID NO: 661517 - DNA, 25 bp, Homo sapien
aatcttttactatgttatatcttta

SEQ ID NO: 661518 - DNA, 25 bp, Homo sapien
ggtcagatgggctgtgtcacagtga

SEQ ID NO: 661519 - DNA, 25 bp, Homo sapien
gggataatttgggatcagtcaacat

SEQ ID NO: 661520 - DNA, 25 bp, Homo sapien
gggatcagtcaacataacacacata

SEQ ID NO: 661521 - DNA, 25 bp, Homo sapien
cataacacacataacacaacccatt

SEQ ID NO: 661522 - DNA, 25 bp, Homo sapien
acacataacacaacccattaatttt

SEQ ID NO: 661523 - DNA, 25 bp, Homo sapien
gggacaccattcaactcataacact

SEQ ID NO: 661524 - DNA, 25 bp, Homo sapien
caccattcaactcataacactgctg

SEQ ID NO: 661525 - DNA, 25 bp, Homo sapien
attcaactcataacactgctgatgt

SEQ ID NO: 661526 - DNA, 25 bp, Homo sapien
caactcataacactgctgatgtttt

SEQ ID NO: 661527 - DNA, 25 bp, Homo sapien
aaatcagattatggcgatggctgca

SEQ ID NO: 661528 - DNA, 25 bp, Homo sapien
gattatggcgatggctgcatgactt

SEQ ID NO: 661529 - DNA, 25 bp, Homo sapien
ttatggcgatggctgcatgactttg

SEQ ID NO: 661530 - DNA, 25 bp, Homo sapien
ctatatggtatgtgagttgtatctc

SEQ ID NO: 661531 - DNA, 25 bp, Homo sapien
gtttaaagagtctgcccaagctcaa

SEQ ID NO: 661532 - DNA, 25 bp, Homo sapien
aagagtctgcccaagctcaataatc

SEQ ID NO: 661533 - DNA, 25 bp, Homo sapien
agtctgcccaagctcaataatcaac

SEQ ID NO: 661534 - DNA, 25 bp, Homo sapien
aagtgggacactccagtctaggctg

SEQ ID NO: 661535 - DNA, 25 bp, Homo sapien
tgggacactccagtctaggctgttt

SEQ ID NO: 661536 - DNA, 25 bp, Homo sapien
gctgttttggtggaaacaacctttg

SEQ ID NO: 661537 - DNA, 25 bp, Homo sapien
ggtggaaacaacctttgttcagtat

SEQ ID NO: 661538 - DNA, 25 bp, Homo sapien
tttgttcagtattgagtagtgcatt

SEQ ID NO: 661539 - DNA, 25 bp, Homo sapien
gtattgagtagtgcatttacttgta

SEQ ID NO: 661540 - DNA, 25 bp, Homo sapien
gagtagtgcatttacttgtaataat

SEQ ID NO: 661541 - DNA, 25 bp, Homo sapien
gtaataatacaaataagtcagctga

SEQ ID NO: 661542 - DNA, 25 bp, Homo sapien
aagtcagctgatgacaatggctgaa

SEQ ID NO: 661543 - DNA, 25 bp, Homo sapien
ccaggtcatggaaaccaagaagtga

SEQ ID NO: 661544 - DNA, 25 bp, Homo sapien
gaaaccaagaagtgagaagcatttc

SEQ ID NO: 661545 - DNA, 25 bp, Homo sapien
aaagacatcagatcaggaggtggga

SEQ ID NO: 661546 - DNA, 25 bp, Homo sapien
atcaggaggtgggagaactactcat

SEQ ID NO: 661547 - DNA, 25 bp, Homo sapien
gagaaacgattccacacagtgccgt

SEQ ID NO: 661548 - DNA, 25 bp, Homo sapien
gtgccgtcctagcactggactgagt

SEQ ID NO: 661549 - DNA, 25 bp, Homo sapien
ggactgagtggccaatatagtgtta

SEQ ID NO: 661550 - DNA, 25 bp, Homo sapien
gccaatatagtgttagcctcagaaa

SEQ ID NO: 661551 - DNA, 25 bp, Homo sapien
tgttagcctcagaaacaatgggagt

SEQ ID NO: 661552 - DNA, 25 bp, Homo sapien
aatatctgactcatccattcacggg

SEQ ID NO: 661553 - DNA, 25 bp, Homo sapien
gactcatccattcacgggtggaaaa

SEQ ID NO: 661554 - DNA, 25 bp, Homo sapien
gaatttttatttcagcctaagagtg

SEQ ID NO: 661555 - DNA, 25 bp, Homo sapien
taagagtgataaggcaccaggtgct

SEQ ID NO: 661556 - DNA, 25 bp, Homo sapien
gtgcttttctggggaaataggacga

SEQ ID NO: 661557 - DNA, 25 bp, Homo sapien
aataggacgaaagggccgggcgcag

SEQ ID NO: 661558 - DNA, 25 bp, Homo sapien
ataggacgaaagggccgggcgcagt

SEQ ID NO: 661559 - DNA, 25 bp, Homo sapien
taggacgaaagggccgggcgcagtg

SEQ ID NO: 661560 - DNA, 25 bp, Homo sapien
aggacgaaagggccgggcgcagtgg

SEQ ID NO: 661561 - DNA, 25 bp, Homo sapien
gggcaacctggtgaaacccagtctt

SEQ ID NO: 661562 - DNA, 25 bp, Homo sapien
ggcaacctggtgaaacccagtcttt

SEQ ID NO: 661563 - DNA, 25 bp, Homo sapien
tggtgaaacccagtctttacaaaat

SEQ ID NO: 661564 - DNA, 25 bp, Homo sapien
tgaaacccagtctttacaaaataca

SEQ ID NO: 661565 - DNA, 25 bp, Homo sapien
gtatgcactcaaaattgaaatctgg

SEQ ID NO: 661566 - DNA, 25 bp, Homo sapien
tctggatatgtaatctactgataaa

SEQ ID NO: 661567 - DNA, 25 bp, Homo sapien
gggactgtcatcttaccaagaaatg

SEQ ID NO: 661568 - DNA, 25 bp, Homo sapien
gactgtcatcttaccaagaaatgct

SEQ ID NO: 661569 - DNA, 25 bp, Homo sapien
atgctaatcattctactttttgaag

SEQ ID NO: 661570 - DNA, 25 bp, Homo sapien
attctactttttgaagtgtgcctca

SEQ ID NO: 661571 - DNA, 25 bp, Homo sapien
actttttgaagtgtgcctcatttgc

SEQ ID NO: 661572 - DNA, 25 bp, Homo sapien
ttgaagtgtgcctcatttgcatcac

SEQ ID NO: 661573 - DNA, 25 bp, Homo sapien
aagtgtgcctcatttgcatcacaaa

SEQ ID NO: 661574 - DNA, 25 bp, Homo sapien
tttgcatcacaaacattattatgaa

SEQ ID NO: 661575 - DNA, 25 bp, Homo sapien
gaaaattcaacattatgcttctgtg

SEQ ID NO: 661576 - DNA, 25 bp, Homo sapien
cagtgtctcccaggatgaagaatga

SEQ ID NO: 661577 - DNA, 25 bp, Homo sapien
gaatgaggccacactgccaaagcaa

SEQ ID NO: 661578 - DNA, 25 bp, Homo sapien
gcaagatctcgtgctatgtgtgatt

SEQ ID NO: 661579 - DNA, 25 bp, Homo sapien
tgtgattgaatctcctgctgggcgc

SEQ ID NO: 661580 - DNA, 25 bp, Homo sapien
ggcgccaagcaggaatctcatcatt

SEQ ID NO: 661581 - DNA, 25 bp, Homo sapien
atcatttccccacaggccctgagag

SEQ ID NO: 661582 - DNA, 25 bp, Homo sapien
agtgcactcactgcagagccaatga

SEQ ID NO: 661583 - DNA, 25 bp, Homo sapien
aatgaggcctgagctcagggtctgc

SEQ ID NO: 661584 - DNA, 25 bp, Homo sapien
tgcatggccacttccatctgtggta

SEQ ID NO: 661585 - DNA, 25 bp, Homo sapien
ttccatctgtggtacttgttagttt

SEQ ID NO: 661586 - DNA, 25 bp, Homo sapien
gtgcgatttgtttggttgcattttc

SEQ ID NO: 661587 - DNA, 25 bp, Homo sapien
agccattgctagctgagtaaataac

SEQ ID NO: 661588 - DNA, 25 bp, Homo sapien
gccattgctagctgagtaaataaca

SEQ ID NO: 661589 - DNA, 25 bp, Homo sapien
cattgctagctgagtaaataacacc

SEQ ID NO: 661590 - DNA, 25 bp, Homo sapien
ttgctagctgagtaaataacaccat

SEQ ID NO: 661591 - DNA, 25 bp, Homo sapien
tgctagctgagtaaataacaccata

SEQ ID NO: 661592 - DNA, 25 bp, Homo sapien
gctagctgagtaaataacaccatag

SEQ ID NO: 661593 - DNA, 25 bp, Homo sapien
aataacaccatagatgccgggtgca

SEQ ID NO: 661594 - DNA, 25 bp, Homo sapien
ataacaccatagatgccgggtgcag

SEQ ID NO: 661595 - DNA, 25 bp, Homo sapien
taacaccatagatgccgggtgcagt

SEQ ID NO: 661596 - DNA, 25 bp, Homo sapien
aacaccatagatgccgggtgcagtg

SEQ ID NO: 661597 - DNA, 25 bp, Homo sapien
acaccatagatgccgggtgcagtga

SEQ ID NO: 661598 - DNA, 25 bp, Homo sapien
acatctgccagcagctggatttcca

SEQ ID NO: 661599 - DNA, 25 bp, Homo sapien
tggatttccaatcttcccaacaata

SEQ ID NO: 661600 - DNA, 25 bp, Homo sapien
gatttccaatcttcccaacaatagt

SEQ ID NO: 661601 - DNA, 25 bp, Homo sapien
ttccaatcttcccaacaatagtctg

SEQ ID NO: 661602 - DNA, 25 bp, Homo sapien
ccaacaatagtctgggcttcattct

SEQ ID NO: 661603 - DNA, 25 bp, Homo sapien
tatgatgtgtggatgggaaatagca

SEQ ID NO: 661604 - DNA, 25 bp, Homo sapien
tacctggtccaggaaacacttgtac

SEQ ID NO: 661605 - DNA, 25 bp, Homo sapien
ggtccaggaaacacttgtacctaga

SEQ ID NO: 661606 - DNA, 25 bp, Homo sapien
ggaaacacttgtacctagaaacgag

SEQ ID NO: 661607 - DNA, 25 bp, Homo sapien
ttgtacctagaaacgagttccaaag

SEQ ID NO: 661608 - DNA, 25 bp, Homo sapien
ctagaaacgagttccaaagaattct

SEQ ID NO: 661609 - DNA, 25 bp, Homo sapien
tccagttctccccagttcggttgtg

SEQ ID NO: 661610 - DNA, 25 bp, Homo sapien
cagttcggttgtgctccagggaaga

SEQ ID NO: 661611 - DNA, 25 bp, Homo sapien
aagtagaataatgcccttagactgc

SEQ ID NO: 661612 - DNA, 25 bp, Homo sapien
cccttagactgcatggaatctcaaa

SEQ ID NO: 661613 - DNA, 25 bp, Homo sapien
agactgcatggaatctcaaacaagt

SEQ ID NO: 661614 - DNA, 25 bp, Homo sapien
caagttttacttttgtgctatgtat

SEQ ID NO: 661615 - DNA, 25 bp, Homo sapien
agatctattttctttctcactgagg

SEQ ID NO: 661616 - DNA, 25 bp, Homo sapien
ctttctcactgaggtcgtatcagta

SEQ ID NO: 661617 - DNA, 25 bp, Homo sapien
gataaactgcgatctctgtggaaat

SEQ ID NO: 661618 - DNA, 25 bp, Homo sapien
tgcgatctctgtggaaatctttttc

SEQ ID NO: 661619 - DNA, 25 bp, Homo sapien
gaagctgttctgaataaagttactc

SEQ ID NO: 661620 - DNA, 25 bp, Homo sapien
tctcgtcgtcattaagcattaccat

SEQ ID NO: 661621 - DNA, 25 bp, Homo sapien
gcattaccatggtgactcagatcta

SEQ ID NO: 661622 - DNA, 25 bp, Homo sapien
gtgactcagatctatccagtggaat

SEQ ID NO: 661623 - DNA, 25 bp, Homo sapien
agaagtgatgttgctattcaagatc

SEQ ID NO: 661624 - DNA, 25 bp, Homo sapien
catggaagtgctcctctgtgatctt

SEQ ID NO: 661625 - DNA, 25 bp, Homo sapien
ttctcccagggaactttggaagtct

SEQ ID NO: 661626 - DNA, 25 bp, Homo sapien
gaactttggaagtctcatgcagaag

SEQ ID NO: 661627 - DNA, 25 bp, Homo sapien
gaaacttcaccaatctgggtctctg

SEQ ID NO: 661628 - DNA, 25 bp, Homo sapien
aatctgggtctctgtgtgactgaaa

SEQ ID NO: 661629 - DNA, 25 bp, Homo sapien
taagagatggcagacccatctacct

SEQ ID NO: 661630 - DNA, 25 bp, Homo sapien
ctctcaccttttagtgtcacatgat

SEQ ID NO: 661631 - DNA, 25 bp, Homo sapien
ttctctgccagagatgattctgtct

SEQ ID NO: 661632 - DNA, 25 bp, Homo sapien
gatgattctgtctcatccaatcaag

SEQ ID NO: 661633 - DNA, 25 bp, Homo sapien
ccaatcaagacttgagtggactcca

SEQ ID NO: 661634 - DNA, 25 bp, Homo sapien
agatcttacccgcttcactggtaac

SEQ ID NO: 661635 - DNA, 25 bp, Homo sapien
actggtaacacccagaatcctcagc

SEQ ID NO: 661636 - DNA, 25 bp, Homo sapien
aggaggtggtcatcagcaacccagg

SEQ ID NO: 661637 - DNA, 25 bp, Homo sapien
ggtggtcatcagcaacccaggaaga

SEQ ID NO: 661638 - DNA, 25 bp, Homo sapien
agcaacccaggaagagtggcctcac

SEQ ID NO: 661639 - DNA, 25 bp, Homo sapien
ggaagagtggcctcaccagaaactg

SEQ ID NO: 661640 - DNA, 25 bp, Homo sapien
agaaactgaccctgccagacctcga

SEQ ID NO: 661641 - DNA, 25 bp, Homo sapien
gccagacctcgatttgagacttcca

SEQ ID NO: 661642 - DNA, 25 bp, Homo sapien
atcttatacctagcaacttgggccc

SEQ ID NO: 661643 - DNA, 25 bp, Homo sapien
tatacctagcaacttgggcccacag

SEQ ID NO: 661644 - DNA, 25 bp, Homo sapien
acctagcaacttgggcccacagatt

SEQ ID NO: 661645 - DNA, 25 bp, Homo sapien
atttttaagaatttactgtgcagaa

SEQ ID NO: 661646 - DNA, 25 bp, Homo sapien
ttactgtgcagaaatacaagtttgc

SEQ ID NO: 661647 - DNA, 25 bp, Homo sapien
aaatggatgtttccttcagcattgc

SEQ ID NO: 661648 - DNA, 25 bp, Homo sapien
tggatgtttccttcagcattgcttg

SEQ ID NO: 661649 - DNA, 25 bp, Homo sapien
tatatgacagaatacaactatcaga

SEQ ID NO: 661650 - DNA, 25 bp, Homo sapien
ctatatgtaaggacatcgagatgct

SEQ ID NO: 661651 - DNA, 25 bp, Homo sapien
catcgagatgctaaaacacgttaag

SEQ ID NO: 661652 - DNA, 25 bp, Homo sapien
atatactgtataagatcacaccaat

SEQ ID NO: 661653 - DNA, 25 bp, Homo sapien
agctcctcccgactgaggttttttg

SEQ ID NO: 661654 - DNA, 25 bp, Homo sapien
tcccgactgaggttttttggcagca

SEQ ID NO: 661655 - DNA, 25 bp, Homo sapien
actgaggttttttggcagcagcccc

SEQ ID NO: 661656 - DNA, 25 bp, Homo sapien
aggttttttggcagcagccccgcga

SEQ ID NO: 661657 - DNA, 25 bp, Homo sapien
ttttttggcagcagccccgcgaagg

SEQ ID NO: 661658 - DNA, 25 bp, Homo sapien
cggggttgcctctgatgcctggaca

SEQ ID NO: 661659 - DNA, 25 bp, Homo sapien
aagcaatgggagtcattccatcccg

SEQ ID NO: 661660 - DNA, 25 bp, Homo sapien
aatgggagtcattccatcccgaggt

SEQ ID NO: 661661 - DNA, 25 bp, Homo sapien
ggagtcattccatcccgaggtgcca

SEQ ID NO: 661662 - DNA, 25 bp, Homo sapien
aaatcctgcggcctctgacaaatgc

SEQ ID NO: 661663 - DNA, 25 bp, Homo sapien
ggcctctgacaaatgcctcacaatg

SEQ ID NO: 661664 - DNA, 25 bp, Homo sapien
agacctcatcgctactgtaaaaatt

SEQ ID NO: 661665 - DNA, 25 bp, Homo sapien
acctcatcgctactgtaaaaattag

SEQ ID NO: 661666 - DNA, 25 bp, Homo sapien
ggctgttgtggtgcacatccacaat

SEQ ID NO: 661667 - DNA, 25 bp, Homo sapien
gttgtggtgcacatccacaatccca

SEQ ID NO: 661668 - DNA, 25 bp, Homo sapien
ttgaaccttaaacccaggaagcaga

SEQ ID NO: 661669 - DNA, 25 bp, Homo sapien
aatgtatatataaccaagattccta

SEQ ID NO: 661670 - DNA, 25 bp, Homo sapien
aagattcctacaccaacattcacga

SEQ ID NO: 661671 - DNA, 25 bp, Homo sapien
gattcctacaccaacattcacgaaa

SEQ ID NO: 661672 - DNA, 25 bp, Homo sapien
tcctacaccaacattcacgaaaata

SEQ ID NO: 661673 - DNA, 25 bp, Homo sapien
attcacgaaaataagttccaggtag

SEQ ID NO: 661674 - DNA, 25 bp, Homo sapien
aagttccaggtagatcaaaatgcta

SEQ ID NO: 661675 - DNA, 25 bp, Homo sapien
gcatcaccaacatagtggacatttt

SEQ ID NO: 661676 - DNA, 25 bp, Homo sapien
catagtggacattttccctctcaga

SEQ ID NO: 661677 - DNA, 25 bp, Homo sapien
ggagtgaaatttcccgtgatctttc

SEQ ID NO: 661678 - DNA, 25 bp, Homo sapien
tgaaatttcccgtgatctttccaca

SEQ ID NO: 661679 - DNA, 25 bp, Homo sapien
atttcccgtgatctttccacaaatg

SEQ ID NO: 661680 - DNA, 25 bp, Homo sapien
gtgatctttccacaaatgaccagct

SEQ ID NO: 661681 - DNA, 25 bp, Homo sapien
tctttccacaaatgaccagcttggg

SEQ ID NO: 661682 - DNA, 25 bp, Homo sapien
ggccctggaacagttcctggaaatg

SEQ ID NO: 661683 - DNA, 25 bp, Homo sapien
tggatagggtggagacaatgctcat

SEQ ID NO: 661684 - DNA, 25 bp, Homo sapien
acaatgctcatggagtgcagtatgg

SEQ ID NO: 661685 - DNA, 25 bp, Homo sapien
gggcctacccagagttgcttggcca

SEQ ID NO: 661686 - DNA, 25 bp, Homo sapien
atgagacccccaacaaatagccctt

SEQ ID NO: 661687 - DNA, 25 bp, Homo sapien
ccatttccaatggatccatatgcaa

SEQ ID NO: 661688 - DNA, 25 bp, Homo sapien
tgcaaaaatggttggtacccctcga

SEQ ID NO: 661689 - DNA, 25 bp, Homo sapien
caaaaaaaattttgctgccccagtg

SEQ ID NO: 661690 - DNA, 25 bp, Homo sapien
attttgctgccccagtggaaaactg

SEQ ID NO: 661691 - DNA, 25 bp, Homo sapien
actgtacacctttatcatcggtatt

SEQ ID NO: 661692 - DNA, 25 bp, Homo sapien
tcatcggtatttaggcccctccaac

SEQ ID NO: 661693 - DNA, 25 bp, Homo sapien
gtatttaggcccctccaactcatga

SEQ ID NO: 661694 - DNA, 25 bp, Homo sapien
atttaggcccctccaactcatgaga

SEQ ID NO: 661695 - DNA, 25 bp, Homo sapien
tttaggcccctccaactcatgagac

SEQ ID NO: 661696 - DNA, 25 bp, Homo sapien
caactcatgagacccccaacaaata

SEQ ID NO: 661697 - DNA, 25 bp, Homo sapien
ggagctccagaaatgatgggtgtta

SEQ ID NO: 661698 - DNA, 25 bp, Homo sapien
gaatctactgggtgtcatcaagggt

SEQ ID NO: 661699 - DNA, 25 bp, Homo sapien
ttagacaaattggaggcaccccttc

SEQ ID NO: 661700 - DNA, 25 bp, Homo sapien
gaaggcccttttgagcaagctgcca

SEQ ID NO: 661701 - DNA, 25 bp, Homo sapien
tgagcaagctgccagtgactgtccc

SEQ ID NO: 661702 - DNA, 25 bp, Homo sapien
tgactgtcccctacattcagagatg

SEQ ID NO: 661703 - DNA, 25 bp, Homo sapien
tgagctgccaggtttcacatgcaaa

SEQ ID NO: 661704 - DNA, 25 bp, Homo sapien
aggtttcacatgcaaagggctggct

SEQ ID NO: 661705 - DNA, 25 bp, Homo sapien
gctgggaatcaagaggcccttcttc

SEQ ID NO: 661706 - DNA, 25 bp, Homo sapien
gcccttcttctcacgttaaagcgta

SEQ ID NO: 661707 - DNA, 25 bp, Homo sapien
aagcgtagcagtctgttctgttctc

SEQ ID NO: 661708 - DNA, 25 bp, Homo sapien
tcccagttctggaatacctttgtct

SEQ ID NO: 661709 - DNA, 25 bp, Homo sapien
gaatacctttgtctcttgggttctc

SEQ ID NO: 661710 - DNA, 25 bp, Homo sapien
tgtacacactccctcagagagctga

SEQ ID NO: 661711 - DNA, 25 bp, Homo sapien
gagagctgagctcttacttggctct

SEQ ID NO: 661712 - DNA, 25 bp, Homo sapien
tggctctctatccacctgtatggga

SEQ ID NO: 661713 - DNA, 25 bp, Homo sapien
tgtatgggatgactcccaaccaacc

SEQ ID NO: 661714 - DNA, 25 bp, Homo sapien
aatcgcctactccatatttccgttt

SEQ ID NO: 661715 - DNA, 25 bp, Homo sapien
ctcagcacctcatatccaagatggg

SEQ ID NO: 661716 - DNA, 25 bp, Homo sapien
tttacccacaaaacaagctcccatt

SEQ ID NO: 661717 - DNA, 25 bp, Homo sapien
cccattcctcaaatttcccaagtat

SEQ ID NO: 661718 - DNA, 25 bp, Homo sapien
tgttattcatttcatctcttcccat

SEQ ID NO: 661719 - DNA, 25 bp, Homo sapien
gctgtcagttcagtgaggagtctga

SEQ ID NO: 661720 - DNA, 25 bp, Homo sapien
agttcagtgaggagtctgagcccaa

SEQ ID NO: 661721 - DNA, 25 bp, Homo sapien
gccctgcaaggccagacagctgatt

SEQ ID NO: 661722 - DNA, 25 bp, Homo sapien
tgcaaggccagacagctgattacat

SEQ ID NO: 661723 - DNA, 25 bp, Homo sapien
aggccagacagctgattacatacag

SEQ ID NO: 661724 - DNA, 25 bp, Homo sapien
agacagctgattacatacaggagaa

SEQ ID NO: 661725 - DNA, 25 bp, Homo sapien
aaactatattgaggctaatgggagc

SEQ ID NO: 661726 - DNA, 25 bp, Homo sapien
gaagggagttacaagtacagaaata

SEQ ID NO: 661727 - DNA, 25 bp, Homo sapien
agaagtttgtgtgattggattggaa

SEQ ID NO: 661728 - DNA, 25 bp, Homo sapien
attggagatattcatgtaaagtcat

SEQ ID NO: 661729 - DNA, 25 bp, Homo sapien
aagtcatggttcttaatacatgtag

SEQ ID NO: 661730 - DNA, 25 bp, Homo sapien
gaagaagacagcagcttgcgagtca

SEQ ID NO: 661731 - DNA, 25 bp, Homo sapien
aagacagcagcttgcgagtcagccc

SEQ ID NO: 661732 - DNA, 25 bp, Homo sapien
agcttgcgagtcagccccttgcgta

SEQ ID NO: 661733 - DNA, 25 bp, Homo sapien
gcgagtcagccccttgcgtaagact

SEQ ID NO: 661734 - DNA, 25 bp, Homo sapien
agccccttgcgtaagactccacagg

SEQ ID NO: 661735 - DNA, 25 bp, Homo sapien
ccttgcgtaagactccacaggagcg

SEQ ID NO: 661736 - DNA, 25 bp, Homo sapien
aagactccacaggagcgggcggcgg

SEQ ID NO: 661737 - DNA, 25 bp, Homo sapien
ctgagcgctagagccggacagccag

SEQ ID NO: 661738 - DNA, 25 bp, Homo sapien
tagagccggacagccaggcgcgaca

SEQ ID NO: 661739 - DNA, 25 bp, Homo sapien
cgacagagccgccgccatatagaga

SEQ ID NO: 661740 - DNA, 25 bp, Homo sapien
gccatatagagaccggcgctcccac

SEQ ID NO: 661741 - DNA, 25 bp, Homo sapien
acatgatatcacactattactaaac

SEQ ID NO: 661742 - DNA, 25 bp, Homo sapien
acactattactaaacttctctttca

SEQ ID NO: 661743 - DNA, 25 bp, Homo sapien
acttctctttcatatgctgttaaag

SEQ ID NO: 661744 - DNA, 25 bp, Homo sapien
gctgttaaagcacaagcaatgagtg

SEQ ID NO: 661745 - DNA, 25 bp, Homo sapien
caagcaatgagtgaattttctgtag

SEQ ID NO: 661746 - DNA, 25 bp, Homo sapien
tagggtagatggtagatgccaaaat

SEQ ID NO: 661747 - DNA, 25 bp, Homo sapien
aatgatagattctttccaccgcaat

SEQ ID NO: 661748 - DNA, 25 bp, Homo sapien
gatagattctttccaccgcaatcac

SEQ ID NO: 661749 - DNA, 25 bp, Homo sapien
gcctttctctgcagttaagagtcca

SEQ ID NO: 661750 - DNA, 25 bp, Homo sapien
ttaagagtccatcttgattttaggg

SEQ ID NO: 661751 - DNA, 25 bp, Homo sapien
ggatcctggcaagttgaggatttca

SEQ ID NO: 661752 - DNA, 25 bp, Homo sapien
ttgccattcaaggtactaaaatttt

SEQ ID NO: 661753 - DNA, 25 bp, Homo sapien
agaatgtcaattcaaatgggttatt

SEQ ID NO: 661754 - DNA, 25 bp, Homo sapien
atgtcaattcaaatgggttattcac

SEQ ID NO: 661755 - DNA, 25 bp, Homo sapien
gtcaattcaaatgggttattcacct

SEQ ID NO: 661756 - DNA, 25 bp, Homo sapien
aattcaaatgggttattcacctttg

SEQ ID NO: 661757 - DNA, 25 bp, Homo sapien
tcaaatgggttattcacctttgaaa

SEQ ID NO: 661758 - DNA, 25 bp, Homo sapien
atgggttattcacctttgaaaagag

SEQ ID NO: 661759 - DNA, 25 bp, Homo sapien
tgggttattcacctttgaaaagagg

SEQ ID NO: 661760 - DNA, 25 bp, Homo sapien
ctttgaaaagaggtgactatagttt

SEQ ID NO: 661761 - DNA, 25 bp, Homo sapien
gacaaacatttaacatgatggatat

SEQ ID NO: 661762 - DNA, 25 bp, Homo sapien
tctttacaaatcacatgaatgtatc

SEQ ID NO: 661763 - DNA, 25 bp, Homo sapien
gtggattcccttaaaaccatcctgt

SEQ ID NO: 661764 - DNA, 25 bp, Homo sapien
tgtgcctgcatatcccttgaaaaat

SEQ ID NO: 661765 - DNA, 25 bp, Homo sapien
gtacatgggtacctgtagcaagcta

SEQ ID NO: 661766 - DNA, 25 bp, Homo sapien
gcaagctaggtcaaagaacactgta

SEQ ID NO: 661767 - DNA, 25 bp, Homo sapien
tatagtaagtagtgcctggctgtat

SEQ ID NO: 661768 - DNA, 25 bp, Homo sapien
gtgcctggctgtataacaaatatgt

SEQ ID NO: 661769 - DNA, 25 bp, Homo sapien
gttgtgtcacactggacaagtcact

SEQ ID NO: 661770 - DNA, 25 bp, Homo sapien
caagtcacttgaccccttgggtcta

SEQ ID NO: 661771 - DNA, 25 bp, Homo sapien
gcccttgtccctgatttaaggctaa

SEQ ID NO: 661772 - DNA, 25 bp, Homo sapien
aaggctaacacatctttttgcacag

SEQ ID NO: 661773 - DNA, 25 bp, Homo sapien
atctttttgcacagagtggctggga

SEQ ID NO: 661774 - DNA, 25 bp, Homo sapien
gaggaagccgatggctctgggttca

SEQ ID NO: 661775 - DNA, 25 bp, Homo sapien
ggttcaaatcctcaagtacaaatgg

SEQ ID NO: 661776 - DNA, 25 bp, Homo sapien
gttcaaatcctcaagtacaaatggt

SEQ ID NO: 661777 - DNA, 25 bp, Homo sapien
aaatcctcaagtacaaatggtgtga

SEQ ID NO: 661778 - DNA, 25 bp, Homo sapien
aatcctcaagtacaaatggtgtgat

SEQ ID NO: 661779 - DNA, 25 bp, Homo sapien
cctcaagtacaaatggtgtgatacc

SEQ ID NO: 661780 - DNA, 25 bp, Homo sapien
gtacaaatggtgtgataccaggcaa

SEQ ID NO: 661781 - DNA, 25 bp, Homo sapien
caaatggtgtgataccaggcaaagc

SEQ ID NO: 661782 - DNA, 25 bp, Homo sapien
ggtgtgataccaggcaaagcatgac

SEQ ID NO: 661783 - DNA, 25 bp, Homo sapien
gtgataccaggcaaagcatgacacc

SEQ ID NO: 661784 - DNA, 25 bp, Homo sapien
caaagcatgacacctccctgacgct

SEQ ID NO: 661785 - DNA, 25 bp, Homo sapien
ccacctacttggctttaccagagag

SEQ ID NO: 661786 - DNA, 25 bp, Homo sapien
ttaccagagagcaatgcagcagcca

SEQ ID NO: 661787 - DNA, 25 bp, Homo sapien
cagagagcaatgcagcagccaccac

SEQ ID NO: 661788 - DNA, 25 bp, Homo sapien
agtagtcacaaactgcccaagcacc

SEQ ID NO: 661789 - DNA, 25 bp, Homo sapien
tcacaaactgcccaagcaccttttt

SEQ ID NO: 661790 - DNA, 25 bp, Homo sapien
gtggtggtgatgatgcatttacctt

SEQ ID NO: 661791 - DNA, 25 bp, Homo sapien
gatgatgcatttaccttatcgagct

SEQ ID NO: 661792 - DNA, 25 bp, Homo sapien
gcatttaccttatcgagctattgtg

SEQ ID NO: 661793 - DNA, 25 bp, Homo sapien
ttaccttatcgagctattgtgaata

SEQ ID NO: 661794 - DNA, 25 bp, Homo sapien
aatcaggtgacttgcattgaatcaa

SEQ ID NO: 661795 - DNA, 25 bp, Homo sapien
caggtgacttgcattgaatcaataa

SEQ ID NO: 661796 - DNA, 25 bp, Homo sapien
tctgtgatgtcaaaattcccttctc

SEQ ID NO: 661797 - DNA, 25 bp, Homo sapien
ccttctccataggtaacagatccta

SEQ ID NO: 661798 - DNA, 25 bp, Homo sapien
ggtaacagatcctatctggctactt

SEQ ID NO: 661799 - DNA, 25 bp, Homo sapien
gatcctatctggctacttttcatta

SEQ ID NO: 661800 - DNA, 25 bp, Homo sapien
atctggctacttttcattattaagg

SEQ ID NO: 661801 - DNA, 25 bp, Homo sapien
ggagatgtctcggattttttgtgca

SEQ ID NO: 661802 - DNA, 25 bp, Homo sapien
tgtctcggattttttgtgcacaaat

SEQ ID NO: 661803 - DNA, 25 bp, Homo sapien
gtgcacaaattgtcctcagaaccaa

SEQ ID NO: 661804 - DNA, 25 bp, Homo sapien
aaccagcataggagagaattcacaa

SEQ ID NO: 661805 - DNA, 25 bp, Homo sapien
gaattcacaaagtaagagactcata

SEQ ID NO: 661806 - DNA, 25 bp, Homo sapien
acatgtgtaaatcattctgttacta

SEQ ID NO: 661807 - DNA, 25 bp, Homo sapien
gaagtcaaaatgaagtctcaccata

SEQ ID NO: 661808 - DNA, 25 bp, Homo sapien
agtctcaccatattgatcagactgg

SEQ ID NO: 661809 - DNA, 25 bp, Homo sapien
gtcctggcttcaaatgatcttccct

SEQ ID NO: 661810 - DNA, 25 bp, Homo sapien
gggattatagagcttgcagacaaca

SEQ ID NO: 661811 - DNA, 25 bp, Homo sapien
caacagatcatggaacttcttggcc

SEQ ID NO: 661812 - DNA, 25 bp, Homo sapien
ataatctcatgagccaatttctgta

SEQ ID NO: 661813 - DNA, 25 bp, Homo sapien
gaaccttggctaatatacacacaca

SEQ ID NO: 661814 - DNA, 25 bp, Homo sapien
atacacacacaccatgattgatagt

SEQ ID NO: 661815 - DNA, 25 bp, Homo sapien
accatgattgatagtggatgcccaa

SEQ ID NO: 661816 - DNA, 25 bp, Homo sapien
gtggatgcccaataaatgcattcca

SEQ ID NO: 661817 - DNA, 25 bp, Homo sapien
atggatgcccaataaatatgtgtaa

SEQ ID NO: 661818 - DNA, 25 bp, Homo sapien
aaattgagtccacggaacactgttc

SEQ ID NO: 661819 - DNA, 25 bp, Homo sapien
gtccacggaacactgttcagcattt

SEQ ID NO: 661820 - DNA, 25 bp, Homo sapien
ttttttgacaaccaagattcatctt

SEQ ID NO: 661821 - DNA, 25 bp, Homo sapien
gattcatctttgacaatttcatgca

SEQ ID NO: 661822 - DNA, 25 bp, Homo sapien
aatttcatgcattgtattatggtga

SEQ ID NO: 661823 - DNA, 25 bp, Homo sapien
atgatgtttctcctggcatgttgtt

SEQ ID NO: 661824 - DNA, 25 bp, Homo sapien
cctggcatgttgtttacagtggttt

SEQ ID NO: 661825 - DNA, 25 bp, Homo sapien
tacagtggtttatgtccatactaac

SEQ ID NO: 661826 - DNA, 25 bp, Homo sapien
tgtccatactaactgatgctggatt

SEQ ID NO: 661827 - DNA, 25 bp, Homo sapien
atgctggattgttctgtttgaggtc

SEQ ID NO: 661828 - DNA, 25 bp, Homo sapien
ctgtttgaggtctgttgtcttcctc

SEQ ID NO: 661829 - DNA, 25 bp, Homo sapien
tgaaactgacgagttgttgaaggca

SEQ ID NO: 661830 - DNA, 25 bp, Homo sapien
gataagatcatttgttcagcagaat

SEQ ID NO: 661831 - DNA, 25 bp, Homo sapien
gttcagcagaattcagaaagacgta

SEQ ID NO: 661832 - DNA, 25 bp, Homo sapien
gaggatgaagacagccacgagtaat

SEQ ID NO: 661833 - DNA, 25 bp, Homo sapien
cacgagtaatctcccacctcaagtg

SEQ ID NO: 661834 - DNA, 25 bp, Homo sapien
acctcaagtgattctgagagctcat

SEQ ID NO: 661835 - DNA, 25 bp, Homo sapien
gaagaccaagacctatctcatctct

SEQ ID NO: 661836 - DNA, 25 bp, Homo sapien
ctatctcatctctaggttaacctct

SEQ ID NO: 661837 - DNA, 25 bp, Homo sapien
acctctagaaatggtctcctgtgca

SEQ ID NO: 661838 - DNA, 25 bp, Homo sapien
atggtctcctgtgcagagaaactac

SEQ ID NO: 661839 - DNA, 25 bp, Homo sapien
gagaaactacatattgcaccaagat

SEQ ID NO: 661840 - DNA, 25 bp, Homo sapien
tccttgcctgccttcaatatttttg

SEQ ID NO: 661841 - DNA, 25 bp, Homo sapien
caatatttttggctttcttcccttg

SEQ ID NO: 661842 - DNA, 25 bp, Homo sapien
ccttgctttgctgggatgtgtgatt

SEQ ID NO: 661843 - DNA, 25 bp, Homo sapien
gtgtgatttatcctatcaccggaga

SEQ ID NO: 661844 - DNA, 25 bp, Homo sapien
tatcaccggagatctctgtgagaaa

SEQ ID NO: 661845 - DNA, 25 bp, Homo sapien
agcactggatgtttatttgcctgca

SEQ ID NO: 661846 - DNA, 25 bp, Homo sapien
tatttgcctgcatatgtcagaagct

SEQ ID NO: 661847 - DNA, 25 bp, Homo sapien
ggagccattcatttccatgtgcctt

SEQ ID NO: 661848 - DNA, 25 bp, Homo sapien
catgtgccttgcacagcctgtgcgg

SEQ ID NO: 661849 - DNA, 25 bp, Homo sapien
tgtgcggccacaatcggcagcactg

SEQ ID NO: 661850 - DNA, 25 bp, Homo sapien
tcggcagcactgagtttgggcaaca

SEQ ID NO: 661851 - DNA, 25 bp, Homo sapien
aaatcagatcttttttgccatcccc

SEQ ID NO: 661852 - DNA, 25 bp, Homo sapien
tccccccaatgcattctcaaatgta

SEQ ID NO: 661853 - DNA, 25 bp, Homo sapien
tcaaatgtatacctcccttcccaat

SEQ ID NO: 661854 - DNA, 25 bp, Homo sapien
gaacttacaggttacaaggttgaga

SEQ ID NO: 661855 - DNA, 25 bp, Homo sapien
aattgttcagttgaatgattcacag

SEQ ID NO: 661856 - DNA, 25 bp, Homo sapien
gattcacaggtatattcaggcctaa

SEQ ID NO: 661857 - DNA, 25 bp, Homo sapien
tattcaggcctaaaaatccatgctt

SEQ ID NO: 661858 - DNA, 25 bp, Homo sapien
atgctttatatttctcgtctgtaac

SEQ ID NO: 661859 - DNA, 25 bp, Homo sapien
tatttctcgtctgtaacacgggacc

SEQ ID NO: 661860 - DNA, 25 bp, Homo sapien
tgtaacacgggacccctctttcaga

SEQ ID NO: 661861 - DNA, 25 bp, Homo sapien
gacccctctttcagagttgttgtga

SEQ ID NO: 661862 - DNA, 25 bp, Homo sapien
aaaatagctagaagatggccaggca

SEQ ID NO: 661863 - DNA, 25 bp, Homo sapien
aaatagctagaagatggccaggcac

SEQ ID NO: 661864 - DNA, 25 bp, Homo sapien
aatagctagaagatggccaggcacc

SEQ ID NO: 661865 - DNA, 25 bp, Homo sapien
atagctagaagatggccaggcacca

SEQ ID NO: 661866 - DNA, 25 bp, Homo sapien
tagctagaagatggccaggcaccat

SEQ ID NO: 661867 - DNA, 25 bp, Homo sapien
agctagaagatggccaggcaccatg

SEQ ID NO: 661868 - DNA, 25 bp, Homo sapien
gctagaagatggccaggcaccatgg

SEQ ID NO: 661869 - DNA, 25 bp, Homo sapien
ctagaagatggccaggcaccatggc

SEQ ID NO: 661870 - DNA, 25 bp, Homo sapien
tagaagatggccaggcaccatggct

SEQ ID NO: 661871 - DNA, 25 bp, Homo sapien
agaagatggccaggcaccatggctc

SEQ ID NO: 661872 - DNA, 25 bp, Homo sapien
gaagatggccaggcaccatggctca

SEQ ID NO: 661873 - DNA, 25 bp, Homo sapien
attgattgaatctttctacactgat

SEQ ID NO: 661874 - DNA, 25 bp, Homo sapien
cactgatttgtaatactccgctatc

SEQ ID NO: 661875 - DNA, 25 bp, Homo sapien
tccgctatcatattcaaaacctgtg

SEQ ID NO: 661876 - DNA, 25 bp, Homo sapien
tctgttctgtgagtgctgtgagttt

SEQ ID NO: 661877 - DNA, 25 bp, Homo sapien
agtgctgtgagttttgtgtgtgcca

SEQ ID NO: 661878 - DNA, 25 bp, Homo sapien
gtgtgccagttttattctaggctgt

SEQ ID NO: 661879 - DNA, 25 bp, Homo sapien
tctaggctgtattttttcccggcat

SEQ ID NO: 661880 - DNA, 25 bp, Homo sapien
tttcccggcattttataattagcat

SEQ ID NO: 661881 - DNA, 25 bp, Homo sapien
gttaggattgttcttggctactctt

SEQ ID NO: 661882 - DNA, 25 bp, Homo sapien
gttcttggctactcttggtccttta

SEQ ID NO: 661883 - DNA, 25 bp, Homo sapien
cttggtcctttactcttcaatatga

SEQ ID NO: 661884 - DNA, 25 bp, Homo sapien
taagcaggcatgagaacgcccttct

SEQ ID NO: 661885 - DNA, 25 bp, Homo sapien
aacgcccttctctctgcaagaagat

SEQ ID NO: 661886 - DNA, 25 bp, Homo sapien
aagatgcccgcccttaccaaggtga

SEQ ID NO: 661887 - DNA, 25 bp, Homo sapien
aggaacctgaaacctcgtccttgat

SEQ ID NO: 661888 - DNA, 25 bp, Homo sapien
gtccttgatcgactcgtggtgttga

SEQ ID NO: 661889 - DNA, 25 bp, Homo sapien
tcgtggtgttgaaggccctgccaaa

SEQ ID NO: 661890 - DNA, 25 bp, Homo sapien
acgggagatggcattccgggtctaa

SEQ ID NO: 661891 - DNA, 25 bp, Homo sapien
ttccgggtctaaattctcgtgggtg

SEQ ID NO: 661892 - DNA, 25 bp, Homo sapien
tcagctgtcaggaggtgccaggctt

SEQ ID NO: 661893 - DNA, 25 bp, Homo sapien
gaccgtggttttctgtcattgtaac

SEQ ID NO: 661894 - DNA, 25 bp, Homo sapien
gaatggctaagtcctgtctatgaca

SEQ ID NO: 661895 - DNA, 25 bp, Homo sapien
attgatagaatatcagtgtccacag

SEQ ID NO: 661896 - DNA, 25 bp, Homo sapien
acagaattaagactgcaagcacagc

SEQ ID NO: 661897 - DNA, 25 bp, Homo sapien
gcaagcacagcaaagacacccatat

SEQ ID NO: 661898 - DNA, 25 bp, Homo sapien
gacacccatattgaatgttccctta

SEQ ID NO: 661899 - DNA, 25 bp, Homo sapien
gaatgttcccttaaattgcttttat

SEQ ID NO: 661900 - DNA, 25 bp, Homo sapien
tgaagtgttatagagggcccaggaa

SEQ ID NO: 661901 - DNA, 25 bp, Homo sapien
ggaaactaagttgagcccacctgac

SEQ ID NO: 661902 - DNA, 25 bp, Homo sapien
ctgaccctgtgatgaatcttggaac

SEQ ID NO: 661903 - DNA, 25 bp, Homo sapien
gaatcttggaacttccgtctcttga

SEQ ID NO: 661904 - DNA, 25 bp, Homo sapien
ggaacttccgtctcttgaatacatt

SEQ ID NO: 661905 - DNA, 25 bp, Homo sapien
acattcttagtagtagcttcttggc

SEQ ID NO: 661906 - DNA, 25 bp, Homo sapien
tgttcgtacatctactctccttcta

SEQ ID NO: 661907 - DNA, 25 bp, Homo sapien
ttcgtacatctactctccttctaaa

SEQ ID NO: 661908 - DNA, 25 bp, Homo sapien
cgtacatctactctccttctaaaat

SEQ ID NO: 661909 - DNA, 25 bp, Homo sapien
tgcagctcagggtcgccatcacggt

SEQ ID NO: 661910 - DNA, 25 bp, Homo sapien
gctcagggtcgccatcacggtccta

SEQ ID NO: 661911 - DNA, 25 bp, Homo sapien
tgtctgctctcaaactctctttcct

SEQ ID NO: 661912 - DNA, 25 bp, Homo sapien
tgctctcaaactctctttcctgtta

SEQ ID NO: 661913 - DNA, 25 bp, Homo sapien
ctctcaaactctctttcctgttaag

SEQ ID NO: 661914 - DNA, 25 bp, Homo sapien
tcaaactctctttcctgttaagatg

SEQ ID NO: 661915 - DNA, 25 bp, Homo sapien
tgtgatcttttattgccctttgaag

SEQ ID NO: 661916 - DNA, 25 bp, Homo sapien
tgatcttttattgccctttgaagca

SEQ ID NO: 661917 - DNA, 25 bp, Homo sapien
agaatcagagattgaaacaaggctt

SEQ ID NO: 661918 - DNA, 25 bp, Homo sapien
gagattgaaacaaggcttgggctga

SEQ ID NO: 661919 - DNA, 25 bp, Homo sapien
tgaaacaaggcttgggctgagcacg

SEQ ID NO: 661920 - DNA, 25 bp, Homo sapien
ataaccccagcacgttgggatgcct

SEQ ID NO: 661921 - DNA, 25 bp, Homo sapien
aaccccagcacgttgggatgcctag

SEQ ID NO: 661922 - DNA, 25 bp, Homo sapien
ccccagcacgttgggatgcctaggt

SEQ ID NO: 661923 - DNA, 25 bp, Homo sapien
aaccacaaaaaacgagccaggcatt

SEQ ID NO: 661924 - DNA, 25 bp, Homo sapien
gtggaatgatagattgagcctgaga

SEQ ID NO: 661925 - DNA, 25 bp, Homo sapien
ggaatgatagattgagcctgagagt

SEQ ID NO: 661926 - DNA, 25 bp, Homo sapien
gaatgatagattgagcctgagagtt

SEQ ID NO: 661927 - DNA, 25 bp, Homo sapien
atagattgagcctgagagttcaagg

SEQ ID NO: 661928 - DNA, 25 bp, Homo sapien
cgttatctaaactcaagcatttctt

SEQ ID NO: 661929 - DNA, 25 bp, Homo sapien
agcatttctttatggtgaattcaac

SEQ ID NO: 661930 - DNA, 25 bp, Homo sapien
ttatggtgaattcaactctttaggc

SEQ ID NO: 661931 - DNA, 25 bp, Homo sapien
aaactttgaagccacctgtgacctg

SEQ ID NO: 661932 - DNA, 25 bp, Homo sapien
agatatcccacctttccagtacaaa

SEQ ID NO: 661933 - DNA, 25 bp, Homo sapien
tatcccacctttccagtacaaacta

SEQ ID NO: 661934 - DNA, 25 bp, Homo sapien
tgtctttgcctgtaatttccgtgtc

SEQ ID NO: 661935 - DNA, 25 bp, Homo sapien
gtaatttccgtgtctccctaaaatg

SEQ ID NO: 661936 - DNA, 25 bp, Homo sapien
tgtataaaaccaacgtgtaatccaa

SEQ ID NO: 661937 - DNA, 25 bp, Homo sapien
atgtttacaggaccccctaaggctg

SEQ ID NO: 661938 - DNA, 25 bp, Homo sapien
tgtgtcacaggccataatccttatc

SEQ ID NO: 661939 - DNA, 25 bp, Homo sapien
agctcccggctctggtacacgcttt

SEQ ID NO: 661940 - DNA, 25 bp, Homo sapien
tggtacacgctttctccccagacgg

SEQ ID NO: 661941 - DNA, 25 bp, Homo sapien
tgcacccttatcacactgtttgatt

SEQ ID NO: 661942 - DNA, 25 bp, Homo sapien
gtatgtaatggtgtgctgtctgctt

SEQ ID NO: 661943 - DNA, 25 bp, Homo sapien
atgtaatggtgtgctgtctgcttct

SEQ ID NO: 661944 - DNA, 25 bp, Homo sapien
tctgcttctcctgctaaaatgttaa

SEQ ID NO: 661945 - DNA, 25 bp, Homo sapien
ctgctaaaatgttaactgccagttt

SEQ ID NO: 661946 - DNA, 25 bp, Homo sapien
taactgccagtttgtcttatctgct

SEQ ID NO: 661947 - DNA, 25 bp, Homo sapien
gtcttatctgctgatgtgtccccat

SEQ ID NO: 661948 - DNA, 25 bp, Homo sapien
gcagagcctctgcacatagtaaggg

SEQ ID NO: 661949 - DNA, 25 bp, Homo sapien
catagtaagggcccagtaagtatct

SEQ ID NO: 661950 - DNA, 25 bp, Homo sapien
gaaataacaactgctctggatcaag

SEQ ID NO: 661951 - DNA, 25 bp, Homo sapien
acaactgctctggatcaagtccagg

SEQ ID NO: 661952 - DNA, 25 bp, Homo sapien
tccaggaacagatattgggactaga

SEQ ID NO: 661953 - DNA, 25 bp, Homo sapien
tgggactagaaagagggattttcca

SEQ ID NO: 661954 - DNA, 25 bp, Homo sapien
aaaatggaaatgctactatgtgaaa

SEQ ID NO: 661955 - DNA, 25 bp, Homo sapien
gaaactctggcacttttttggctat

SEQ ID NO: 661956 - DNA, 25 bp, Homo sapien
gccatgtgtacagtatgagctatca

SEQ ID NO: 661957 - DNA, 25 bp, Homo sapien
gtacagtatgagctatcatgcttta

SEQ ID NO: 661958 - DNA, 25 bp, Homo sapien
agctatcatgctttatcaagtctga

SEQ ID NO: 661959 - DNA, 25 bp, Homo sapien
tcatgctttatcaagtctgaagaac

SEQ ID NO: 661960 - DNA, 25 bp, Homo sapien
taataacctcctaataaagtacatt

SEQ ID NO: 661961 - DNA, 25 bp, Homo sapien
aaaatgtattttagtcaggccaggc

SEQ ID NO: 661962 - DNA, 25 bp, Homo sapien
aaatgtattttagtcaggccaggcg

SEQ ID NO: 661963 - DNA, 25 bp, Homo sapien
aatgtattttagtcaggccaggcgc

SEQ ID NO: 661964 - DNA, 25 bp, Homo sapien
atgtattttagtcaggccaggcgcg

SEQ ID NO: 661965 - DNA, 25 bp, Homo sapien
tgtattttagtcaggccaggcgcgg

SEQ ID NO: 661966 - DNA, 25 bp, Homo sapien
gtattttagtcaggccaggcgcggt

SEQ ID NO: 661967 - DNA, 25 bp, Homo sapien
tattttagtcaggccaggcgcggtg

SEQ ID NO: 661968 - DNA, 25 bp, Homo sapien
attttagtcaggccaggcgcggtgg

SEQ ID NO: 661969 - DNA, 25 bp, Homo sapien
aattggccgacgtggtggcgggtgc

SEQ ID NO: 661970 - DNA, 25 bp, Homo sapien
agtcccagctgttcggaggctgaag

SEQ ID NO: 661971 - DNA, 25 bp, Homo sapien
ccagctgttcggaggctgaagcagg

SEQ ID NO: 661972 - DNA, 25 bp, Homo sapien
gactctgtctctgcaaaaaatacaa

SEQ ID NO: 661973 - DNA, 25 bp, Homo sapien
tgggcttggcggtgcatgtctgtag

SEQ ID NO: 661974 - DNA, 25 bp, Homo sapien
gggcttggcggtgcatgtctgtagt

SEQ ID NO: 661975 - DNA, 25 bp, Homo sapien
ggcttggcggtgcatgtctgtagtc

SEQ ID NO: 661976 - DNA, 25 bp, Homo sapien
gcttggcggtgcatgtctgtagtcc

SEQ ID NO: 661977 - DNA, 25 bp, Homo sapien
cttggcggtgcatgtctgtagtccc

SEQ ID NO: 661978 - DNA, 25 bp, Homo sapien
ttggcggtgcatgtctgtagtccca

SEQ ID NO: 661979 - DNA, 25 bp, Homo sapien
ctatgattgcaccaccatacttcag

SEQ ID NO: 661980 - DNA, 25 bp, Homo sapien
gcaccaccatacttcagcctgggca

SEQ ID NO: 661981 - DNA, 25 bp, Homo sapien
gcaacagagtgaaaccctttgtcaa

SEQ ID NO: 661982 - DNA, 25 bp, Homo sapien
cagagtgaaaccctttgtcaaacaa

SEQ ID NO: 661983 - DNA, 25 bp, Homo sapien
gttagtggagttttactgttaatat

SEQ ID NO: 661984 - DNA, 25 bp, Homo sapien
tgttaatatcatcatgtcccccttt

SEQ ID NO: 661985 - DNA, 25 bp, Homo sapien
atatcatcatgtccccctttgtgtt

SEQ ID NO: 661986 - DNA, 25 bp, Homo sapien
ctttgtgtttactactgtctgaaat

SEQ ID NO: 661987 - DNA, 25 bp, Homo sapien
tgtttactactgtctgaaattactg

SEQ ID NO: 661988 - DNA, 25 bp, Homo sapien
tgggatgtagaagcatatttcagtc

SEQ ID NO: 661989 - DNA, 25 bp, Homo sapien
gaagttgtatcttgttcttgggcat

SEQ ID NO: 661990 - DNA, 25 bp, Homo sapien
gtatcttgttcttgggcatgttagc

SEQ ID NO: 661991 - DNA, 25 bp, Homo sapien
tgttcttgggcatgttagccttgtt

SEQ ID NO: 661992 - DNA, 25 bp, Homo sapien
tgttagccttgtttttcatcccaat

SEQ ID NO: 661993 - DNA, 25 bp, Homo sapien
agccttgtttttcatcccaatttga

SEQ ID NO: 661994 - DNA, 25 bp, Homo sapien
agagctgtataacaagagctacaag

SEQ ID NO: 661995 - DNA, 25 bp, Homo sapien
aagagtaacagcgacttgtgccaat

SEQ ID NO: 661996 - DNA, 25 bp, Homo sapien
aacagcgacttgtgccaatcatatg

SEQ ID NO: 661997 - DNA, 25 bp, Homo sapien
ttgtgccaatcatatgttctcctcc

SEQ ID NO: 661998 - DNA, 25 bp, Homo sapien
caatcatatgttctcctcccttctg

SEQ ID NO: 661999 - DNA, 25 bp, Homo sapien
ttctgcccactccatgacaaagcat

SEQ ID NO: 662000 - DNA, 25 bp, Homo sapien
atgacaaagcatgacacaggaatga

SEQ ID NO: 662001 - DNA, 25 bp, Homo sapien
gggagaggactcagactacctccac

SEQ ID NO: 662002 - DNA, 25 bp, Homo sapien
gactacctccactacatttttgtat

SEQ ID NO: 662003 - DNA, 25 bp, Homo sapien
tacatttttgtataggtgagggtcc

SEQ ID NO: 662004 - DNA, 25 bp, Homo sapien
gtatgtataagtgaatctcagactt

SEQ ID NO: 662005 - DNA, 25 bp, Homo sapien
gcatggtggcaggtggcaggtgcct

SEQ ID NO: 662006 - DNA, 25 bp, Homo sapien
catggtggcaggtggcaggtgccta

SEQ ID NO: 662007 - DNA, 25 bp, Homo sapien
atggtggcaggtggcaggtgcctat

SEQ ID NO: 662008 - DNA, 25 bp, Homo sapien
tggtggcaggtggcaggtgcctata

SEQ ID NO: 662009 - DNA, 25 bp, Homo sapien
ggtggcaggtggcaggtgcctataa

SEQ ID NO: 662010 - DNA, 25 bp, Homo sapien
gtggcaggtggcaggtgcctataat

SEQ ID NO: 662011 - DNA, 25 bp, Homo sapien
tggcaggtggcaggtgcctataatc

SEQ ID NO: 662012 - DNA, 25 bp, Homo sapien
ggcaggtggcaggtgcctataatcc

SEQ ID NO: 662013 - DNA, 25 bp, Homo sapien
gcaggtggcaggtgcctataatccc

SEQ ID NO: 662014 - DNA, 25 bp, Homo sapien
aggcccagtctatgaagcaagtaaa

SEQ ID NO: 662015 - DNA, 25 bp, Homo sapien
aagtaaacgtgcctactgcctcagt

SEQ ID NO: 662016 - DNA, 25 bp, Homo sapien
agtcgggagtcctagagatgctgtc

SEQ ID NO: 662017 - DNA, 25 bp, Homo sapien
agagatgctgtctgtgctcactctg

SEQ ID NO: 662018 - DNA, 25 bp, Homo sapien
gagcctttgagctctaaggcaccca

SEQ ID NO: 662019 - DNA, 25 bp, Homo sapien
aaggcacccagcttgcagtaccatt

SEQ ID NO: 662020 - DNA, 25 bp, Homo sapien
attctagcaactgagtaggccccac

SEQ ID NO: 662021 - DNA, 25 bp, Homo sapien
aggccccacttgcacatggcatggt

SEQ ID NO: 662022 - DNA, 25 bp, Homo sapien
gtgccaggtggatcgggttccccaa

SEQ ID NO: 662023 - DNA, 25 bp, Homo sapien
atcgatggtaggaatctctccgcac

SEQ ID NO: 662024 - DNA, 25 bp, Homo sapien
tctccgcactagttgcttagtcaga

SEQ ID NO: 662025 - DNA, 25 bp, Homo sapien
gaacacaataattaaatcctggctg

SEQ ID NO: 662026 - DNA, 25 bp, Homo sapien
cacaataattaaatcctggctgggt

SEQ ID NO: 662027 - DNA, 25 bp, Homo sapien
acaataattaaatcctggctgggtg

SEQ ID NO: 662028 - DNA, 25 bp, Homo sapien
tggctgggtgtgatgacccacatct

SEQ ID NO: 662029 - DNA, 25 bp, Homo sapien
tgggtgtgatgacccacatctgtaa

SEQ ID NO: 662030 - DNA, 25 bp, Homo sapien
ggtgtgatgacccacatctgtaatg

SEQ ID NO: 662031 - DNA, 25 bp, Homo sapien
gtgtgatgacccacatctgtaatgc

SEQ ID NO: 662032 - DNA, 25 bp, Homo sapien
tgtgatgacccacatctgtaatgcc

SEQ ID NO: 662033 - DNA, 25 bp, Homo sapien
gtgatgacccacatctgtaatgcca

SEQ ID NO: 662034 - DNA, 25 bp, Homo sapien
gatgacccacatctgtaatgccagc

SEQ ID NO: 662035 - DNA, 25 bp, Homo sapien
atgacccacatctgtaatgccagca

SEQ ID NO: 662036 - DNA, 25 bp, Homo sapien
ttctccattttcctccatggtggtc

SEQ ID NO: 662037 - DNA, 25 bp, Homo sapien
atggtggtcctacaaattgctgccc

SEQ ID NO: 662038 - DNA, 25 bp, Homo sapien
gtggtcctacaaattgctgccccag

SEQ ID NO: 662039 - DNA, 25 bp, Homo sapien
aaattgctgccccagccatatttta

SEQ ID NO: 662040 - DNA, 25 bp, Homo sapien
tgctgccccagccatattttaaatc

SEQ ID NO: 662041 - DNA, 25 bp, Homo sapien
gccccagccatattttaaatcccta

SEQ ID NO: 662042 - DNA, 25 bp, Homo sapien
taaatccctatgtctagggtagttt

SEQ ID NO: 662043 - DNA, 25 bp, Homo sapien
gttaggtatttttgacttcctgatc

SEQ ID NO: 662044 - DNA, 25 bp, Homo sapien
gacttcctgatcaactaatagccta

SEQ ID NO: 662045 - DNA, 25 bp, Homo sapien
aaacaatgcatttaacaaggcaggg

SEQ ID NO: 662046 - DNA, 25 bp, Homo sapien
ataggatagtttgacccaggagttt

SEQ ID NO: 662047 - DNA, 25 bp, Homo sapien
aaacacaatggtagtatgctatact

SEQ ID NO: 662048 - DNA, 25 bp, Homo sapien
atgctatactggcttgttttactta

SEQ ID NO: 662049 - DNA, 25 bp, Homo sapien
actggcttgttttacttatgaatat

SEQ ID NO: 662050 - DNA, 25 bp, Homo sapien
tgcctcgttccattgtacgtatgta

SEQ ID NO: 662051 - DNA, 25 bp, Homo sapien
gtatggtaatgatttaacagtccct

SEQ ID NO: 662052 - DNA, 25 bp, Homo sapien
aacagtccctaatagctggacattt

SEQ ID NO: 662053 - DNA, 25 bp, Homo sapien
gacatttagattgccagtattttcc

SEQ ID NO: 662054 - DNA, 25 bp, Homo sapien
gtacaggtacatctatctgtaggat

SEQ ID NO: 662055 - DNA, 25 bp, Homo sapien
tcctagaaagttgaattgctggttc

SEQ ID NO: 662056 - DNA, 25 bp, Homo sapien
gctggttcaaaggtttgtgcgttct

SEQ ID NO: 662057 - DNA, 25 bp, Homo sapien
aggtttgtgcgttcttaatctgtac

SEQ ID NO: 662058 - DNA, 25 bp, Homo sapien
gaaagatggtgagatatcctgcagg

SEQ ID NO: 662059 - DNA, 25 bp, Homo sapien
ggtgagatatcctgcaggagaccag

SEQ ID NO: 662060 - DNA, 25 bp, Homo sapien
caggagggtggaggcctctcaagaa

SEQ ID NO: 662061 - DNA, 25 bp, Homo sapien
aggcctctcaagaagagggaagcat

SEQ ID NO: 662062 - DNA, 25 bp, Homo sapien
gcaggatggtttacctgcctggaca

SEQ ID NO: 662063 - DNA, 25 bp, Homo sapien
gacagcaagatgatggctacactag

SEQ ID NO: 662064 - DNA, 25 bp, Homo sapien
gcaagatgatggctacactagcccc

SEQ ID NO: 662065 - DNA, 25 bp, Homo sapien
tgggcgcctggatttgcccaccaga

SEQ ID NO: 662066 - DNA, 25 bp, Homo sapien
tggatttgcccaccagatctcctca

SEQ ID NO: 662067 - DNA, 25 bp, Homo sapien
ttcacctcctgctgtacctacaagg

SEQ ID NO: 662068 - DNA, 25 bp, Homo sapien
gtacctacaaggtctccccgattct

SEQ ID NO: 662069 - DNA, 25 bp, Homo sapien
ataatttatttctgcattctcctat

SEQ ID NO: 662070 - DNA, 25 bp, Homo sapien
gaatttgaattctttccacttcggg

SEQ ID NO: 662071 - DNA, 25 bp, Homo sapien
aaagctgctagaaatattattgatg

SEQ ID NO: 662072 - DNA, 25 bp, Homo sapien
gatgtgaagtatagcaactctggtg

SEQ ID NO: 662073 - DNA, 25 bp, Homo sapien
aactctggtgagcaatttggattct

SEQ ID NO: 662074 - DNA, 25 bp, Homo sapien
agcaatttggattctctagttaact

SEQ ID NO: 662075 - DNA, 25 bp, Homo sapien
ggattctctagttaacttgaaaaag

SEQ ID NO: 662076 - DNA, 25 bp, Homo sapien
aagtgtatacactatgacccagcaa

SEQ ID NO: 662077 - DNA, 25 bp, Homo sapien
atgttagagaaactttcatacgtgt

SEQ ID NO: 662078 - DNA, 25 bp, Homo sapien
atgagtaaaaatgtctgtagctgtt

SEQ ID NO: 662079 - DNA, 25 bp, Homo sapien
aatgtctgtagctgttttgttaata

SEQ ID NO: 662080 - DNA, 25 bp, Homo sapien
attctagtgaatagaggtccacaca

SEQ ID NO: 662081 - DNA, 25 bp, Homo sapien
ggtccacacagacaattgctatctt

SEQ ID NO: 662082 - DNA, 25 bp, Homo sapien
ttgctatctttgttagatgctccag

SEQ ID NO: 662083 - DNA, 25 bp, Homo sapien
gatgctccagtaccaagcctaagaa

SEQ ID NO: 662084 - DNA, 25 bp, Homo sapien
agaatcatcttttgctgccatcttt

SEQ ID NO: 662085 - DNA, 25 bp, Homo sapien
cagtataagctgagcatgtgtttga

SEQ ID NO: 662086 - DNA, 25 bp, Homo sapien
catgtgtttgatgcatagcggtgtg

SEQ ID NO: 662087 - DNA, 25 bp, Homo sapien
gtgtgggaactatatactttcttct

SEQ ID NO: 662088 - DNA, 25 bp, Homo sapien
tcttactttccttcagtaaaggagc

SEQ ID NO: 662089 - DNA, 25 bp, Homo sapien
ggagcttagctccattaagcattgt

SEQ ID NO: 662090 - DNA, 25 bp, Homo sapien
gctccattaagcattgttcaagata

SEQ ID NO: 662091 - DNA, 25 bp, Homo sapien
tttctctctttcagatgcagggtgg

SEQ ID NO: 662092 - DNA, 25 bp, Homo sapien
ctctctttcagatgcagggtggtgg

SEQ ID NO: 662093 - DNA, 25 bp, Homo sapien
gcccagactcgaacccctgcaaaaa

SEQ ID NO: 662094 - DNA, 25 bp, Homo sapien
gggctacaggcatgcgacactgcat

SEQ ID NO: 662095 - DNA, 25 bp, Homo sapien
tacaggcatgcgacactgcatccag

SEQ ID NO: 662096 - DNA, 25 bp, Homo sapien
aggcatgcgacactgcatccagcta

SEQ ID NO: 662097 - DNA, 25 bp, Homo sapien
ctgcatccagctaatcctgcaaata

SEQ ID NO: 662098 - DNA, 25 bp, Homo sapien
gcatccagctaatcctgcaaatatt

SEQ ID NO: 662099 - DNA, 25 bp, Homo sapien
ccagctaatcctgcaaatattgtta

SEQ ID NO: 662100 - DNA, 25 bp, Homo sapien
gctaatcctgcaaatattgttaagt

SEQ ID NO: 662101 - DNA, 25 bp, Homo sapien
tgcaaatattgttaagtaaaccggt

SEQ ID NO: 662102 - DNA, 25 bp, Homo sapien
gaaagaaagggatgataggccgggc

SEQ ID NO: 662103 - DNA, 25 bp, Homo sapien
aaagaaagggatgataggccgggcg

SEQ ID NO: 662104 - DNA, 25 bp, Homo sapien
aagaaagggatgataggccgggcgt

SEQ ID NO: 662105 - DNA, 25 bp, Homo sapien
agaaagggatgataggccgggcgtg

SEQ ID NO: 662106 - DNA, 25 bp, Homo sapien
cgaggtcgggagatagagacatggt

SEQ ID NO: 662107 - DNA, 25 bp, Homo sapien
gaggtcgggagatagagacatggtg

SEQ ID NO: 662108 - DNA, 25 bp, Homo sapien
aggtcgggagatagagacatggtga

SEQ ID NO: 662109 - DNA, 25 bp, Homo sapien
ggtcgggagatagagacatggtgaa

SEQ ID NO: 662110 - DNA, 25 bp, Homo sapien
gtcgggagatagagacatggtgaaa

SEQ ID NO: 662111 - DNA, 25 bp, Homo sapien
ctactgatcaaagtctcctggccgg

SEQ ID NO: 662112 - DNA, 25 bp, Homo sapien
tactgatcaaagtctcctggccggg

SEQ ID NO: 662113 - DNA, 25 bp, Homo sapien
actgatcaaagtctcctggccgggc

SEQ ID NO: 662114 - DNA, 25 bp, Homo sapien
ctgatcaaagtctcctggccgggca

SEQ ID NO: 662115 - DNA, 25 bp, Homo sapien
tgatcaaagtctcctggccgggcac

SEQ ID NO: 662116 - DNA, 25 bp, Homo sapien
gatcaaagtctcctggccgggcacg

SEQ ID NO: 662117 - DNA, 25 bp, Homo sapien
atcaaagtctcctggccgggcacgg

SEQ ID NO: 662118 - DNA, 25 bp, Homo sapien
tcaaagtctcctggccgggcacggt

SEQ ID NO: 662119 - DNA, 25 bp, Homo sapien
ggaagtctaggcaggtagatcacaa

SEQ ID NO: 662120 - DNA, 25 bp, Homo sapien
gccgggcgtggcagggtgcgcctga

SEQ ID NO: 662121 - DNA, 25 bp, Homo sapien
gcagggtgcgcctgagttccagcta

SEQ ID NO: 662122 - DNA, 25 bp, Homo sapien
tgacaatggtgatagtagggatggt

SEQ ID NO: 662123 - DNA, 25 bp, Homo sapien
gacaatggtgatagtagggatggtc

SEQ ID NO: 662124 - DNA, 25 bp, Homo sapien
acaatggtgatagtagggatggtct

SEQ ID NO: 662125 - DNA, 25 bp, Homo sapien
caatggtgatagtagggatggtctt

SEQ ID NO: 662126 - DNA, 25 bp, Homo sapien
aatggtgatagtagggatggtcttg

SEQ ID NO: 662127 - DNA, 25 bp, Homo sapien
atggtgatagtagggatggtcttgc

SEQ ID NO: 662128 - DNA, 25 bp, Homo sapien
tggtgatagtagggatggtcttgct

SEQ ID NO: 662129 - DNA, 25 bp, Homo sapien
ggtgatagtagggatggtcttgctc

SEQ ID NO: 662130 - DNA, 25 bp, Homo sapien
gtgatagtagggatggtcttgctct

SEQ ID NO: 662131 - DNA, 25 bp, Homo sapien
tgtgacctacacttttcttgctgat

SEQ ID NO: 662132 - DNA, 25 bp, Homo sapien
ctacacttttcttgctgatgcctgg

SEQ ID NO: 662133 - DNA, 25 bp, Homo sapien
tggccatgggcagcagcgcaagact

SEQ ID NO: 662134 - DNA, 25 bp, Homo sapien
agcagcgcaagactgtgtctctctc

SEQ ID NO: 662135 - DNA, 25 bp, Homo sapien
tctctttcacatctcaggtttctat

SEQ ID NO: 662136 - DNA, 25 bp, Homo sapien
acatctcaggtttctatgcagttag

SEQ ID NO: 662137 - DNA, 25 bp, Homo sapien
agtaatccatatcacatctgttagg

SEQ ID NO: 662138 - DNA, 25 bp, Homo sapien
gagtattataaatccatctttctat

SEQ ID NO: 662139 - DNA, 25 bp, Homo sapien
tctattagattgtgataactgcccc

SEQ ID NO: 662140 - DNA, 25 bp, Homo sapien
attcattatttcctgtaccaaactc

SEQ ID NO: 662141 - DNA, 25 bp, Homo sapien
ttcctgtaccaaactcattttgtaa

SEQ ID NO: 662142 - DNA, 25 bp, Homo sapien
ggtgcacaccaccattcctggcaag

SEQ ID NO: 662143 - DNA, 25 bp, Homo sapien
gtgcacaccaccattcctggcaaga

SEQ ID NO: 662144 - DNA, 25 bp, Homo sapien
tgcacaccaccattcctggcaagaa

SEQ ID NO: 662145 - DNA, 25 bp, Homo sapien
gcacaccaccattcctggcaagaaa

SEQ ID NO: 662146 - DNA, 25 bp, Homo sapien
cacaccaccattcctggcaagaaaa

SEQ ID NO: 662147 - DNA, 25 bp, Homo sapien
acaccaccattcctggcaagaaaac

SEQ ID NO: 662148 - DNA, 25 bp, Homo sapien
accaccattcctggcaagaaaacat

SEQ ID NO: 662149 - DNA, 25 bp, Homo sapien
ccaccattcctggcaagaaaacatt

SEQ ID NO: 662150 - DNA, 25 bp, Homo sapien
caccattcctggcaagaaaacattt

SEQ ID NO: 662151 - DNA, 25 bp, Homo sapien
accattcctggcaagaaaacatttt

SEQ ID NO: 662152 - DNA, 25 bp, Homo sapien
cattcctggcaagaaaacatttttt

SEQ ID NO: 662153 - DNA, 25 bp, Homo sapien
aatcagagttctggatagactttag

SEQ ID NO: 662154 - DNA, 25 bp, Homo sapien
atatggtttccggtattgttccctg

SEQ ID NO: 662155 - DNA, 25 bp, Homo sapien
tattgttccctgtcatgagttctgt

SEQ ID NO: 662156 - DNA, 25 bp, Homo sapien
gttccctgtcatgagttctgttcaa

SEQ ID NO: 662157 - DNA, 25 bp, Homo sapien
ttctgttcaaactcctttacctgta

SEQ ID NO: 662158 - DNA, 25 bp, Homo sapien
tttacctgtaaaactctgctcaagt

SEQ ID NO: 662159 - DNA, 25 bp, Homo sapien
actctgctcaagttattaaccatct

SEQ ID NO: 662160 - DNA, 25 bp, Homo sapien
ttaaccatctctgcaactcagcttt

SEQ ID NO: 662161 - DNA, 25 bp, Homo sapien
attagcgtgtataaattacttctga

SEQ ID NO: 662162 - DNA, 25 bp, Homo sapien
gttttgagaacatgtgacaccatct

SEQ ID NO: 662163 - DNA, 25 bp, Homo sapien
tgtgacaccatctaataaattcatg

SEQ ID NO: 662164 - DNA, 25 bp, Homo sapien
cacgccagcctgacgatgtttttta

SEQ ID NO: 662165 - DNA, 25 bp, Homo sapien
gccagcctgacgatgttttttactt

SEQ ID NO: 662166 - DNA, 25 bp, Homo sapien
agcctgacgatgttttttacttcta

SEQ ID NO: 662167 - DNA, 25 bp, Homo sapien
gacgatgttttttacttctatcact

SEQ ID NO: 662168 - DNA, 25 bp, Homo sapien
tttttacttctatcacttccttttg

SEQ ID NO: 662169 - DNA, 25 bp, Homo sapien
tttacttctatcacttccttttgat

SEQ ID NO: 662170 - DNA, 25 bp, Homo sapien
ttctatctctgcttacgtcacccat

SEQ ID NO: 662171 - DNA, 25 bp, Homo sapien
ttacgtcacccatcattcttgcgtg

SEQ ID NO: 662172 - DNA, 25 bp, Homo sapien
acccatcattcttgcgtgttgtatg

SEQ ID NO: 662173 - DNA, 25 bp, Homo sapien
tcattcttgcgtgttgtatgctttt

SEQ ID NO: 662174 - DNA, 25 bp, Homo sapien
tatgatctggtaattctaaaatgtc

SEQ ID NO: 662175 - DNA, 25 bp, Homo sapien
caccatcctggctcctgtaacagga

SEQ ID NO: 662176 - DNA, 25 bp, Homo sapien
ctcctgtaacaggacggcacagcaa

SEQ ID NO: 662177 - DNA, 25 bp, Homo sapien
aggacggcacagcaaaggccactgc

SEQ ID NO: 662178 - DNA, 25 bp, Homo sapien
aaggccactgcctggacatgagaca

SEQ ID NO: 662179 - DNA, 25 bp, Homo sapien
tgcctggacatgagacacacaccac

SEQ ID NO: 662180 - DNA, 25 bp, Homo sapien
ccatccaggcattggtcggtgaact

SEQ ID NO: 662181 - DNA, 25 bp, Homo sapien
ggcattggtcggtgaactagaattc

SEQ ID NO: 662182 - DNA, 25 bp, Homo sapien
tagaattcacactagtccctaatat

SEQ ID NO: 662183 - DNA, 25 bp, Homo sapien
tagtccctaatatctacaccaccag

SEQ ID NO: 662184 - DNA, 25 bp, Homo sapien
ttcattcctgcctcgggtgacgcca

SEQ ID NO: 662185 - DNA, 25 bp, Homo sapien
aggagggaggatgcaccccctgact

SEQ ID NO: 662186 - DNA, 25 bp, Homo sapien
aacatattgactcatgctttcttag

SEQ ID NO: 662187 - DNA, 25 bp, Homo sapien
attgactcatgctttcttagagggt

SEQ ID NO: 662188 - DNA, 25 bp, Homo sapien
actcatgctttcttagagggtagaa

SEQ ID NO: 662189 - DNA, 25 bp, Homo sapien
gatataagttcaaaaagttccagag

SEQ ID NO: 662190 - DNA, 25 bp, Homo sapien
gttccagagaagatgaccacacaaa

SEQ ID NO: 662191 - DNA, 25 bp, Homo sapien
gaccacacaaactgaacaaaatgta

SEQ ID NO: 662192 - DNA, 25 bp, Homo sapien
gaaagatatcatggtaactctataa

SEQ ID NO: 662193 - DNA, 25 bp, Homo sapien
ggtaactctataagttcattttaat

SEQ ID NO: 662194 - DNA, 25 bp, Homo sapien
acaaataattgttccatactttaat

SEQ ID NO: 662195 - DNA, 25 bp, Homo sapien
ttgttccatactttaattgatttga

SEQ ID NO: 662196 - DNA, 25 bp, Homo sapien
tactttaattgatttgagaacacca

SEQ ID NO: 662197 - DNA, 25 bp, Homo sapien
ccaagcaccattttatacctttaag

SEQ ID NO: 662198 - DNA, 25 bp, Homo sapien
caagcaccattttatacctttaaga

SEQ ID NO: 662199 - DNA, 25 bp, Homo sapien
ttatacctttaagaatgtgtgggcc

SEQ ID NO: 662200 - DNA, 25 bp, Homo sapien
tatacctttaagaatgtgtgggccg

SEQ ID NO: 662201 - DNA, 25 bp, Homo sapien
atacctttaagaatgtgtgggccgg

SEQ ID NO: 662202 - DNA, 25 bp, Homo sapien
tacctttaagaatgtgtgggccgga

SEQ ID NO: 662203 - DNA, 25 bp, Homo sapien
cctttaagaatgtgtgggccggacg

SEQ ID NO: 662204 - DNA, 25 bp, Homo sapien
ctttaagaatgtgtgggccggacgt

SEQ ID NO: 662205 - DNA, 25 bp, Homo sapien
tttaagaatgtgtgggccggacgtg

SEQ ID NO: 662206 - DNA, 25 bp, Homo sapien
ttaagaatgtgtgggccggacgtgg

SEQ ID NO: 662207 - DNA, 25 bp, Homo sapien
aagaatgtgtgggccggacgtggtg

SEQ ID NO: 662208 - DNA, 25 bp, Homo sapien
tggccgagatattgaactcattctt

SEQ ID NO: 662209 - DNA, 25 bp, Homo sapien
gaactcattcttcaaacctgtcttc

SEQ ID NO: 662210 - DNA, 25 bp, Homo sapien
ttcaaacctgtcttccgcaatagaa

SEQ ID NO: 662211 - DNA, 25 bp, Homo sapien
ttctgaaaataactcctggcacaag

SEQ ID NO: 662212 - DNA, 25 bp, Homo sapien
acaagcagaagcacgacccctcgga

SEQ ID NO: 662213 - DNA, 25 bp, Homo sapien
tcggaacatctaagtgccaccctga

SEQ ID NO: 662214 - DNA, 25 bp, Homo sapien
aagtgccaccctgaacaggtgtaga

SEQ ID NO: 662215 - DNA, 25 bp, Homo sapien
aacaggtgtagacatgccccttggg

SEQ ID NO: 662216 - DNA, 25 bp, Homo sapien
gaattgattaggatctactgtacat

SEQ ID NO: 662217 - DNA, 25 bp, Homo sapien
gaatagtgtctgaaaacggcatcat

SEQ ID NO: 662218 - DNA, 25 bp, Homo sapien
cggcatcatggagctattattgtta

SEQ ID NO: 662219 - DNA, 25 bp, Homo sapien
tctgtggtagagcagggatcattct

SEQ ID NO: 662220 - DNA, 25 bp, Homo sapien
agcagggatcattctgtttaacaga

SEQ ID NO: 662221 - DNA, 25 bp, Homo sapien
gtttaacagaatattagacccttga

SEQ ID NO: 662222 - DNA, 25 bp, Homo sapien
tagacccttgagtcggttaattctg

SEQ ID NO: 662223 - DNA, 25 bp, Homo sapien
ttgagtcggttaattctgttttaga

SEQ ID NO: 662224 - DNA, 25 bp, Homo sapien
ttctgttttagaacccatttccatg

SEQ ID NO: 662225 - DNA, 25 bp, Homo sapien
agaacccatttccatgtgtttcgtg

SEQ ID NO: 662226 - DNA, 25 bp, Homo sapien
ccatttccatgtgtttcgtgaccat

SEQ ID NO: 662227 - DNA, 25 bp, Homo sapien
ccatgtgtttcgtgaccattcagat

SEQ ID NO: 662228 - DNA, 25 bp, Homo sapien
gtttcgtgaccattcagattgttta

SEQ ID NO: 662229 - DNA, 25 bp, Homo sapien
aatttagaaaatggctgttgtgggc

SEQ ID NO: 662230 - DNA, 25 bp, Homo sapien
agttaagctgtgtcattaagaacca

SEQ ID NO: 662231 - DNA, 25 bp, Homo sapien
taagctgtgtcattaagaaccaaca

SEQ ID NO: 662232 - DNA, 25 bp, Homo sapien
gtgtcattaagaaccaacagcgtgg

SEQ ID NO: 662233 - DNA, 25 bp, Homo sapien
attaagaaccaacagcgtggccggg

SEQ ID NO: 662234 - DNA, 25 bp, Homo sapien
taagaaccaacagcgtggccgggcg

SEQ ID NO: 662235 - DNA, 25 bp, Homo sapien
aaccaacagcgtggccgggcgtgat

SEQ ID NO: 662236 - DNA, 25 bp, Homo sapien
aaatctcatttgttgctgcaatctt

SEQ ID NO: 662237 - DNA, 25 bp, Homo sapien
tctcatttgttgctgcaatcttttc

SEQ ID NO: 662238 - DNA, 25 bp, Homo sapien
tttgttgctgcaatcttttcacaat

SEQ ID NO: 662239 - DNA, 25 bp, Homo sapien
tgttgctgcaatcttttcacaataa

SEQ ID NO: 662240 - DNA, 25 bp, Homo sapien
acaataaagttaagctgtgtcatta

SEQ ID NO: 662241 - DNA, 25 bp, Homo sapien
atgtgaacattcatgaaaacttatt

SEQ ID NO: 662242 - DNA, 25 bp, Homo sapien
ttaagaaatcaaatccggctcatac

SEQ ID NO: 662243 - DNA, 25 bp, Homo sapien
aagaaatcaaatccggctcatacca

SEQ ID NO: 662244 - DNA, 25 bp, Homo sapien
aatcaaatccggctcataccagtaa

SEQ ID NO: 662245 - DNA, 25 bp, Homo sapien
tcaaatccggctcataccagtaatc

SEQ ID NO: 662246 - DNA, 25 bp, Homo sapien
aaatccggctcataccagtaatccc

SEQ ID NO: 662247 - DNA, 25 bp, Homo sapien
atccggctcataccagtaatcccag

SEQ ID NO: 662248 - DNA, 25 bp, Homo sapien
ccagtgactcgggagtctaaagtga

SEQ ID NO: 662249 - DNA, 25 bp, Homo sapien
ctcgggagtctaaagtgagaggatc

SEQ ID NO: 662250 - DNA, 25 bp, Homo sapien
gtaccactgctctcaagcatgggca

SEQ ID NO: 662251 - DNA, 25 bp, Homo sapien
taccactgctctcaagcatgggcaa

SEQ ID NO: 662252 - DNA, 25 bp, Homo sapien
tatatttacctgctcccttcaccag

SEQ ID NO: 662253 - DNA, 25 bp, Homo sapien
atatttacctgctcccttcaccagg

SEQ ID NO: 662254 - DNA, 25 bp, Homo sapien
tatttacctgctcccttcaccagga

SEQ ID NO: 662255 - DNA, 25 bp, Homo sapien
atttacctgctcccttcaccaggag

SEQ ID NO: 662256 - DNA, 25 bp, Homo sapien
tttacctgctcccttcaccaggaga

SEQ ID NO: 662257 - DNA, 25 bp, Homo sapien
ttacctgctcccttcaccaggagat

SEQ ID NO: 662258 - DNA, 25 bp, Homo sapien
tacctgctcccttcaccaggagatc

SEQ ID NO: 662259 - DNA, 25 bp, Homo sapien
cttgccctatcaaagagaatagttt

SEQ ID NO: 662260 - DNA, 25 bp, Homo sapien
ttgccctatcaaagagaatagtttt

SEQ ID NO: 662261 - DNA, 25 bp, Homo sapien
agagatgggcaagtctggcttctga

SEQ ID NO: 662262 - DNA, 25 bp, Homo sapien
tgccattgaacttctctgtgctgag

SEQ ID NO: 662263 - DNA, 25 bp, Homo sapien
ttagagaatcctctccacatttgga

SEQ ID NO: 662264 - DNA, 25 bp, Homo sapien
catttggaggtttgtgtcacccttc

SEQ ID NO: 662265 - DNA, 25 bp, Homo sapien
gtcacccttctacatgaccagggct

SEQ ID NO: 662266 - DNA, 25 bp, Homo sapien
gaccagggcttctgtcccatgagaa

SEQ ID NO: 662267 - DNA, 25 bp, Homo sapien
agttctgagttgtagatttgcccat

SEQ ID NO: 662268 - DNA, 25 bp, Homo sapien
agatttgcccatgggccagacatca

SEQ ID NO: 662269 - DNA, 25 bp, Homo sapien
cagacatcaggctctgtccatgagg

SEQ ID NO: 662270 - DNA, 25 bp, Homo sapien
caggctctgtccatgaggtgaccca

SEQ ID NO: 662271 - DNA, 25 bp, Homo sapien
tgacccaagtcaccagaggaaaagt

SEQ ID NO: 662272 - DNA, 25 bp, Homo sapien
aaattaggatcttacagcttttatc

SEQ ID NO: 662273 - DNA, 25 bp, Homo sapien
tacagcttttatcaggaaattattg

SEQ ID NO: 662274 - DNA, 25 bp, Homo sapien
gcttttatcaggaaattattgctgt

SEQ ID NO: 662275 - DNA, 25 bp, Homo sapien
tattgctgttttccattgcaatttg

SEQ ID NO: 662276 - DNA, 25 bp, Homo sapien
gctgttttccattgcaatttgtatc

SEQ ID NO: 662277 - DNA, 25 bp, Homo sapien
gttttccattgcaatttgtatcaca

SEQ ID NO: 662278 - DNA, 25 bp, Homo sapien
cttaactatcattggtgaaccccta

SEQ ID NO: 662279 - DNA, 25 bp, Homo sapien
ggtgaacccctaattgtttggatgg

SEQ ID NO: 662280 - DNA, 25 bp, Homo sapien
tcattaggaattcttattttacgtt

SEQ ID NO: 662281 - DNA, 25 bp, Homo sapien
atagaattgttagctaatgatgcac

SEQ ID NO: 662282 - DNA, 25 bp, Homo sapien
aattgttagctaatgatgcacacaa

SEQ ID NO: 662283 - DNA, 25 bp, Homo sapien
tccctgcctcaatccctggggattg

SEQ ID NO: 662284 - DNA, 25 bp, Homo sapien
atccctggggattgtccaggcaaaa

SEQ ID NO: 662285 - DNA, 25 bp, Homo sapien
ctggggattgtccaggcaaaacctg

SEQ ID NO: 662286 - DNA, 25 bp, Homo sapien
agggcagcgggcaagctgttggatg

SEQ ID NO: 662287 - DNA, 25 bp, Homo sapien
agcgggcaagctgttggatggaaca

SEQ ID NO: 662288 - DNA, 25 bp, Homo sapien
cgggcaagctgttggatggaacaga

SEQ ID NO: 662289 - DNA, 25 bp, Homo sapien
tggaacagagagaccctcgcagctg

SEQ ID NO: 662290 - DNA, 25 bp, Homo sapien
ggaacagagagaccctcgcagctga

SEQ ID NO: 662291 - DNA, 25 bp, Homo sapien
cctcgcagctgactagggcccaagg

SEQ ID NO: 662292 - DNA, 25 bp, Homo sapien
ctccactgctgaagaccctgctgta

SEQ ID NO: 662293 - DNA, 25 bp, Homo sapien
tccactgctgaagaccctgctgtag

SEQ ID NO: 662294 - DNA, 25 bp, Homo sapien
gatgccttcacctgaatgacatcta

SEQ ID NO: 662295 - DNA, 25 bp, Homo sapien
gccttcacctgaatgacatctacct

SEQ ID NO: 662296 - DNA, 25 bp, Homo sapien
ttcacctgaatgacatctacctcca

SEQ ID NO: 662297 - DNA, 25 bp, Homo sapien
tgaatgacatctacctccatcagga

SEQ ID NO: 662298 - DNA, 25 bp, Homo sapien
aatgacatctacctccatcaggacc

SEQ ID NO: 662299 - DNA, 25 bp, Homo sapien
atcaggaccccagatgtctgacagc

SEQ ID NO: 662300 - DNA, 25 bp, Homo sapien
ggaccccagatgtctgacagccctg

SEQ ID NO: 662301 - DNA, 25 bp, Homo sapien
ccagatgtctgacagccctgtgtga

SEQ ID NO: 662302 - DNA, 25 bp, Homo sapien
acagccctgtgtgacaccaagataa

SEQ ID NO: 662303 - DNA, 25 bp, Homo sapien
agccctgtgtgacaccaagataagt

SEQ ID NO: 662304 - DNA, 25 bp, Homo sapien
cctgtgtgacaccaagataagtaac

SEQ ID NO: 662305 - DNA, 25 bp, Homo sapien
tttcatccatttatgttctttttgt

SEQ ID NO: 662306 - DNA, 25 bp, Homo sapien
tctttttctgttcaaacctcctagg

SEQ ID NO: 662307 - DNA, 25 bp, Homo sapien
ttctgttcaaacctcctaggtaatt

SEQ ID NO: 662308 - DNA, 25 bp, Homo sapien
cctcctaggtaattgttctgtaaat

SEQ ID NO: 662309 - DNA, 25 bp, Homo sapien
aatcttaagtgattcttatgtccac

SEQ ID NO: 662310 - DNA, 25 bp, Homo sapien
ttatgtccactttcacatgattttt

SEQ ID NO: 662311 - DNA, 25 bp, Homo sapien
cacatgatttttcatggagttttca

SEQ ID NO: 662312 - DNA, 25 bp, Homo sapien
ggagttttcatttaacaaacacatt

SEQ ID NO: 662313 - DNA, 25 bp, Homo sapien
aacacatttggcttttgttacacgt

SEQ ID NO: 662314 - DNA, 25 bp, Homo sapien
ttggcttttgttacacgtgttaata

SEQ ID NO: 662315 - DNA, 25 bp, Homo sapien
gttacacgtgttaataattttgcat

SEQ ID NO: 662316 - DNA, 25 bp, Homo sapien
aaaactagcaaatccagctctatgc

SEQ ID NO: 662317 - DNA, 25 bp, Homo sapien
aactagcaaatccagctctatgctc

SEQ ID NO: 662318 - DNA, 25 bp, Homo sapien
ctagcaaatccagctctatgctcag

SEQ ID NO: 662319 - DNA, 25 bp, Homo sapien
tagcaaatccagctctatgctcaga

SEQ ID NO: 662320 - DNA, 25 bp, Homo sapien
agcaaatccagctctatgctcagag

SEQ ID NO: 662321 - DNA, 25 bp, Homo sapien
gcaaatccagctctatgctcagaga

SEQ ID NO: 662322 - DNA, 25 bp, Homo sapien
ctatgctcagagaattaccagaaaa

SEQ ID NO: 662323 - DNA, 25 bp, Homo sapien
tatgctcagagaattaccagaaaat

SEQ ID NO: 662324 - DNA, 25 bp, Homo sapien
tgctcagagaattaccagaaaataa

SEQ ID NO: 662325 - DNA, 25 bp, Homo sapien
attacatgaagcttgaatataggga

SEQ ID NO: 662326 - DNA, 25 bp, Homo sapien
acatgaagcttgaatatagggagat

SEQ ID NO: 662327 - DNA, 25 bp, Homo sapien
tggtttcagcaaggcataattttgc

SEQ ID NO: 662328 - DNA, 25 bp, Homo sapien
aaggcataattttgcttagaacata

SEQ ID NO: 662329 - DNA, 25 bp, Homo sapien
aacatatttcttaattccttctgag

SEQ ID NO: 662330 - DNA, 25 bp, Homo sapien
taattccttctgagtatttttggag

SEQ ID NO: 662331 - DNA, 25 bp, Homo sapien
aatctctatatatggtgatacaaaa

SEQ ID NO: 662332 - DNA, 25 bp, Homo sapien
tattttctctttaaatgctaatcat

SEQ ID NO: 662333 - DNA, 25 bp, Homo sapien
atcattggttataatgtggcggctt

SEQ ID NO: 662334 - DNA, 25 bp, Homo sapien
tggcggcttgggacattttggatct

SEQ ID NO: 662335 - DNA, 25 bp, Homo sapien
gcggcttgggacattttggatcttt

SEQ ID NO: 662336 - DNA, 25 bp, Homo sapien
ggcttgggacattttggatctttct

SEQ ID NO: 662337 - DNA, 25 bp, Homo sapien
tgggacattttggatctttctaaaa

SEQ ID NO: 662338 - DNA, 25 bp, Homo sapien
tctgatgattacttatacattcctg

SEQ ID NO: 662339 - DNA, 25 bp, Homo sapien
gatgattacttatacattcctgaaa

SEQ ID NO: 662340 - DNA, 25 bp, Homo sapien
aacattttcatctgtatctgccctg

SEQ ID NO: 662341 - DNA, 25 bp, Homo sapien
attttcatctgtatctgccctgtat

SEQ ID NO: 662342 - DNA, 25 bp, Homo sapien
tttcatctgtatctgccctgtattt

SEQ ID NO: 662343 - DNA, 25 bp, Homo sapien
tcatctgtatctgccctgtattttt

SEQ ID NO: 662344 - DNA, 25 bp, Homo sapien
ctgtatctgccctgtatttttcatg

SEQ ID NO: 662345 - DNA, 25 bp, Homo sapien
gtatatactgtttcaatatctgctt

SEQ ID NO: 662346 - DNA, 25 bp, Homo sapien
actgtttcaatatctgctttttcac

SEQ ID NO: 662347 - DNA, 25 bp, Homo sapien
atctgctttttcacacagaaatata

SEQ ID NO: 662348 - DNA, 25 bp, Homo sapien
tatagatattcttgaactttcatgt

SEQ ID NO: 662349 - DNA, 25 bp, Homo sapien
acatcagtgccccttgctactttct

SEQ ID NO: 662350 - DNA, 25 bp, Homo sapien
ttgctactttctcagtcctcactat

SEQ ID NO: 662351 - DNA, 25 bp, Homo sapien
cagctttttctccagtccattatcc

SEQ ID NO: 662352 - DNA, 25 bp, Homo sapien
gcagtctaggttaaactagccaggc

SEQ ID NO: 662353 - DNA, 25 bp, Homo sapien
gtgattttcaaaagccccactttag

SEQ ID NO: 662354 - DNA, 25 bp, Homo sapien
aaaagccccactttagagatcaggc

SEQ ID NO: 662355 - DNA, 25 bp, Homo sapien
gccccactttagagatcaggccaca

SEQ ID NO: 662356 - DNA, 25 bp, Homo sapien
acagctttttatatcgcacaggaca

SEQ ID NO: 662357 - DNA, 25 bp, Homo sapien
tttttatatcgcacaggacacatca

SEQ ID NO: 662358 - DNA, 25 bp, Homo sapien
acaggacacatcagcctgagctgct

SEQ ID NO: 662359 - DNA, 25 bp, Homo sapien
gacacatcagcctgagctgctgcct

SEQ ID NO: 662360 - DNA, 25 bp, Homo sapien
ggaggacaactgagcccatgggtct

SEQ ID NO: 662361 - DNA, 25 bp, Homo sapien
gaggacaactgagcccatgggtcta

SEQ ID NO: 662362 - DNA, 25 bp, Homo sapien
gacaactgagcccatgggtctagcc

SEQ ID NO: 662363 - DNA, 25 bp, Homo sapien
acaactgagcccatgggtctagcct

SEQ ID NO: 662364 - DNA, 25 bp, Homo sapien
caactgagcccatgggtctagcctg

SEQ ID NO: 662365 - DNA, 25 bp, Homo sapien
aactgagcccatgggtctagcctgg

SEQ ID NO: 662366 - DNA, 25 bp, Homo sapien
gctgcagggagctattatttattgt

SEQ ID NO: 662367 - DNA, 25 bp, Homo sapien
tattgtacctgtgaagaaccccctg

SEQ ID NO: 662368 - DNA, 25 bp, Homo sapien
ttgtacctgtgaagaaccccctgca

SEQ ID NO: 662369 - DNA, 25 bp, Homo sapien
tacctgtgaagaaccccctgcattg

SEQ ID NO: 662370 - DNA, 25 bp, Homo sapien
tgaagaaccccctgcattgcagcct

SEQ ID NO: 662371 - DNA, 25 bp, Homo sapien
agatgctatagaggctagatttttc

SEQ ID NO: 662372 - DNA, 25 bp, Homo sapien
ttttctgtcatatttgcgactaata

SEQ ID NO: 662373 - DNA, 25 bp, Homo sapien
gcgactaataaatttcaatgctact

SEQ ID NO: 662374 - DNA, 25 bp, Homo sapien
gcccagctaaaaattagtggttcca

SEQ ID NO: 662375 - DNA, 25 bp, Homo sapien
agtggttccattaccaaagaagtag

SEQ ID NO: 662376 - DNA, 25 bp, Homo sapien
ttgggaaacaattagccgtctctgc

SEQ ID NO: 662377 - DNA, 25 bp, Homo sapien
aacaattagccgtctctgcaataac

SEQ ID NO: 662378 - DNA, 25 bp, Homo sapien
aattagccgtctctgcaataacctt

SEQ ID NO: 662379 - DNA, 25 bp, Homo sapien
gccgtctctgcaataaccttttaat

SEQ ID NO: 662380 - DNA, 25 bp, Homo sapien
aaccttttaatagtttgctctagat

SEQ ID NO: 662381 - DNA, 25 bp, Homo sapien
tttaatagtttgctctagatgctat

SEQ ID NO: 662382 - DNA, 25 bp, Homo sapien
atagatgcatcttaagacaagaaag

SEQ ID NO: 662383 - DNA, 25 bp, Homo sapien
tagatgcatcttaagacaagaaagt

SEQ ID NO: 662384 - DNA, 25 bp, Homo sapien
agatgcatcttaagacaagaaagtg

SEQ ID NO: 662385 - DNA, 25 bp, Homo sapien
gatgcatcttaagacaagaaagtga

SEQ ID NO: 662386 - DNA, 25 bp, Homo sapien
atgcatcttaagacaagaaagtgaa

SEQ ID NO: 662387 - DNA, 25 bp, Homo sapien
caactatcagaaaatgtatgtcata

SEQ ID NO: 662388 - DNA, 25 bp, Homo sapien
aactatcagaaaatgtatgtcatag

SEQ ID NO: 662389 - DNA, 25 bp, Homo sapien
gctgctgctgacagattaaccaaag

SEQ ID NO: 662390 - DNA, 25 bp, Homo sapien
gctgctgacagattaaccaaagaaa

SEQ ID NO: 662391 - DNA, 25 bp, Homo sapien
ctgctgacagattaaccaaagaaag

SEQ ID NO: 662392 - DNA, 25 bp, Homo sapien
tgctgacagattaaccaaagaaaga

SEQ ID NO: 662393 - DNA, 25 bp, Homo sapien
aggtgcactaatatctcagacacag

SEQ ID NO: 662394 - DNA, 25 bp, Homo sapien
ggtgcactaatatctcagacacaga

SEQ ID NO: 662395 - DNA, 25 bp, Homo sapien
gtgcactaatatctcagacacagac

SEQ ID NO: 662396 - DNA, 25 bp, Homo sapien
tgcactaatatctcagacacagaca

SEQ ID NO: 662397 - DNA, 25 bp, Homo sapien
gcactaatatctcagacacagacat

SEQ ID NO: 662398 - DNA, 25 bp, Homo sapien
agacacagacatcaccactaaaaaa

SEQ ID NO: 662399 - DNA, 25 bp, Homo sapien
gacacagacatcaccactaaaaaat

SEQ ID NO: 662400 - DNA, 25 bp, Homo sapien
acacagacatcaccactaaaaaatc

SEQ ID NO: 662401 - DNA, 25 bp, Homo sapien
acagacatcaccactaaaaaatctt

SEQ ID NO: 662402 - DNA, 25 bp, Homo sapien
gacatcaccactaaaaaatcttatc

SEQ ID NO: 662403 - DNA, 25 bp, Homo sapien
caccactaaaaaatcttatccccat

SEQ ID NO: 662404 - DNA, 25 bp, Homo sapien
agactcgcctaagcagtttctctct

SEQ ID NO: 662405 - DNA, 25 bp, Homo sapien
ggagatgttgaaatggtcgctgaaa

SEQ ID NO: 662406 - DNA, 25 bp, Homo sapien
atggtcgctgaaacactgcaaacac

SEQ ID NO: 662407 - DNA, 25 bp, Homo sapien
gggacagatcccaaagtatagcagc

SEQ ID NO: 662408 - DNA, 25 bp, Homo sapien
tactgctgcctaagtggtcttccta

SEQ ID NO: 662409 - DNA, 25 bp, Homo sapien
gtggtcttcctaaaacacaagtttg

SEQ ID NO: 662410 - DNA, 25 bp, Homo sapien
aagtttgcacttgtcagaaccactc

SEQ ID NO: 662411 - DNA, 25 bp, Homo sapien
acttgtcagaaccactccttaagat

SEQ ID NO: 662412 - DNA, 25 bp, Homo sapien
ttaagatctctcatgggttgccctc

SEQ ID NO: 662413 - DNA, 25 bp, Homo sapien
gttgccctcgtctccaaataaagat

SEQ ID NO: 662414 - DNA, 25 bp, Homo sapien
taaagatactaaccactgagctggc

SEQ ID NO: 662415 - DNA, 25 bp, Homo sapien
tgatgggggcgagtccagtctaacc

SEQ ID NO: 662416 - DNA, 25 bp, Homo sapien
tcagtcatgccaaagaaagagatat

SEQ ID NO: 662417 - DNA, 25 bp, Homo sapien
gagattggagctatttcctcaccat

SEQ ID NO: 662418 - DNA, 25 bp, Homo sapien
gagctatttcctcaccattttataa

SEQ ID NO: 662419 - DNA, 25 bp, Homo sapien
tatttcctcaccattttataactta

SEQ ID NO: 662420 - DNA, 25 bp, Homo sapien
ttaactgcctgcagagtactctgta

SEQ ID NO: 662421 - DNA, 25 bp, Homo sapien
gcagagtactctgtagatctaatgt

SEQ ID NO: 662422 - DNA, 25 bp, Homo sapien
tgaaacaatagaatgcggaaggctg

SEQ ID NO: 662423 - DNA, 25 bp, Homo sapien
cagccctttgggaggaccaggctag

SEQ ID NO: 662424 - DNA, 25 bp, Homo sapien
aggaccaggctagcgatcactttga

SEQ ID NO: 662425 - DNA, 25 bp, Homo sapien
ccaggctagcgatcactttgagctc

SEQ ID NO: 662426 - DNA, 25 bp, Homo sapien
gtacttgaacctttgttatttctct

SEQ ID NO: 662427 - DNA, 25 bp, Homo sapien
atttctctaatttcatcttcaactc

SEQ ID NO: 662428 - DNA, 25 bp, Homo sapien
atcttcaactctgctcatcgttatt

SEQ ID NO: 662429 - DNA, 25 bp, Homo sapien
atcgttattctcttgccctgggcat

SEQ ID NO: 662430 - DNA, 25 bp, Homo sapien
ttttgttctctgaacgtgccaggca

SEQ ID NO: 662431 - DNA, 25 bp, Homo sapien
ttctactgaattgctcttcatccat

SEQ ID NO: 662432 - DNA, 25 bp, Homo sapien
tgtatgaccaatttccttacttttc

SEQ ID NO: 662433 - DNA, 25 bp, Homo sapien
tttcaccttctaaatggagtcttac

SEQ ID NO: 662434 - DNA, 25 bp, Homo sapien
ggagtcttacctgatgaccatccaa

SEQ ID NO: 662435 - DNA, 25 bp, Homo sapien
cctgatgaccatccaaagctttata

SEQ ID NO: 662436 - DNA, 25 bp, Homo sapien
atattctttctttgctctataattt

SEQ ID NO: 662437 - DNA, 25 bp, Homo sapien
aggagtgtttccttggaagttgtag

SEQ ID NO: 662438 - DNA, 25 bp, Homo sapien
gtgggtttttaggactgttatctat

SEQ ID NO: 662439 - DNA, 25 bp, Homo sapien
aggactgttatctatgagcatgcat

SEQ ID NO: 662440 - DNA, 25 bp, Homo sapien
gagcatgcatggctataaacgcatt

SEQ ID NO: 662441 - DNA, 25 bp, Homo sapien
taaacgcattaattgaagggtattc

SEQ ID NO: 662442 - DNA, 25 bp, Homo sapien
gtattcatgataacaggacagctct

SEQ ID NO: 662443 - DNA, 25 bp, Homo sapien
gtttttgtcttgtaggatttgctct

SEQ ID NO: 662444 - DNA, 25 bp, Homo sapien
gtcttgtaggatttgctctttattt

SEQ ID NO: 662445 - DNA, 25 bp, Homo sapien
tgctctttatttggtgatgtaaaat

SEQ ID NO: 662446 - DNA, 25 bp, Homo sapien
aatttatcgtggtcgcattttgtta

SEQ ID NO: 662447 - DNA, 25 bp, Homo sapien
tcgtggtcgcattttgttaatgtta

SEQ ID NO: 662448 - DNA, 25 bp, Homo sapien
cgcccggcctatatgactttatatt

SEQ ID NO: 662449 - DNA, 25 bp, Homo sapien
gcccggcctatatgactttatattt

SEQ ID NO: 662450 - DNA, 25 bp, Homo sapien
cccggcctatatgactttatattta

SEQ ID NO: 662451 - DNA, 25 bp, Homo sapien
ccggcctatatgactttatatttac

SEQ ID NO: 662452 - DNA, 25 bp, Homo sapien
tgactttatatttacctgctccctt

SEQ ID NO: 662453 - DNA, 25 bp, Homo sapien
ttacctgctcccttcaccaggagat

SEQ ID NO: 662454 - DNA, 25 bp, Homo sapien
tcatgggctgtgatgctgggttttc

SEQ ID NO: 662455 - DNA, 25 bp, Homo sapien
gggctgtgatgctgggttttcttaa

SEQ ID NO: 662456 - DNA, 25 bp, Homo sapien
ggctgtgatgctgggttttcttaac

SEQ ID NO: 662457 - DNA, 25 bp, Homo sapien
gtgatgctgggttttcttaacagca

SEQ ID NO: 662458 - DNA, 25 bp, Homo sapien
ccccttgccctatcaaagagaatag

SEQ ID NO: 662459 - DNA, 25 bp, Homo sapien
aaatgtccattcctttttcatctcc

SEQ ID NO: 662460 - DNA, 25 bp, Homo sapien
gtccattcctttttcatctccatca

SEQ ID NO: 662461 - DNA, 25 bp, Homo sapien
acccatctcacatcttccttcagtg

SEQ ID NO: 662462 - DNA, 25 bp, Homo sapien
agtgcctatgtgatctgtttgagta

SEQ ID NO: 662463 - DNA, 25 bp, Homo sapien
gcctatgtgatctgtttgagtataa

SEQ ID NO: 662464 - DNA, 25 bp, Homo sapien
ctgtttgagtataaccaggtgtaca

SEQ ID NO: 662465 - DNA, 25 bp, Homo sapien
gtataaccaggtgtacaaaagtact

SEQ ID NO: 662466 - DNA, 25 bp, Homo sapien
gtactaagtgatatgagatgacttc

SEQ ID NO: 662467 - DNA, 25 bp, Homo sapien
atgacttcagtagtccagggactct

SEQ ID NO: 662468 - DNA, 25 bp, Homo sapien
cagtagtccagggactctttcttcc

SEQ ID NO: 662469 - DNA, 25 bp, Homo sapien
cttcccccactctgtaaagagttat

SEQ ID NO: 662470 - DNA, 25 bp, Homo sapien
cataagaataatgattacgggccag

SEQ ID NO: 662471 - DNA, 25 bp, Homo sapien
ataagaataatgattacgggccagg

SEQ ID NO: 662472 - DNA, 25 bp, Homo sapien
taagaataatgattacgggccaggt

SEQ ID NO: 662473 - DNA, 25 bp, Homo sapien
aagaataatgattacgggccaggtg

SEQ ID NO: 662474 - DNA, 25 bp, Homo sapien
agaataatgattacgggccaggtgt

SEQ ID NO: 662475 - DNA, 25 bp, Homo sapien
aataatgattacgggccaggtgtgc

SEQ ID NO: 662476 - DNA, 25 bp, Homo sapien
ataatgattacgggccaggtgtgct

SEQ ID NO: 662477 - DNA, 25 bp, Homo sapien
taatgattacgggccaggtgtgctg

SEQ ID NO: 662478 - DNA, 25 bp, Homo sapien
atgattacgggccaggtgtgctggc

SEQ ID NO: 662479 - DNA, 25 bp, Homo sapien
tgattacgggccaggtgtgctggct

SEQ ID NO: 662480 - DNA, 25 bp, Homo sapien
attacgggccaggtgtgctggctca

SEQ ID NO: 662481 - DNA, 25 bp, Homo sapien
gaggagaactggcatatgcactcaa

SEQ ID NO: 662482 - DNA, 25 bp, Homo sapien
ggagaactggcatatgcactcaata

SEQ ID NO: 662483 - DNA, 25 bp, Homo sapien
gagaactggcatatgcactcaataa

SEQ ID NO: 662484 - DNA, 25 bp, Homo sapien
actggcatatgcactcaataacttt

SEQ ID NO: 662485 - DNA, 25 bp, Homo sapien
tggcatatgcactcaataactttga

SEQ ID NO: 662486 - DNA, 25 bp, Homo sapien
gcatatgcactcaataactttgaca

SEQ ID NO: 662487 - DNA, 25 bp, Homo sapien
atgcactcaataactttgacaaaca

SEQ ID NO: 662488 - DNA, 25 bp, Homo sapien
gaccccttgagcttcagcgaggagc

SEQ ID NO: 662489 - DNA, 25 bp, Homo sapien
accccttgagcttcagcgaggagcg

SEQ ID NO: 662490 - DNA, 25 bp, Homo sapien
ccttgagcttcagcgaggagcgctt

SEQ ID NO: 662491 - DNA, 25 bp, Homo sapien
ttgagcttcagcgaggagcgcttta

SEQ ID NO: 662492 - DNA, 25 bp, Homo sapien
aaattaggatcttacagcttttatc

SEQ ID NO: 662493 - DNA, 25 bp, Homo sapien
tacagcttttatcaggaaattattg

SEQ ID NO: 662494 - DNA, 25 bp, Homo sapien
gcttttatcaggaaattattgctgt

SEQ ID NO: 662495 - DNA, 25 bp, Homo sapien
tattgctgttttccattgcaatttg

SEQ ID NO: 662496 - DNA, 25 bp, Homo sapien
ttgctgttttccattgcaatttgta

SEQ ID NO: 662497 - DNA, 25 bp, Homo sapien
gctgttttccattgcaatttgtatc

SEQ ID NO: 662498 - DNA, 25 bp, Homo sapien
ctgttttccattgcaatttgtatca

SEQ ID NO: 662499 - DNA, 25 bp, Homo sapien
tgttttccattgcaatttgtatcac

SEQ ID NO: 662500 - DNA, 25 bp, Homo sapien
gttttccattgcaatttgtatcaca

SEQ ID NO: 662501 - DNA, 25 bp, Homo sapien
atagaattgttagctaatgatgcac

SEQ ID NO: 662502 - DNA, 25 bp, Homo sapien
aattgttagctaatgatgcacacaa

SEQ ID NO: 662503 - DNA, 25 bp, Homo sapien
actcagagacttatatagtggcgat

SEQ ID NO: 662504 - DNA, 25 bp, Homo sapien
gacttatatagtggcgatggcattc

SEQ ID NO: 662505 - DNA, 25 bp, Homo sapien
tggcgatggcattcaaattcagtct

SEQ ID NO: 662506 - DNA, 25 bp, Homo sapien
ggcattcaaattcagtctgcattac

SEQ ID NO: 662507 - DNA, 25 bp, Homo sapien
aaattcagtctgcattacttcaaaa

SEQ ID NO: 662508 - DNA, 25 bp, Homo sapien
gcattacttcaaaatgtatgcttat

SEQ ID NO: 662509 - DNA, 25 bp, Homo sapien
atgtatgcttatttgagagaaaaac

SEQ ID NO: 662510 - DNA, 25 bp, Homo sapien
ttttttactttcaactagacatata

SEQ ID NO: 662511 - DNA, 25 bp, Homo sapien
acactgtatctatattggatatcta

SEQ ID NO: 662512 - DNA, 25 bp, Homo sapien
gaaccacaaagtttgttggcctttg

SEQ ID NO: 662513 - DNA, 25 bp, Homo sapien
agtttgttggcctttgtgcatttac

SEQ ID NO: 662514 - DNA, 25 bp, Homo sapien
cagccaaggtgagggtttaaacaga

SEQ ID NO: 662515 - DNA, 25 bp, Homo sapien
gccaaggtgagggtttaaacagaca

SEQ ID NO: 662516 - DNA, 25 bp, Homo sapien
ccaaggtgagggtttaaacagacag

SEQ ID NO: 662517 - DNA, 25 bp, Homo sapien
caaggtgagggtttaaacagacaga

SEQ ID NO: 662518 - DNA, 25 bp, Homo sapien
ggtgagggtttaaacagacagaaag

SEQ ID NO: 662519 - DNA, 25 bp, Homo sapien
atagacaaagacaccgagagacaga

SEQ ID NO: 662520 - DNA, 25 bp, Homo sapien
tagacaaagacaccgagagacagag

SEQ ID NO: 662521 - DNA, 25 bp, Homo sapien
aggaccacaatgtgctcccacccta

SEQ ID NO: 662522 - DNA, 25 bp, Homo sapien
ggaccacaatgtgctcccaccctag

SEQ ID NO: 662523 - DNA, 25 bp, Homo sapien
gaccacaatgtgctcccaccctagt

SEQ ID NO: 662524 - DNA, 25 bp, Homo sapien
acaatgtgctcccaccctagtggat

SEQ ID NO: 662525 - DNA, 25 bp, Homo sapien
aataagaaaaatactggccagctgc

SEQ ID NO: 662526 - DNA, 25 bp, Homo sapien
aagaaaaatactggccagctgcagt

SEQ ID NO: 662527 - DNA, 25 bp, Homo sapien
aaatactggccagctgcagtggctc

SEQ ID NO: 662528 - DNA, 25 bp, Homo sapien
cacctataatcttcgcactctggga

SEQ ID NO: 662529 - DNA, 25 bp, Homo sapien
gggtgaggcccggaactgcttcaac

SEQ ID NO: 662530 - DNA, 25 bp, Homo sapien
ggtgaggcccggaactgcttcaacc

SEQ ID NO: 662531 - DNA, 25 bp, Homo sapien
gtgaggcccggaactgcttcaacct

SEQ ID NO: 662532 - DNA, 25 bp, Homo sapien
tgaggcccggaactgcttcaacctg

SEQ ID NO: 662533 - DNA, 25 bp, Homo sapien
gaggcccggaactgcttcaacctgg

SEQ ID NO: 662534 - DNA, 25 bp, Homo sapien
aggcccggaactgcttcaacctggg

SEQ ID NO: 662535 - DNA, 25 bp, Homo sapien
ggcccggaactgcttcaacctggga

SEQ ID NO: 662536 - DNA, 25 bp, Homo sapien
tttctctctttcagatgcagggtgg

SEQ ID NO: 662537 - DNA, 25 bp, Homo sapien
ctctctttcagatgcagggtggtgg

SEQ ID NO: 662538 - DNA, 25 bp, Homo sapien
gggttctccttatattgcccagccc

SEQ ID NO: 662539 - DNA, 25 bp, Homo sapien
ttatattgcccagcccagactcgaa

SEQ ID NO: 662540 - DNA, 25 bp, Homo sapien
gcccagactcgaacccctgcaaaaa

SEQ ID NO: 662541 - DNA, 25 bp, Homo sapien
gggctacaggcatgcgacactgcat

SEQ ID NO: 662542 - DNA, 25 bp, Homo sapien
tacaggcatgcgacactgcatccag

SEQ ID NO: 662543 - DNA, 25 bp, Homo sapien
aggcatgcgacactgcatccagcta

SEQ ID NO: 662544 - DNA, 25 bp, Homo sapien
gcatccagctaatcctgcaaatatt

SEQ ID NO: 662545 - DNA, 25 bp, Homo sapien
ccagctaatcctgcaaatattgtta

SEQ ID NO: 662546 - DNA, 25 bp, Homo sapien
tgcaaatattgttaagtaaaccggt

SEQ ID NO: 662547 - DNA, 25 bp, Homo sapien
ggaattgcggcggagtgccgtggct

SEQ ID NO: 662548 - DNA, 25 bp, Homo sapien
gaattgcggcggagtgccgtggctc

SEQ ID NO: 662549 - DNA, 25 bp, Homo sapien
aattgcggcggagtgccgtggctca

SEQ ID NO: 662550 - DNA, 25 bp, Homo sapien
attgcggcggagtgccgtggctcac

SEQ ID NO: 662551 - DNA, 25 bp, Homo sapien
ttgcggcggagtgccgtggctcacg

SEQ ID NO: 662552 - DNA, 25 bp, Homo sapien
tgcggcggagtgccgtggctcacgc

SEQ ID NO: 662553 - DNA, 25 bp, Homo sapien
gcggcggagtgccgtggctcacgcc

SEQ ID NO: 662554 - DNA, 25 bp, Homo sapien
cggcggagtgccgtggctcacgcct

SEQ ID NO: 662555 - DNA, 25 bp, Homo sapien
tctcagcactttgaggggcggaggt

SEQ ID NO: 662556 - DNA, 25 bp, Homo sapien
caggaatttgagacctggacaacat

SEQ ID NO: 662557 - DNA, 25 bp, Homo sapien
catggcgaaaaaccgcctctacaaa

SEQ ID NO: 662558 - DNA, 25 bp, Homo sapien
gggaaagcctaatcagtagaatcga

SEQ ID NO: 662559 - DNA, 25 bp, Homo sapien
cagtagaatcgagtgtttagtcaat

SEQ ID NO: 662560 - DNA, 25 bp, Homo sapien
atgtatttgacaggaggccatttta

SEQ ID NO: 662561 - DNA, 25 bp, Homo sapien
actttgtatttgtatgctgcaaaca

SEQ ID NO: 662562 - DNA, 25 bp, Homo sapien
taaagatcttgccagctggtgcctg

SEQ ID NO: 662563 - DNA, 25 bp, Homo sapien
gtgcctgggtgcatagactgcctat

SEQ ID NO: 662564 - DNA, 25 bp, Homo sapien
gcatagactgcctatggctcttgaa

SEQ ID NO: 662565 - DNA, 25 bp, Homo sapien
tgcctatggctcttgaattgcatgc

SEQ ID NO: 662566 - DNA, 25 bp, Homo sapien
gaattgcatgctgaaaacttcataa

SEQ ID NO: 662567 - DNA, 25 bp, Homo sapien
gaaaccagaaaatcacagaagcata

SEQ ID NO: 662568 - DNA, 25 bp, Homo sapien
aacacagctgcttatgcctataaag

SEQ ID NO: 662569 - DNA, 25 bp, Homo sapien
agttggatggcagcctggccgacat

SEQ ID NO: 662570 - DNA, 25 bp, Homo sapien
gaaaacttgtaattctctggctctt

SEQ ID NO: 662571 - DNA, 25 bp, Homo sapien
aaaacttgtaattctctggctctta

SEQ ID NO: 662572 - DNA, 25 bp, Homo sapien
aaacttgtaattctctggctcttaa

SEQ ID NO: 662573 - DNA, 25 bp, Homo sapien
aacttgtaattctctggctcttaaa

SEQ ID NO: 662574 - DNA, 25 bp, Homo sapien
cttgtaattctctggctcttaaatg

SEQ ID NO: 662575 - DNA, 25 bp, Homo sapien
gtaattctctggctcttaaatgctg

SEQ ID NO: 662576 - DNA, 25 bp, Homo sapien
aattctctggctcttaaatgctggc

SEQ ID NO: 662577 - DNA, 25 bp, Homo sapien
tggctcttaaatgctggcaatttta

SEQ ID NO: 662578 - DNA, 25 bp, Homo sapien
ggctcttaaatgctggcaattttat

SEQ ID NO: 662579 - DNA, 25 bp, Homo sapien
aaatgctggcaattttattagttcc

SEQ ID NO: 662580 - DNA, 25 bp, Homo sapien
tgagccttccgagagagcgcggcct

SEQ ID NO: 662581 - DNA, 25 bp, Homo sapien
cgcggcctgctgacacctgggtgtc

SEQ ID NO: 662582 - DNA, 25 bp, Homo sapien
gacacctgggtgtcagacttctggc

SEQ ID NO: 662583 - DNA, 25 bp, Homo sapien
cttctggcctgcagactgtcagaat

SEQ ID NO: 662584 - DNA, 25 bp, Homo sapien
gactgtcagaataagctcctgttgt

SEQ ID NO: 662585 - DNA, 25 bp, Homo sapien
gtcagaataagctcctgttgtttta

SEQ ID NO: 662586 - DNA, 25 bp, Homo sapien
agccacctggtttatggtaatttct

SEQ ID NO: 662587 - DNA, 25 bp, Homo sapien
gtaatttcttgcagcagacctagca

SEQ ID NO: 662588 - DNA, 25 bp, Homo sapien
gacctagcaaattaatagaccccat

SEQ ID NO: 662589 - DNA, 25 bp, Homo sapien
gaccccatagtcctgtaattcattt

SEQ ID NO: 662590 - DNA, 25 bp, Homo sapien
tgtaattcattttgcttaaacgagc

SEQ ID NO: 662591 - DNA, 25 bp, Homo sapien
ggccttcgggacatgataaggtcat

SEQ ID NO: 662592 - DNA, 25 bp, Homo sapien
gataaggtcatgaggatgaagccct

SEQ ID NO: 662593 - DNA, 25 bp, Homo sapien
ggatgaagccctcaagaataagatt

SEQ ID NO: 662594 - DNA, 25 bp, Homo sapien
gaagccctcaagaataagattcatt

SEQ ID NO: 662595 - DNA, 25 bp, Homo sapien
aagattcattgccttataaagaaaa

SEQ ID NO: 662596 - DNA, 25 bp, Homo sapien
agaaaaaccagaaagatccctcatt

SEQ ID NO: 662597 - DNA, 25 bp, Homo sapien
aagatccctcatttcttcaatcata

SEQ ID NO: 662598 - DNA, 25 bp, Homo sapien
agacacatgagcaagaagacggcca

SEQ ID NO: 662599 - DNA, 25 bp, Homo sapien
tgagcaagaagacggccagctatga

SEQ ID NO: 662600 - DNA, 25 bp, Homo sapien
cagctatgaagcaggtcgtgggccc

SEQ ID NO: 662601 - DNA, 25 bp, Homo sapien
tgaagcaggtcgtgggccctcgcca

SEQ ID NO: 662602 - DNA, 25 bp, Homo sapien
agaatgtcaattcaaatgggttatt

SEQ ID NO: 662603 - DNA, 25 bp, Homo sapien
atgtcaattcaaatgggttattcac

SEQ ID NO: 662604 - DNA, 25 bp, Homo sapien
gtcaattcaaatgggttattcacct

SEQ ID NO: 662605 - DNA, 25 bp, Homo sapien
aattcaaatgggttattcacctttg

SEQ ID NO: 662606 - DNA, 25 bp, Homo sapien
tcaaatgggttattcacctttgaaa

SEQ ID NO: 662607 - DNA, 25 bp, Homo sapien
atgggttattcacctttgaaaagag

SEQ ID NO: 662608 - DNA, 25 bp, Homo sapien
tgggttattcacctttgaaaagagg

SEQ ID NO: 662609 - DNA, 25 bp, Homo sapien
ctttgaaaagaggtgactatagttt

SEQ ID NO: 662610 - DNA, 25 bp, Homo sapien
aagacaaacatttaacatgatggat

SEQ ID NO: 662611 - DNA, 25 bp, Homo sapien
acaaacatttaacatgatggatatc

SEQ ID NO: 662612 - DNA, 25 bp, Homo sapien
tctttacaaatcacatgaatgtatc

SEQ ID NO: 662613 - DNA, 25 bp, Homo sapien
gttttgcaaagaaagtagcatttgg

SEQ ID NO: 662614 - DNA, 25 bp, Homo sapien
ttttgcaaagaaagtagcatttggg

SEQ ID NO: 662615 - DNA, 25 bp, Homo sapien
tttgcaaagaaagtagcatttgggc

SEQ ID NO: 662616 - DNA, 25 bp, Homo sapien
ttgcaaagaaagtagcatttgggcc

SEQ ID NO: 662617 - DNA, 25 bp, Homo sapien
tgcaaagaaagtagcatttgggccg

SEQ ID NO: 662618 - DNA, 25 bp, Homo sapien
gcaaagaaagtagcatttgggccgg

SEQ ID NO: 662619 - DNA, 25 bp, Homo sapien
aagaaagtagcatttgggccgggcg

SEQ ID NO: 662620 - DNA, 25 bp, Homo sapien
agaaagtagcatttgggccgggcgt

SEQ ID NO: 662621 - DNA, 25 bp, Homo sapien
gaaagtagcatttgggccgggcgtg

SEQ ID NO: 662622 - DNA, 25 bp, Homo sapien
aaagtagcatttgggccgggcgtgg

SEQ ID NO: 662623 - DNA, 25 bp, Homo sapien
aagtagcatttgggccgggcgtggt

SEQ ID NO: 662624 - DNA, 25 bp, Homo sapien
ctacttatgccatgggtggttccga

SEQ ID NO: 662625 - DNA, 25 bp, Homo sapien
gtggttccgaatcccttgaaacaag

SEQ ID NO: 662626 - DNA, 25 bp, Homo sapien
agaggactgttgttgttatcccggt

SEQ ID NO: 662627 - DNA, 25 bp, Homo sapien
gttatcccggtgtctaccatgaaga

SEQ ID NO: 662628 - DNA, 25 bp, Homo sapien
aagatggtatggatcccttcctagg

SEQ ID NO: 662629 - DNA, 25 bp, Homo sapien
gaaatggacattgacgcacactgga

SEQ ID NO: 662630 - DNA, 25 bp, Homo sapien
cattgacgcacactggaccatttta

SEQ ID NO: 662631 - DNA, 25 bp, Homo sapien
ctggaccattttatctgcacaacaa

SEQ ID NO: 662632 - DNA, 25 bp, Homo sapien
acaagtaaacagtattaggcccagt

SEQ ID NO: 662633 - DNA, 25 bp, Homo sapien
attaggcccagtttacagatgttaa

SEQ ID NO: 662634 - DNA, 25 bp, Homo sapien
attaaacagcttgcctaagttcatg

SEQ ID NO: 662635 - DNA, 25 bp, Homo sapien
tttctctataggagatactctccag

SEQ ID NO: 662636 - DNA, 25 bp, Homo sapien
ggagatactctccagtttaatgaat

SEQ ID NO: 662637 - DNA, 25 bp, Homo sapien
acttttgtcatgtaactggttctgt

SEQ ID NO: 662638 - DNA, 25 bp, Homo sapien
ggttctgtatttctatgcatgccaa

SEQ ID NO: 662639 - DNA, 25 bp, Homo sapien
atgcatgccaattatacacatctct

SEQ ID NO: 662640 - DNA, 25 bp, Homo sapien
ttatacacatctctatctgcatttt

SEQ ID NO: 662641 - DNA, 25 bp, Homo sapien
tttctattttaaccgctgaaggaat

SEQ ID NO: 662642 - DNA, 25 bp, Homo sapien
aaccgctgaaggaatatgattatac

SEQ ID NO: 662643 - DNA, 25 bp, Homo sapien
aatgccatactcaatggtggcagca

SEQ ID NO: 662644 - DNA, 25 bp, Homo sapien
ctcaatggtggcagcatttaattta

SEQ ID NO: 662645 - DNA, 25 bp, Homo sapien
aacattgtagctggatctgtttctg

SEQ ID NO: 662646 - DNA, 25 bp, Homo sapien
cagccactcctgctggcaaaagaag

SEQ ID NO: 662647 - DNA, 25 bp, Homo sapien
gaacagttctatcaatgtccttatt

SEQ ID NO: 662648 - DNA, 25 bp, Homo sapien
gtagggaccaaagtcgtatccagat

SEQ ID NO: 662649 - DNA, 25 bp, Homo sapien
aagtcgtatccagatgcacgtccta

SEQ ID NO: 662650 - DNA, 25 bp, Homo sapien
tatccagatgcacgtcctatcacag

SEQ ID NO: 662651 - DNA, 25 bp, Homo sapien
tatcacagcactcggtgcagccggt

SEQ ID NO: 662652 - DNA, 25 bp, Homo sapien
ggtgcagccggtcatctgctgtcct

SEQ ID NO: 662653 - DNA, 25 bp, Homo sapien
tcaggacgtcctcagcaacaaaatg

SEQ ID NO: 662654 - DNA, 25 bp, Homo sapien
aaatgcatctccaactgcatctgac

SEQ ID NO: 662655 - DNA, 25 bp, Homo sapien
aactgcatctgacgcatttgcacag

SEQ ID NO: 662656 - DNA, 25 bp, Homo sapien
atttgcacagtgtgtctccagactg

SEQ ID NO: 662657 - DNA, 25 bp, Homo sapien
agtaggaataaagatgctgacttca

SEQ ID NO: 662658 - DNA, 25 bp, Homo sapien
gtaggaataaagatgctgacttcag

SEQ ID NO: 662659 - DNA, 25 bp, Homo sapien
taggaataaagatgctgacttcagc

SEQ ID NO: 662660 - DNA, 25 bp, Homo sapien
aggaataaagatgctgacttcagct

SEQ ID NO: 662661 - DNA, 25 bp, Homo sapien
ggaataaagatgctgacttcagctg

SEQ ID NO: 662662 - DNA, 25 bp, Homo sapien
gaataaagatgctgacttcagctgg

SEQ ID NO: 662663 - DNA, 25 bp, Homo sapien
aataaagatgctgacttcagctggg

SEQ ID NO: 662664 - DNA, 25 bp, Homo sapien
ataaagatgctgacttcagctgggt

SEQ ID NO: 662665 - DNA, 25 bp, Homo sapien
aaagatgctgacttcagctgggtgc

SEQ ID NO: 662666 - DNA, 25 bp, Homo sapien
aagatgctgacttcagctgggtgca

SEQ ID NO: 662667 - DNA, 25 bp, Homo sapien
agatgctgacttcagctgggtgcag

SEQ ID NO: 662668 - DNA, 25 bp, Homo sapien
gggaaagcctaatcagtagaatcga

SEQ ID NO: 662669 - DNA, 25 bp, Homo sapien
cagtagaatcgagtgtttagtcaat

SEQ ID NO: 662670 - DNA, 25 bp, Homo sapien
aatcatatgtatttgacaggaggcc

SEQ ID NO: 662671 - DNA, 25 bp, Homo sapien
gtatttgacaggaggccattttaag

SEQ ID NO: 662672 - DNA, 25 bp, Homo sapien
actttgtatttgtatgctgcaaaca

SEQ ID NO: 662673 - DNA, 25 bp, Homo sapien
gtgcctgggtgcatagactgcctat

SEQ ID NO: 662674 - DNA, 25 bp, Homo sapien
gcatagactgcctatggctcttgaa

SEQ ID NO: 662675 - DNA, 25 bp, Homo sapien
tgcctatggctcttgaattgcatgc

SEQ ID NO: 662676 - DNA, 25 bp, Homo sapien
gaattgcatgctgaaaacttcataa

SEQ ID NO: 662677 - DNA, 25 bp, Homo sapien
gaaaccagaaaatcacagaagcata

SEQ ID NO: 662678 - DNA, 25 bp, Homo sapien
agctgcttatgcctataaagtaagt

SEQ ID NO: 662679 - DNA, 25 bp, Homo sapien
cagtttgtttgctcttcaaaaagtc

SEQ ID NO: 662680 - DNA, 25 bp, Homo sapien
agtttgtttgctcttcaaaaagtca

SEQ ID NO: 662681 - DNA, 25 bp, Homo sapien
gtttgtttgctcttcaaaaagtcaa

SEQ ID NO: 662682 - DNA, 25 bp, Homo sapien
tcttcaaaaagtcaacctgaggccg

SEQ ID NO: 662683 - DNA, 25 bp, Homo sapien
cttcaaaaagtcaacctgaggccgg

SEQ ID NO: 662684 - DNA, 25 bp, Homo sapien
ttcaaaaagtcaacctgaggccggg

SEQ ID NO: 662685 - DNA, 25 bp, Homo sapien
tcaaaaagtcaacctgaggccgggc

SEQ ID NO: 662686 - DNA, 25 bp, Homo sapien
caaaaagtcaacctgaggccgggcg

SEQ ID NO: 662687 - DNA, 25 bp, Homo sapien
aaaagtcaacctgaggccgggcgcg

SEQ ID NO: 662688 - DNA, 25 bp, Homo sapien
aaagtcaacctgaggccgggcgcgg

SEQ ID NO: 662689 - DNA, 25 bp, Homo sapien
aagtcaacctgaggccgggcgcggt

SEQ ID NO: 662690 - DNA, 25 bp, Homo sapien
gataaggtcatgaggatgaagccct

SEQ ID NO: 662691 - DNA, 25 bp, Homo sapien
ggatgaagccctcaagaataagatt

SEQ ID NO: 662692 - DNA, 25 bp, Homo sapien
gaagccctcaagaataagattcatt

SEQ ID NO: 662693 - DNA, 25 bp, Homo sapien
aagattcattgccttataaagaaaa

SEQ ID NO: 662694 - DNA, 25 bp, Homo sapien
agaaaaaccagaaagatccctcatt

SEQ ID NO: 662695 - DNA, 25 bp, Homo sapien
ttcaatcataagaagacacatgagc

SEQ ID NO: 662696 - DNA, 25 bp, Homo sapien
agacacatgagcaagaagacggcca

SEQ ID NO: 662697 - DNA, 25 bp, Homo sapien
tgagcaagaagacggccagctatga

SEQ ID NO: 662698 - DNA, 25 bp, Homo sapien
cagctatgaagcaggtcgtgggccc

SEQ ID NO: 662699 - DNA, 25 bp, Homo sapien
ctatgaagcaggtcgtgggccctcg

SEQ ID NO: 662700 - DNA, 25 bp, Homo sapien
tgaagcaggtcgtgggccctcgcca

SEQ ID NO: 662701 - DNA, 25 bp, Homo sapien
acatgtgcatgttcgtcacagggta

SEQ ID NO: 662702 - DNA, 25 bp, Homo sapien
gcatgttcgtcacagggtatattgt

SEQ ID NO: 662703 - DNA, 25 bp, Homo sapien
gaggttttggcttctattgatcctg

SEQ ID NO: 662704 - DNA, 25 bp, Homo sapien
tttggcttctattgatcctgtcacc

SEQ ID NO: 662705 - DNA, 25 bp, Homo sapien
cttctattgatcctgtcacccaaag

SEQ ID NO: 662706 - DNA, 25 bp, Homo sapien
ctattgatcctgtcacccaaagagt

SEQ ID NO: 662707 - DNA, 25 bp, Homo sapien
ttgatcctgtcacccaaagagtgaa

SEQ ID NO: 662708 - DNA, 25 bp, Homo sapien
gaacatagtccccagcaggaaattt

SEQ ID NO: 662709 - DNA, 25 bp, Homo sapien
catagtccccagcaggaaatttttt

SEQ ID NO: 662710 - DNA, 25 bp, Homo sapien
tcctgtatctgttattcccatcttt

SEQ ID NO: 662711 - DNA, 25 bp, Homo sapien
tgtatctgttattcccatctttatg

SEQ ID NO: 662712 - DNA, 25 bp, Homo sapien
tacaaaactttcctatacctcagcc

SEQ ID NO: 662713 - DNA, 25 bp, Homo sapien
ctttcctatacctcagcctttcttt

SEQ ID NO: 662714 - DNA, 25 bp, Homo sapien
gagtctctgcaaaacatatatgatg

SEQ ID NO: 662715 - DNA, 25 bp, Homo sapien
tatatgatgacagctgactttcttg

SEQ ID NO: 662716 - DNA, 25 bp, Homo sapien
gacagctgactttcttgttataaaa

SEQ ID NO: 662717 - DNA, 25 bp, Homo sapien
ctctctgttattattaggtgttatt

SEQ ID NO: 662718 - DNA, 25 bp, Homo sapien
ttcaggcagggtactatttaaaggt

SEQ ID NO: 662719 - DNA, 25 bp, Homo sapien
aatgttcatctcactactgttcttc

SEQ ID NO: 662720 - DNA, 25 bp, Homo sapien
gttcatctcactactgttcttctac

SEQ ID NO: 662721 - DNA, 25 bp, Homo sapien
gttcttctacacattactgtaagca

SEQ ID NO: 662722 - DNA, 25 bp, Homo sapien
attactgtaagcactaaccattata

SEQ ID NO: 662723 - DNA, 25 bp, Homo sapien
taaaagatactgaactagggctggg

SEQ ID NO: 662724 - DNA, 25 bp, Homo sapien
aaaagatactgaactagggctgggc

SEQ ID NO: 662725 - DNA, 25 bp, Homo sapien
aaagatactgaactagggctgggct

SEQ ID NO: 662726 - DNA, 25 bp, Homo sapien
aagatactgaactagggctgggctc

SEQ ID NO: 662727 - DNA, 25 bp, Homo sapien
agatactgaactagggctgggctca

SEQ ID NO: 662728 - DNA, 25 bp, Homo sapien
gatactgaactagggctgggctcag

SEQ ID NO: 662729 - DNA, 25 bp, Homo sapien
atactgaactagggctgggctcagt

SEQ ID NO: 662730 - DNA, 25 bp, Homo sapien
tactgaactagggctgggctcagtg

SEQ ID NO: 662731 - DNA, 25 bp, Homo sapien
gttcaagaccaacacggccaatgtg

SEQ ID NO: 662732 - DNA, 25 bp, Homo sapien
ttcaagaccaacacggccaatgtgg

SEQ ID NO: 662733 - DNA, 25 bp, Homo sapien
ccaacacggccaatgtggcgaaacc

SEQ ID NO: 662734 - DNA, 25 bp, Homo sapien
agagattgaaacaaggcttgggctg

SEQ ID NO: 662735 - DNA, 25 bp, Homo sapien
gagattgaaacaaggcttgggctga

SEQ ID NO: 662736 - DNA, 25 bp, Homo sapien
aaccacaaaaaacgagccaggcatt

SEQ ID NO: 662737 - DNA, 25 bp, Homo sapien
ggtggaatgatagattgagcctgag

SEQ ID NO: 662738 - DNA, 25 bp, Homo sapien
gtggaatgatagattgagcctgaga

SEQ ID NO: 662739 - DNA, 25 bp, Homo sapien
tggaatgatagattgagcctgagag

SEQ ID NO: 662740 - DNA, 25 bp, Homo sapien
ggaatgatagattgagcctgagagt

SEQ ID NO: 662741 - DNA, 25 bp, Homo sapien
gaatgatagattgagcctgagagtt

SEQ ID NO: 662742 - DNA, 25 bp, Homo sapien
gaacagagagttcaaatccttggct

SEQ ID NO: 662743 - DNA, 25 bp, Homo sapien
cagagagttcaaatccttggctggg

SEQ ID NO: 662744 - DNA, 25 bp, Homo sapien
acatggagttgtttgaggactaaat

SEQ ID NO: 662745 - DNA, 25 bp, Homo sapien
ggactaaatgtgatagttcaggctt

SEQ ID NO: 662746 - DNA, 25 bp, Homo sapien
atgtgatagttcaggcttggtttct

SEQ ID NO: 662747 - DNA, 25 bp, Homo sapien
gatagttcaggcttggtttctaata

SEQ ID NO: 662748 - DNA, 25 bp, Homo sapien
tagttcaggcttggtttctaatact

SEQ ID NO: 662749 - DNA, 25 bp, Homo sapien
ttctaatacttagtgagggctcctt

SEQ ID NO: 662750 - DNA, 25 bp, Homo sapien
aatacttagtgagggctccttggta

SEQ ID NO: 662751 - DNA, 25 bp, Homo sapien
cttagtgagggctccttggtagctg

SEQ ID NO: 662752 - DNA, 25 bp, Homo sapien
tgagggctccttggtagctggtgtt

SEQ ID NO: 662753 - DNA, 25 bp, Homo sapien
aattgagaagttaatctgtgagtca

SEQ ID NO: 662754 - DNA, 25 bp, Homo sapien
attgagaagttaatctgtgagtcaa

SEQ ID NO: 662755 - DNA, 25 bp, Homo sapien
tgagaagttaatctgtgagtcaagc

SEQ ID NO: 662756 - DNA, 25 bp, Homo sapien
gagaagttaatctgtgagtcaagct

SEQ ID NO: 662757 - DNA, 25 bp, Homo sapien
agaagttaatctgtgagtcaagctc

SEQ ID NO: 662758 - DNA, 25 bp, Homo sapien
gaagttaatctgtgagtcaagctcc

SEQ ID NO: 662759 - DNA, 25 bp, Homo sapien
aagttaatctgtgagtcaagctccc

SEQ ID NO: 662760 - DNA, 25 bp, Homo sapien
gagtcaagctcccacttcttaagtc

SEQ ID NO: 662761 - DNA, 25 bp, Homo sapien
agtcaagctcccacttcttaagtcc

SEQ ID NO: 662762 - DNA, 25 bp, Homo sapien
gtcaagctcccacttcttaagtcca

SEQ ID NO: 662763 - DNA, 25 bp, Homo sapien
tcaagctcccacttcttaagtccat

SEQ ID NO: 662764 - DNA, 25 bp, Homo sapien
gaaataacaactgctctggatcaag

SEQ ID NO: 662765 - DNA, 25 bp, Homo sapien
ataacaactgctctggatcaagtcc

SEQ ID NO: 662766 - DNA, 25 bp, Homo sapien
acaactgctctggatcaagtccagg

SEQ ID NO: 662767 - DNA, 25 bp, Homo sapien
tccaggaacagatattgggactaga

SEQ ID NO: 662768 - DNA, 25 bp, Homo sapien
tgggactagaaagagggattttcca

SEQ ID NO: 662769 - DNA, 25 bp, Homo sapien
aaaatggaaatgctactatgtgaaa

SEQ ID NO: 662770 - DNA, 25 bp, Homo sapien
gccatgtgtacagtatgagctatca

SEQ ID NO: 662771 - DNA, 25 bp, Homo sapien
gtacagtatgagctatcatgcttta

SEQ ID NO: 662772 - DNA, 25 bp, Homo sapien
agctatcatgctttatcaagtctga

SEQ ID NO: 662773 - DNA, 25 bp, Homo sapien
tcatgctttatcaagtctgaagaac

SEQ ID NO: 662774 - DNA, 25 bp, Homo sapien
taataacctcctaataaagtacatt

SEQ ID NO: 662775 - DNA, 25 bp, Homo sapien
acctggtttagaaattaggacatct

SEQ ID NO: 662776 - DNA, 25 bp, Homo sapien
aattaggacatctagagccagactt

SEQ ID NO: 662777 - DNA, 25 bp, Homo sapien
taggacatctagagccagacttaaa

SEQ ID NO: 662778 - DNA, 25 bp, Homo sapien
gacatctagagccagacttaaaatt

SEQ ID NO: 662779 - DNA, 25 bp, Homo sapien
aaattttatgaaaccaatgggcctg

SEQ ID NO: 662780 - DNA, 25 bp, Homo sapien
ttttatgaaaccaatgggcctgact

SEQ ID NO: 662781 - DNA, 25 bp, Homo sapien
tatgaaaccaatgggcctgactgat

SEQ ID NO: 662782 - DNA, 25 bp, Homo sapien
aaaccaatgggcctgactgatttaa

SEQ ID NO: 662783 - DNA, 25 bp, Homo sapien
aaccaatgggcctgactgatttaat

SEQ ID NO: 662784 - DNA, 25 bp, Homo sapien
ccaatgggcctgactgatttaatgt

SEQ ID NO: 662785 - DNA, 25 bp, Homo sapien
tgggcctgactgatttaatgtcatc

SEQ ID NO: 662786 - DNA, 25 bp, Homo sapien
attctgggctttcaggtacaaataa

SEQ ID NO: 662787 - DNA, 25 bp, Homo sapien
ttctgggctttcaggtacaaataaa

SEQ ID NO: 662788 - DNA, 25 bp, Homo sapien
ctgggctttcaggtacaaataaaat

SEQ ID NO: 662789 - DNA, 25 bp, Homo sapien
gggctttcaggtacaaataaaatga

SEQ ID NO: 662790 - DNA, 25 bp, Homo sapien
cttactattttcacaatttaggact

SEQ ID NO: 662791 - DNA, 25 bp, Homo sapien
tattttcacaatttaggactttcca

SEQ ID NO: 662792 - DNA, 25 bp, Homo sapien
attttcacaatttaggactttccat

SEQ ID NO: 662793 - DNA, 25 bp, Homo sapien
ttaggactttccatagactattaca

SEQ ID NO: 662794 - DNA, 25 bp, Homo sapien
aggactttccatagactattacaat

SEQ ID NO: 662795 - DNA, 25 bp, Homo sapien
gactttccatagactattacaattt

SEQ ID NO: 662796 - DNA, 25 bp, Homo sapien
tagactattacaatttatgtgaatt

SEQ ID NO: 662797 - DNA, 25 bp, Homo sapien
cctgtgactttaagctacttaaaag

SEQ ID NO: 662798 - DNA, 25 bp, Homo sapien
ctgtgactttaagctacttaaaaga

SEQ ID NO: 662799 - DNA, 25 bp, Homo sapien
tgtgactttaagctacttaaaagaa

SEQ ID NO: 662800 - DNA, 25 bp, Homo sapien
gaaaatttggccagacaccgtggct

SEQ ID NO: 662801 - DNA, 25 bp, Homo sapien
aaaatttggccagacaccgtggctc

SEQ ID NO: 662802 - DNA, 25 bp, Homo sapien
atttggccagacaccgtggctcact

SEQ ID NO: 662803 - DNA, 25 bp, Homo sapien
tttggccagacaccgtggctcactc

SEQ ID NO: 662804 - DNA, 25 bp, Homo sapien
ttggccagacaccgtggctcactcc

SEQ ID NO: 662805 - DNA, 25 bp, Homo sapien
tggccagacaccgtggctcactcct

SEQ ID NO: 662806 - DNA, 25 bp, Homo sapien
gggaagctgtggcaggcagatcacg

SEQ ID NO: 662807 - DNA, 25 bp, Homo sapien
attgcactccagccttggaacaaga

SEQ ID NO: 662808 - DNA, 25 bp, Homo sapien
gcgctgctcactgatttccgggggc

SEQ ID NO: 662809 - DNA, 25 bp, Homo sapien
gtggccgggcactcggagctggccg

SEQ ID NO: 662810 - DNA, 25 bp, Homo sapien
taggcccggaagtgtctggagaaaa

SEQ ID NO: 662811 - DNA, 25 bp, Homo sapien
aaggccaagggtcaccgatacctct

SEQ ID NO: 662812 - DNA, 25 bp, Homo sapien
ggccaagggtcaccgatacctctga

SEQ ID NO: 662813 - DNA, 25 bp, Homo sapien
aagggtcaccgatacctctgaggcg

SEQ ID NO: 662814 - DNA, 25 bp, Homo sapien
gtcaccgatacctctgaggcggctc

SEQ ID NO: 662815 - DNA, 25 bp, Homo sapien
ttctccaggtcacgtacctctccgt

SEQ ID NO: 662816 - DNA, 25 bp, Homo sapien
agcgctgagggcactccttttggga

SEQ ID NO: 662817 - DNA, 25 bp, Homo sapien
ctgagggcactccttttgggagcct

SEQ ID NO: 662818 - DNA, 25 bp, Homo sapien
gagggcactccttttgggagcctct

SEQ ID NO: 662819 - DNA, 25 bp, Homo sapien
ctcataagaataatgattacgggcc

SEQ ID NO: 662820 - DNA, 25 bp, Homo sapien
tcataagaataatgattacgggcca

SEQ ID NO: 662821 - DNA, 25 bp, Homo sapien
cataagaataatgattacgggccag

SEQ ID NO: 662822 - DNA, 25 bp, Homo sapien
ataagaataatgattacgggccagg

SEQ ID NO: 662823 - DNA, 25 bp, Homo sapien
taagaataatgattacgggccaggt

SEQ ID NO: 662824 - DNA, 25 bp, Homo sapien
aagaataatgattacgggccaggtg

SEQ ID NO: 662825 - DNA, 25 bp, Homo sapien
agaataatgattacgggccaggtgt

SEQ ID NO: 662826 - DNA, 25 bp, Homo sapien
aataatgattacgggccaggtgtgc

SEQ ID NO: 662827 - DNA, 25 bp, Homo sapien
ataatgattacgggccaggtgtgct

SEQ ID NO: 662828 - DNA, 25 bp, Homo sapien
taatgattacgggccaggtgtgctg

SEQ ID NO: 662829 - DNA, 25 bp, Homo sapien
atgattacgggccaggtgtgctggc

SEQ ID NO: 662830 - DNA, 25 bp, Homo sapien
tgttcgtacatctactctccttcta

SEQ ID NO: 662831 - DNA, 25 bp, Homo sapien
cgtacatctactctccttctaaaat

SEQ ID NO: 662832 - DNA, 25 bp, Homo sapien
tgcagctcagggtcgccatcacggt

SEQ ID NO: 662833 - DNA, 25 bp, Homo sapien
gctcagggtcgccatcacggtccta

SEQ ID NO: 662834 - DNA, 25 bp, Homo sapien
aggattgggaaattccagcctggtg

SEQ ID NO: 662835 - DNA, 25 bp, Homo sapien
gtgaattctagtcagaccggttgtc

SEQ ID NO: 662836 - DNA, 25 bp, Homo sapien
tgctctcaaactctctttcctgtta

SEQ ID NO: 662837 - DNA, 25 bp, Homo sapien
tcaaactctctttcctgttaagatg

SEQ ID NO: 662838 - DNA, 25 bp, Homo sapien
aggacatggaccctcatcagtaatt

SEQ ID NO: 662839 - DNA, 25 bp, Homo sapien
ggaccctcatcagtaattctaattt

SEQ ID NO: 662840 - DNA, 25 bp, Homo sapien
gtgatcttttattgccctttgaagc

SEQ ID NO: 662841 - DNA, 25 bp, Homo sapien
ttatcggaggtcagcccggctccta

SEQ ID NO: 662842 - DNA, 25 bp, Homo sapien
ccggctcctatttatttgtctgcag

SEQ ID NO: 662843 - DNA, 25 bp, Homo sapien
atttatttgtctgcagagcccgaaa

SEQ ID NO: 662844 - DNA, 25 bp, Homo sapien
gaaaggctccagtttagcttttgtt

SEQ ID NO: 662845 - DNA, 25 bp, Homo sapien
tgggtttgttttctgctagcaagtg

SEQ ID NO: 662846 - DNA, 25 bp, Homo sapien
tcttttccctgttgatctcctgtta

SEQ ID NO: 662847 - DNA, 25 bp, Homo sapien
tgatctcctgttacttttctccttg

SEQ ID NO: 662848 - DNA, 25 bp, Homo sapien
tttctccttggcttctgttggcact

SEQ ID NO: 662849 - DNA, 25 bp, Homo sapien
ggcactcacctcatttgactttgag

SEQ ID NO: 662850 - DNA, 25 bp, Homo sapien
gatgactctgcagaaatacttgggc

SEQ ID NO: 662851 - DNA, 25 bp, Homo sapien
gcaaagcaggtaacttcagagtcat

SEQ ID NO: 662852 - DNA, 25 bp, Homo sapien
taaagggctcactcatagggctgtt

SEQ ID NO: 662853 - DNA, 25 bp, Homo sapien
gggctcactcatagggctgttggca

SEQ ID NO: 662854 - DNA, 25 bp, Homo sapien
tcatagggctgttggcaggatgcct

SEQ ID NO: 662855 - DNA, 25 bp, Homo sapien
accacatgggcctctcagtagggtt

SEQ ID NO: 662856 - DNA, 25 bp, Homo sapien
atgggcctctcagtagggttgcttg

SEQ ID NO: 662857 - DNA, 25 bp, Homo sapien
ctctcagtagggttgcttgtgtgtc

SEQ ID NO: 662858 - DNA, 25 bp, Homo sapien
cttgtgtgtccttgtatcacggcaa

SEQ ID NO: 662859 - DNA, 25 bp, Homo sapien
gtgtccttgtatcacggcaactggc

SEQ ID NO: 662860 - DNA, 25 bp, Homo sapien
ttgtatcacggcaactggcttcccc

SEQ ID NO: 662861 - DNA, 25 bp, Homo sapien
cccacttggatcttgcaagtgagct

SEQ ID NO: 662862 - DNA, 25 bp, Homo sapien
gctgagagaacaaagtagaaaccat

SEQ ID NO: 662863 - DNA, 25 bp, Homo sapien
gggagaaggtatgttctatagtcct

SEQ ID NO: 662864 - DNA, 25 bp, Homo sapien
aagtctcagtcagttaagtcagcct

SEQ ID NO: 662865 - DNA, 25 bp, Homo sapien
agttaagtcagcctgtgcccctgct

SEQ ID NO: 662866 - DNA, 25 bp, Homo sapien
gaccttcacaagtgctttcagcttt

SEQ ID NO: 662867 - DNA, 25 bp, Homo sapien
tcttttgtcactttggtgagacagg

SEQ ID NO: 662868 - DNA, 25 bp, Homo sapien
agctggagttgggtgcttcctttcc

SEQ ID NO: 662869 - DNA, 25 bp, Homo sapien
ccccaggtcaacgaggctctggtaa

SEQ ID NO: 662870 - DNA, 25 bp, Homo sapien
ggctctggtaaaatagtttcccttg

SEQ ID NO: 662871 - DNA, 25 bp, Homo sapien
gtttcccttgagaactggcttttgt

SEQ ID NO: 662872 - DNA, 25 bp, Homo sapien
ggagaactgaacacttgggcatatt

SEQ ID NO: 662873 - DNA, 25 bp, Homo sapien
tttccctatcctcataccagaagag

SEQ ID NO: 662874 - DNA, 25 bp, Homo sapien
agtaacgtatgtagtcttcttgtca

SEQ ID NO: 662875 - DNA, 25 bp, Homo sapien
taacgtatgtagtcttcttgtcatg

SEQ ID NO: 662876 - DNA, 25 bp, Homo sapien
acgtatgtagtcttcttgtcatgta

SEQ ID NO: 662877 - DNA, 25 bp, Homo sapien
gtatgtagtcttcttgtcatgtagg

SEQ ID NO: 662878 - DNA, 25 bp, Homo sapien
gtagtcttcttgtcatgtaggtccc

SEQ ID NO: 662879 - DNA, 25 bp, Homo sapien
agtcttcttgtcatgtaggtcccaa

SEQ ID NO: 662880 - DNA, 25 bp, Homo sapien
gtcttcttgtcatgtaggtcccaat

SEQ ID NO: 662881 - DNA, 25 bp, Homo sapien
cttcttgtcatgtaggtcccaatta

SEQ ID NO: 662882 - DNA, 25 bp, Homo sapien
tcttgtcatgtaggtcccaattaaa

SEQ ID NO: 662883 - DNA, 25 bp, Homo sapien
gggacttaaaattatgatgtgaaaa

SEQ ID NO: 662884 - DNA, 25 bp, Homo sapien
aattatgtagagtatcagacttttt

SEQ ID NO: 662885 - DNA, 25 bp, Homo sapien
gatgttttttgtgttgtattcaaga

SEQ ID NO: 662886 - DNA, 25 bp, Homo sapien
gtattcaagaaatctttgtcatgca

SEQ ID NO: 662887 - DNA, 25 bp, Homo sapien
aaatctttgtcatgcaaaggtcact

SEQ ID NO: 662888 - DNA, 25 bp, Homo sapien
atctttgtcatgcaaaggtcactta

SEQ ID NO: 662889 - DNA, 25 bp, Homo sapien
tttgtcatgcaaaggtcacttaaga

SEQ ID NO: 662890 - DNA, 25 bp, Homo sapien
ttgtcatgcaaaggtcacttaagat

SEQ ID NO: 662891 - DNA, 25 bp, Homo sapien
gtcatgcaaaggtcacttaagattt

SEQ ID NO: 662892 - DNA, 25 bp, Homo sapien
catgcaaaggtcacttaagattttc

SEQ ID NO: 662893 - DNA, 25 bp, Homo sapien
taagattttctgtaagtttttggct

SEQ ID NO: 662894 - DNA, 25 bp, Homo sapien
gtcaacagggtgaaaccgcatgtct

SEQ ID NO: 662895 - DNA, 25 bp, Homo sapien
ctgggtgtgttggtgaattgcttga

SEQ ID NO: 662896 - DNA, 25 bp, Homo sapien
gagctccttaatgtgcaaatcagga

SEQ ID NO: 662897 - DNA, 25 bp, Homo sapien
ttaattgaatgagcaagaccctaaa

SEQ ID NO: 662898 - DNA, 25 bp, Homo sapien
gacagaatcccgagtcttccaagag

SEQ ID NO: 662899 - DNA, 25 bp, Homo sapien
atcccgagtcttccaagagacagaa

SEQ ID NO: 662900 - DNA, 25 bp, Homo sapien
gaaagaatacaaagctctggaaacc

SEQ ID NO: 662901 - DNA, 25 bp, Homo sapien
gacaagtctgaccaatgtctaaaat

SEQ ID NO: 662902 - DNA, 25 bp, Homo sapien
gtaaacctaaaactgagtgttctca

SEQ ID NO: 662903 - DNA, 25 bp, Homo sapien
gagtgttctcactagtaaacaatga

SEQ ID NO: 662904 - DNA, 25 bp, Homo sapien
aaccccaacagtttcatcagacagc

SEQ ID NO: 662905 - DNA, 25 bp, Homo sapien
aacagtttcatcagacagcaatcat

SEQ ID NO: 662906 - DNA, 25 bp, Homo sapien
catgataaatgcatctattacacta

SEQ ID NO: 662907 - DNA, 25 bp, Homo sapien
gacctaatggagttcaggacgctat

SEQ ID NO: 662908 - DNA, 25 bp, Homo sapien
caggacgctatgactgttggcacct

SEQ ID NO: 662909 - DNA, 25 bp, Homo sapien
gttggcacctgatgtgcacagctgc

SEQ ID NO: 662910 - DNA, 25 bp, Homo sapien
gctgctcccatctgcgcagagagaa

SEQ ID NO: 662911 - DNA, 25 bp, Homo sapien
agtggcgctgaaacatctgctgctt

SEQ ID NO: 662912 - DNA, 25 bp, Homo sapien
tgctttcactcaccatcaagatgga

SEQ ID NO: 662913 - DNA, 25 bp, Homo sapien
ggaactgactgtacatgcaagcaaa

SEQ ID NO: 662914 - DNA, 25 bp, Homo sapien
gaagataagttgtttctccttgaca

SEQ ID NO: 662915 - DNA, 25 bp, Homo sapien
gtttctccttgacacctaggaatgc

SEQ ID NO: 662916 - DNA, 25 bp, Homo sapien
acctaggaatgcacctggccaagac

SEQ ID NO: 662917 - DNA, 25 bp, Homo sapien
ctggccaagaccctcagttgaaaga

SEQ ID NO: 662918 - DNA, 25 bp, Homo sapien
ctactgatcaaagtctcctggccgg

SEQ ID NO: 662919 - DNA, 25 bp, Homo sapien
tactgatcaaagtctcctggccggg

SEQ ID NO: 662920 - DNA, 25 bp, Homo sapien
actgatcaaagtctcctggccgggc

SEQ ID NO: 662921 - DNA, 25 bp, Homo sapien
ctgatcaaagtctcctggccgggca

SEQ ID NO: 662922 - DNA, 25 bp, Homo sapien
tgatcaaagtctcctggccgggcac

SEQ ID NO: 662923 - DNA, 25 bp, Homo sapien
gatcaaagtctcctggccgggcacg

SEQ ID NO: 662924 - DNA, 25 bp, Homo sapien
atcaaagtctcctggccgggcacgg

SEQ ID NO: 662925 - DNA, 25 bp, Homo sapien
tcaaagtctcctggccgggcacggt

SEQ ID NO: 662926 - DNA, 25 bp, Homo sapien
gccgggcgtggcagggtgcgcctga

SEQ ID NO: 662927 - DNA, 25 bp, Homo sapien
ccttttccccaaatcatcatggact

SEQ ID NO: 662928 - DNA, 25 bp, Homo sapien
atcatcatggactttgaggagcatc

SEQ ID NO: 662929 - DNA, 25 bp, Homo sapien
catggactttgaggagcatcagaat

SEQ ID NO: 662930 - DNA, 25 bp, Homo sapien
gactttgaggagcatcagaatgatg

SEQ ID NO: 662931 - DNA, 25 bp, Homo sapien
gaatgatgtaaaagtgtcttgtttt

SEQ ID NO: 662932 - DNA, 25 bp, Homo sapien
gattttaatccatcttaattgttct

SEQ ID NO: 662933 - DNA, 25 bp, Homo sapien
aattgttctatttgtgaattatcaa

SEQ ID NO: 662934 - DNA, 25 bp, Homo sapien
atttttagggactcaagagcaaaat

SEQ ID NO: 662935 - DNA, 25 bp, Homo sapien
actttagcaaagatctggccagtat

SEQ ID NO: 662936 - DNA, 25 bp, Homo sapien
tagcaaagatctggccagtataaaa

SEQ ID NO: 662937 - DNA, 25 bp, Homo sapien
aaaatcttcaatcctgtttccttcg

SEQ ID NO: 662938 - DNA, 25 bp, Homo sapien
tacaaaatttgtcactcctccgaga

SEQ ID NO: 662939 - DNA, 25 bp, Homo sapien
aaaatttgtcactcctccgagagac

SEQ ID NO: 662940 - DNA, 25 bp, Homo sapien
gtcactcctccgagagacacttaat

SEQ ID NO: 662941 - DNA, 25 bp, Homo sapien
agacacttaatatttgacctggttc

SEQ ID NO: 662942 - DNA, 25 bp, Homo sapien
aatatttgacctggttcacatgaga

SEQ ID NO: 662943 - DNA, 25 bp, Homo sapien
gacctggttcacatgagagaattct

SEQ ID NO: 662944 - DNA, 25 bp, Homo sapien
gatgtcttctctggaacatgtagtt

SEQ ID NO: 662945 - DNA, 25 bp, Homo sapien
agttttatgtaacaacataccacag

SEQ ID NO: 662946 - DNA, 25 bp, Homo sapien
accacagtaatggaccttcttctat

SEQ ID NO: 662947 - DNA, 25 bp, Homo sapien
gtaatggaccttcttctataattca

SEQ ID NO: 662948 - DNA, 25 bp, Homo sapien
atggaccttcttctataattcatag

SEQ ID NO: 662949 - DNA, 25 bp, Homo sapien
atgagacccccaacaaatagccctt

SEQ ID NO: 662950 - DNA, 25 bp, Homo sapien
caaaaaaaattttgctgccccagtg

SEQ ID NO: 662951 - DNA, 25 bp, Homo sapien
tcatcggtatttaggcccctccaac

SEQ ID NO: 662952 - DNA, 25 bp, Homo sapien
catcggtatttaggcccctccaact

SEQ ID NO: 662953 - DNA, 25 bp, Homo sapien
gtatttaggcccctccaactcatga

SEQ ID NO: 662954 - DNA, 25 bp, Homo sapien
tatttaggcccctccaactcatgag

SEQ ID NO: 662955 - DNA, 25 bp, Homo sapien
atttaggcccctccaactcatgaga

SEQ ID NO: 662956 - DNA, 25 bp, Homo sapien
tttaggcccctccaactcatgagac

SEQ ID NO: 662957 - DNA, 25 bp, Homo sapien
ttaggcccctccaactcatgagacc

SEQ ID NO: 662958 - DNA, 25 bp, Homo sapien
taggcccctccaactcatgagaccc

SEQ ID NO: 662959 - DNA, 25 bp, Homo sapien
caactcatgagacccccaacaaata

SEQ ID NO: 662960 - DNA, 25 bp, Homo sapien
gcataagatgaattggcgaagggtt

SEQ ID NO: 662961 - DNA, 25 bp, Homo sapien
ttggcgaagggtttgaacatattat

SEQ ID NO: 662962 - DNA, 25 bp, Homo sapien
gagaacattttttactggccaatga

SEQ ID NO: 662963 - DNA, 25 bp, Homo sapien
tttactggccaatgaacttcgtagc

SEQ ID NO: 662964 - DNA, 25 bp, Homo sapien
gccaatgaacttcgtagccaaaaac

SEQ ID NO: 662965 - DNA, 25 bp, Homo sapien
cttcgtagccaaaaacatgttgttg

SEQ ID NO: 662966 - DNA, 25 bp, Homo sapien
ggcctggctgatggcaaacagtaaa

SEQ ID NO: 662967 - DNA, 25 bp, Homo sapien
tggaatcataaacccccaaataatt

SEQ ID NO: 662968 - DNA, 25 bp, Homo sapien
ccccaaataattatcacctgtaaat

SEQ ID NO: 662969 - DNA, 25 bp, Homo sapien
tatcacctgtaaatcaatgtcataa

SEQ ID NO: 662970 - DNA, 25 bp, Homo sapien
ggcatttaaaaagtatcaggcaagt

SEQ ID NO: 662971 - DNA, 25 bp, Homo sapien
ggagagggtcatacactccctagtg

SEQ ID NO: 662972 - DNA, 25 bp, Homo sapien
gtcatacactccctagtgacttcta

SEQ ID NO: 662973 - DNA, 25 bp, Homo sapien
tagtgacttctactctatgctccag

SEQ ID NO: 662974 - DNA, 25 bp, Homo sapien
ccatccccttggttacacacaaata

SEQ ID NO: 662975 - DNA, 25 bp, Homo sapien
gttacacacaaatatcaccagtctt

SEQ ID NO: 662976 - DNA, 25 bp, Homo sapien
tatcaccagtctttacatgtacttt

SEQ ID NO: 662977 - DNA, 25 bp, Homo sapien
tgacttctcagataataccctccaa

SEQ ID NO: 662978 - DNA, 25 bp, Homo sapien
ataccctccaacaagataactgcag

SEQ ID NO: 662979 - DNA, 25 bp, Homo sapien
ggacttgccaccatgacctgagaaa

SEQ ID NO: 662980 - DNA, 25 bp, Homo sapien
tgacctgagaaatacaccaagatat

SEQ ID NO: 662981 - DNA, 25 bp, Homo sapien
ttctcatacttttaacatactctgc

SEQ ID NO: 662982 - DNA, 25 bp, Homo sapien
agccattgctagctgagtaaataac

SEQ ID NO: 662983 - DNA, 25 bp, Homo sapien
gccattgctagctgagtaaataaca

SEQ ID NO: 662984 - DNA, 25 bp, Homo sapien
cattgctagctgagtaaataacacc

SEQ ID NO: 662985 - DNA, 25 bp, Homo sapien
ttgctagctgagtaaataacaccat

SEQ ID NO: 662986 - DNA, 25 bp, Homo sapien
tgctagctgagtaaataacaccata

SEQ ID NO: 662987 - DNA, 25 bp, Homo sapien
gctagctgagtaaataacaccatag

SEQ ID NO: 662988 - DNA, 25 bp, Homo sapien
aataacaccatagatgccgggtgca

SEQ ID NO: 662989 - DNA, 25 bp, Homo sapien
ataacaccatagatgccgggtgcag

SEQ ID NO: 662990 - DNA, 25 bp, Homo sapien
taacaccatagatgccgggtgcagt

SEQ ID NO: 662991 - DNA, 25 bp, Homo sapien
aacaccatagatgccgggtgcagtg

SEQ ID NO: 662992 - DNA, 25 bp, Homo sapien
catagatgccgggtgcagtgactca

SEQ ID NO: 662993 - DNA, 25 bp, Homo sapien
aaggcactatgttcttctactgggc

SEQ ID NO: 662994 - DNA, 25 bp, Homo sapien
atgttcttctactgggcatgaggaa

SEQ ID NO: 662995 - DNA, 25 bp, Homo sapien
gggtaaatgtagcagacctttcttt

SEQ ID NO: 662996 - DNA, 25 bp, Homo sapien
atgtagcagacctttcttttctctc

SEQ ID NO: 662997 - DNA, 25 bp, Homo sapien
ttttctctctatatggctctggaca

SEQ ID NO: 662998 - DNA, 25 bp, Homo sapien
tatatggctctggacatcgtgctca

SEQ ID NO: 662999 - DNA, 25 bp, Homo sapien
tggacatcgtgctcacatggtgcac

SEQ ID NO: 663000 - DNA, 25 bp, Homo sapien
tggtgcacacacttactttatttat

SEQ ID NO: 663001 - DNA, 25 bp, Homo sapien
gaattatggcctgtggtattttgat

SEQ ID NO: 663002 - DNA, 25 bp, Homo sapien
gtggtattttgatatggcattttgc

SEQ ID NO: 663003 - DNA, 25 bp, Homo sapien
ggcattttgctaatgtaccttgtgt

SEQ ID NO: 663004 - DNA, 25 bp, Homo sapien
aggatggtctcagggaccctgacac

SEQ ID NO: 663005 - DNA, 25 bp, Homo sapien
ggaccctgacacagcaccaaagaga

SEQ ID NO: 663006 - DNA, 25 bp, Homo sapien
agcagactcaaaaaccccgtgacat

SEQ ID NO: 663007 - DNA, 25 bp, Homo sapien
gtgacatccctgagcatctcaacat

SEQ ID NO: 663008 - DNA, 25 bp, Homo sapien
gtgtgacactaggtgtccacattct

SEQ ID NO: 663009 - DNA, 25 bp, Homo sapien
acattctctcttcactggtgaatgg

SEQ ID NO: 663010 - DNA, 25 bp, Homo sapien
gtgaatggacacctgtgattgttgt

SEQ ID NO: 663011 - DNA, 25 bp, Homo sapien
cctgtgattgttgttcactgttggc

SEQ ID NO: 663012 - DNA, 25 bp, Homo sapien
tggcatcaccaccacataccattat

SEQ ID NO: 663013 - DNA, 25 bp, Homo sapien
cataccattatgcttggcatgtcat

SEQ ID NO: 663014 - DNA, 25 bp, Homo sapien
gtcattgatgcccaagagtatccat

SEQ ID NO: 663015 - DNA, 25 bp, Homo sapien
ttaaaaacaataatgagggccaggc

SEQ ID NO: 663016 - DNA, 25 bp, Homo sapien
aaaaacaataatgagggccaggcat

SEQ ID NO: 663017 - DNA, 25 bp, Homo sapien
aaacaataatgagggccaggcatgg

SEQ ID NO: 663018 - DNA, 25 bp, Homo sapien
aagctgaagcaagataactgcttga

SEQ ID NO: 663019 - DNA, 25 bp, Homo sapien
agctgaagcaagataactgcttgat

SEQ ID NO: 663020 - DNA, 25 bp, Homo sapien
gctgaagcaagataactgcttgatc

SEQ ID NO: 663021 - DNA, 25 bp, Homo sapien
ctgaagcaagataactgcttgatcc

SEQ ID NO: 663022 - DNA, 25 bp, Homo sapien
tgaagcaagataactgcttgatccc

SEQ ID NO: 663023 - DNA, 25 bp, Homo sapien
aagcaagataactgcttgatcccag

SEQ ID NO: 663024 - DNA, 25 bp, Homo sapien
agcaagataactgcttgatcccagg

SEQ ID NO: 663025 - DNA, 25 bp, Homo sapien
gcaagataactgcttgatcccagga

SEQ ID NO: 663026 - DNA, 25 bp, Homo sapien
aaacagagatggcaattattcaatt

SEQ ID NO: 663027 - DNA, 25 bp, Homo sapien
gaatgctcatcttgtagaagtcaga

SEQ ID NO: 663028 - DNA, 25 bp, Homo sapien
atcttgtagaagtcagaacactgat

SEQ ID NO: 663029 - DNA, 25 bp, Homo sapien
acactgatttgtattatggcttcct

SEQ ID NO: 663030 - DNA, 25 bp, Homo sapien
tgatttgtattatggcttcctttgt

SEQ ID NO: 663031 - DNA, 25 bp, Homo sapien
gttttcttctatttgcatgtatgca

SEQ ID NO: 663032 - DNA, 25 bp, Homo sapien
tatagcttactatatttcgtttttt

SEQ ID NO: 663033 - DNA, 25 bp, Homo sapien
attgtcaactgacagatgtcttgta

SEQ ID NO: 663034 - DNA, 25 bp, Homo sapien
gacagatgtcttgtacatggtaact

SEQ ID NO: 663035 - DNA, 25 bp, Homo sapien
gtcttgtacatggtaacttgtttat

SEQ ID NO: 663036 - DNA, 25 bp, Homo sapien
acatggtaacttgtttatatgattc

SEQ ID NO: 663037 - DNA, 25 bp, Homo sapien
gcagccactgacaggtaggtctggc

SEQ ID NO: 663038 - DNA, 25 bp, Homo sapien
agccactgacaggtaggtctggcac

SEQ ID NO: 663039 - DNA, 25 bp, Homo sapien
cactgacaggtaggtctggcaccct

SEQ ID NO: 663040 - DNA, 25 bp, Homo sapien
actgacaggtaggtctggcacccta

SEQ ID NO: 663041 - DNA, 25 bp, Homo sapien
tgacaggtaggtctggcaccctagc

SEQ ID NO: 663042 - DNA, 25 bp, Homo sapien
acaggtaggtctggcaccctagcca

SEQ ID NO: 663043 - DNA, 25 bp, Homo sapien
aggtaggtctggcaccctagccagc

SEQ ID NO: 663044 - DNA, 25 bp, Homo sapien
gtaggtctggcaccctagccagcct

SEQ ID NO: 663045 - DNA, 25 bp, Homo sapien
tggcaccctagccagcctttaaaac

SEQ ID NO: 663046 - DNA, 25 bp, Homo sapien
accctagccagcctttaaaactgca

SEQ ID NO: 663047 - DNA, 25 bp, Homo sapien
ctagccagcctttaaaactgcactt

SEQ ID NO: 663048 - DNA, 25 bp, Homo sapien
gtaagtgatgacaccaactgtgtaa

SEQ ID NO: 663049 - DNA, 25 bp, Homo sapien
aagttattcaaaacccagtgcttag

SEQ ID NO: 663050 - DNA, 25 bp, Homo sapien
aacccagtgcttagatctggcttta

SEQ ID NO: 663051 - DNA, 25 bp, Homo sapien
agatctggctttatgtctgaacttc

SEQ ID NO: 663052 - DNA, 25 bp, Homo sapien
gacttgtaaaatgtggactcctcta

SEQ ID NO: 663053 - DNA, 25 bp, Homo sapien
gtggactcctctataagatcttgaa

SEQ ID NO: 663054 - DNA, 25 bp, Homo sapien
aaatgtccatcagaatactgtttaa

SEQ ID NO: 663055 - DNA, 25 bp, Homo sapien
gttgcaagagcaatctgacagtgga

SEQ ID NO: 663056 - DNA, 25 bp, Homo sapien
gtgttaatacacatcttgtgactag

SEQ ID NO: 663057 - DNA, 25 bp, Homo sapien
catcttgtgactagggatttctgag

SEQ ID NO: 663058 - DNA, 25 bp, Homo sapien
gatttctgagtgttggagaggtcaa

SEQ ID NO: 663059 - DNA, 25 bp, Homo sapien
tgctattatgaaaatctcttagtaa

SEQ ID NO: 663060 - DNA, 25 bp, Homo sapien
taaatagctgcagccctgttcattt

SEQ ID NO: 663061 - DNA, 25 bp, Homo sapien
gcagccctgttcatttaaggcgtta

SEQ ID NO: 663062 - DNA, 25 bp, Homo sapien
ctgttcatttaaggcgttagctact

SEQ ID NO: 663063 - DNA, 25 bp, Homo sapien
ggcgttagctacttaatctcttaaa

SEQ ID NO: 663064 - DNA, 25 bp, Homo sapien
atctcttaaaatcaatcccctaggg

SEQ ID NO: 663065 - DNA, 25 bp, Homo sapien
tcccctagggagagtactgatttat

SEQ ID NO: 663066 - DNA, 25 bp, Homo sapien
gaaattctaagtgaagatcagtcaa

SEQ ID NO: 663067 - DNA, 25 bp, Homo sapien
cagtcaatgatgttgttagtacact

SEQ ID NO: 663068 - DNA, 25 bp, Homo sapien
gtacacttaatactttatctttcta

SEQ ID NO: 663069 - DNA, 25 bp, Homo sapien
tattttacattgtataacccaccca

SEQ ID NO: 663070 - DNA, 25 bp, Homo sapien
ccaagataagtaacgatcccgttga

SEQ ID NO: 663071 - DNA, 25 bp, Homo sapien
gataagtaacgatcccgttgaagat

SEQ ID NO: 663072 - DNA, 25 bp, Homo sapien
tcccgttgaagataccacattacac

SEQ ID NO: 663073 - DNA, 25 bp, Homo sapien
ccacattacacttaggctcctgttg

SEQ ID NO: 663074 - DNA, 25 bp, Homo sapien
acattacacttaggctcctgttggc

SEQ ID NO: 663075 - DNA, 25 bp, Homo sapien
tgttggccatgacagcttcttagac

SEQ ID NO: 663076 - DNA, 25 bp, Homo sapien
tggccatgacagcttcttagacttg

SEQ ID NO: 663077 - DNA, 25 bp, Homo sapien
gccatgacagcttcttagacttgtt

SEQ ID NO: 663078 - DNA, 25 bp, Homo sapien
tgacagcttcttagacttgttttta

SEQ ID NO: 663079 - DNA, 25 bp, Homo sapien
gcttcttagacttgtttttaatgac

SEQ ID NO: 663080 - DNA, 25 bp, Homo sapien
tttaatgaccttgacaggttttgtt

SEQ ID NO: 663081 - DNA, 25 bp, Homo sapien
tgttgtacagtacaatcctgtatta

SEQ ID NO: 663082 - DNA, 25 bp, Homo sapien
aaagcatggcgaagataagtattac

SEQ ID NO: 663083 - DNA, 25 bp, Homo sapien
tttgggcactcttaaaatattagga

SEQ ID NO: 663084 - DNA, 25 bp, Homo sapien
gaaacgtgtaactacacaagggcac

SEQ ID NO: 663085 - DNA, 25 bp, Homo sapien
acacaagggcacacaaccaaagaga

SEQ ID NO: 663086 - DNA, 25 bp, Homo sapien
ggctaaaatctagcctatgtcccac

SEQ ID NO: 663087 - DNA, 25 bp, Homo sapien
atgtcccaccatagcttaagtaatt

SEQ ID NO: 663088 - DNA, 25 bp, Homo sapien
gtaagtactttattagacacatgat

SEQ ID NO: 663089 - DNA, 25 bp, Homo sapien
tagacacatgattccttgattttct

SEQ ID NO: 663090 - DNA, 25 bp, Homo sapien
gattttctatagcaagggtcccaac

SEQ ID NO: 663091 - DNA, 25 bp, Homo sapien
gggtcccaacagacttattctactt

SEQ ID NO: 663092 - DNA, 25 bp, Homo sapien
aagagaaaaaaagaggctgggcgct

SEQ ID NO: 663093 - DNA, 25 bp, Homo sapien
agagaaaaaaagaggctgggcgctg

SEQ ID NO: 663094 - DNA, 25 bp, Homo sapien
gagaaaaaaagaggctgggcgctgt

SEQ ID NO: 663095 - DNA, 25 bp, Homo sapien
agaaaaaaagaggctgggcgctgtg

SEQ ID NO: 663096 - DNA, 25 bp, Homo sapien
tggtcaaatggtgaagccctgactc

SEQ ID NO: 663097 - DNA, 25 bp, Homo sapien
ggtcaaatggtgaagccctgactct

SEQ ID NO: 663098 - DNA, 25 bp, Homo sapien
gtcaaatggtgaagccctgactcta

SEQ ID NO: 663099 - DNA, 25 bp, Homo sapien
tcaaatggtgaagccctgactctac

SEQ ID NO: 663100 - DNA, 25 bp, Homo sapien
caaatggtgaagccctgactctact

SEQ ID NO: 663101 - DNA, 25 bp, Homo sapien
acgtgcctgtgatgccagcgactcg

SEQ ID NO: 663102 - DNA, 25 bp, Homo sapien
cgtgcctgtgatgccagcgactcgg

SEQ ID NO: 663103 - DNA, 25 bp, Homo sapien
aggagcctgctcagctggtgcacct

SEQ ID NO: 663104 - DNA, 25 bp, Homo sapien
ggtgcacctgtgctagaccagaagc

SEQ ID NO: 663105 - DNA, 25 bp, Homo sapien
gaatgaatcctccagagtggccttc

SEQ ID NO: 663106 - DNA, 25 bp, Homo sapien
tggccttccccaagggctgagtgga

SEQ ID NO: 663107 - DNA, 25 bp, Homo sapien
gggtgtgcatctactctgactccca

SEQ ID NO: 663108 - DNA, 25 bp, Homo sapien
tctgactcccagagttaccagtggg

SEQ ID NO: 663109 - DNA, 25 bp, Homo sapien
gagggtccacacctgtagcagtaat

SEQ ID NO: 663110 - DNA, 25 bp, Homo sapien
gtagcagtaatctccttggtaacct

SEQ ID NO: 663111 - DNA, 25 bp, Homo sapien
ttggtaaccttcactttactggtgt

SEQ ID NO: 663112 - DNA, 25 bp, Homo sapien
ttactggtgttctttgcgttcctat

SEQ ID NO: 663113 - DNA, 25 bp, Homo sapien
gcgttcctatttcacttccacattt

SEQ ID NO: 663114 - DNA, 25 bp, Homo sapien
ttttcctcagattactttcagtact

SEQ ID NO: 663115 - DNA, 25 bp, Homo sapien
tttaatctttggtctgcagcagttg

SEQ ID NO: 663116 - DNA, 25 bp, Homo sapien
gcagcagttggactataatatgcct

SEQ ID NO: 663117 - DNA, 25 bp, Homo sapien
tttcatcatattcatctggcttgga

SEQ ID NO: 663118 - DNA, 25 bp, Homo sapien
ctggcttggagtttgctgaacttct

SEQ ID NO: 663119 - DNA, 25 bp, Homo sapien
tgctgaacttcttgagcctggaaat

SEQ ID NO: 663120 - DNA, 25 bp, Homo sapien
gcctggaaatttatgtcttctgcca

SEQ ID NO: 663121 - DNA, 25 bp, Homo sapien
tatgtcttctgccaaactgagggaa

SEQ ID NO: 663122 - DNA, 25 bp, Homo sapien
gagggaacatctggccatcattttt

SEQ ID NO: 663123 - DNA, 25 bp, Homo sapien
acatctggccatcattttttcaaat

SEQ ID NO: 663124 - DNA, 25 bp, Homo sapien
ttccatctctcctacacatatatta

SEQ ID NO: 663125 - DNA, 25 bp, Homo sapien
agattctccatgagatacatgacca

SEQ ID NO: 663126 - DNA, 25 bp, Homo sapien
gagatacatgaccaaacatacaatg

SEQ ID NO: 663127 - DNA, 25 bp, Homo sapien
taatgttttctgtaggatgatacaa

SEQ ID NO: 663128 - DNA, 25 bp, Homo sapien
gatacaattgtaatatctctgtcaa

SEQ ID NO: 663129 - DNA, 25 bp, Homo sapien
gtaatatctctgtcaaattggaaca

SEQ ID NO: 663130 - DNA, 25 bp, Homo sapien
ggaacaaatatacgacaatcagcag

SEQ ID NO: 663131 - DNA, 25 bp, Homo sapien
gacaatcagcagcaattaccttggg

SEQ ID NO: 663132 - DNA, 25 bp, Homo sapien
gcagcaattaccttgggaaacagag

SEQ ID NO: 663133 - DNA, 25 bp, Homo sapien
gagtggaatcagatctcagtgatga

SEQ ID NO: 663134 - DNA, 25 bp, Homo sapien
gatctcagtgatgagactcacatga

SEQ ID NO: 663135 - DNA, 25 bp, Homo sapien
gcttaatcttaacctgtatcctgta

SEQ ID NO: 663136 - DNA, 25 bp, Homo sapien
actcgggcccagaagcaatgatcag

SEQ ID NO: 663137 - DNA, 25 bp, Homo sapien
gagctgaagttgctgttcttttccc

SEQ ID NO: 663138 - DNA, 25 bp, Homo sapien
gttcttttcccacgactttgtgaag

SEQ ID NO: 663139 - DNA, 25 bp, Homo sapien
gaaatctcggcccaaggtcctatag

SEQ ID NO: 663140 - DNA, 25 bp, Homo sapien
taggcagcactggatcggatctcta

SEQ ID NO: 663141 - DNA, 25 bp, Homo sapien
ggatcggatctctaaggagtcccta

SEQ ID NO: 663142 - DNA, 25 bp, Homo sapien
ggagtccctacagctatgaagttct

SEQ ID NO: 663143 - DNA, 25 bp, Homo sapien
aagttcttaacatctttatttcctg

SEQ ID NO: 663144 - DNA, 25 bp, Homo sapien
gaagagctggactgacctgacttaa

SEQ ID NO: 663145 - DNA, 25 bp, Homo sapien
atatctggtgagtttctgaagcttt

SEQ ID NO: 663146 - DNA, 25 bp, Homo sapien
gagtttctgaagcttttctacaagg

SEQ ID NO: 663147 - DNA, 25 bp, Homo sapien
aagaaagaggcaggacacagtggct

SEQ ID NO: 663148 - DNA, 25 bp, Homo sapien
agaaagaggcaggacacagtggctc

SEQ ID NO: 663149 - DNA, 25 bp, Homo sapien
tgagcatggtggtgcgtggctctag

SEQ ID NO: 663150 - DNA, 25 bp, Homo sapien
gagcatggtggtgcgtggctctagt

SEQ ID NO: 663151 - DNA, 25 bp, Homo sapien
gtggtgcgtggctctagtcccacct

SEQ ID NO: 663152 - DNA, 25 bp, Homo sapien
tggtgcgtggctctagtcccaccta

SEQ ID NO: 663153 - DNA, 25 bp, Homo sapien
ggtgcgtggctctagtcccacctac

SEQ ID NO: 663154 - DNA, 25 bp, Homo sapien
tgcgtggctctagtcccacctactt

SEQ ID NO: 663155 - DNA, 25 bp, Homo sapien
cacctacttgggactcccacctact

SEQ ID NO: 663156 - DNA, 25 bp, Homo sapien
ctacttgggactcccacctactcgg

SEQ ID NO: 663157 - DNA, 25 bp, Homo sapien
tacttgggactcccacctactcggg

SEQ ID NO: 663158 - DNA, 25 bp, Homo sapien
ttggcaagccagtgagagttcattt

SEQ ID NO: 663159 - DNA, 25 bp, Homo sapien
caagccagtgagagttcatttatcc

SEQ ID NO: 663160 - DNA, 25 bp, Homo sapien
gagttcatttatcccagaagtataa

SEQ ID NO: 663161 - DNA, 25 bp, Homo sapien
aaggaaagccagatcagaagtttga

SEQ ID NO: 663162 - DNA, 25 bp, Homo sapien
cagaagtttgatcaaaagcaagagc

SEQ ID NO: 663163 - DNA, 25 bp, Homo sapien
agcaagagcttggacgtgtgataca

SEQ ID NO: 663164 - DNA, 25 bp, Homo sapien
agcttggacgtgtgatacatctcag

SEQ ID NO: 663165 - DNA, 25 bp, Homo sapien
ggacgtgtgatacatctcagcaatt

SEQ ID NO: 663166 - DNA, 25 bp, Homo sapien
tgtgatacatctcagcaatttgccg

SEQ ID NO: 663167 - DNA, 25 bp, Homo sapien
gagacaagagaagatgcaatggcaa

SEQ ID NO: 663168 - DNA, 25 bp, Homo sapien
gatgcaatggcaatggttgaccatt

SEQ ID NO: 663169 - DNA, 25 bp, Homo sapien
actcactataccctgaatgcttatg

SEQ ID NO: 663170 - DNA, 25 bp, Homo sapien
cactataccctgaatgcttatgtgg

SEQ ID NO: 663171 - DNA, 25 bp, Homo sapien
tataccctgaatgcttatgtgggat

SEQ ID NO: 663172 - DNA, 25 bp, Homo sapien
cctgaatgcttatgtgggatacacc

SEQ ID NO: 663173 - DNA, 25 bp, Homo sapien
atgcttatgtgggatacaccaaggg

SEQ ID NO: 663174 - DNA, 25 bp, Homo sapien
gtcactatgacaaaattactttgcc

SEQ ID NO: 663175 - DNA, 25 bp, Homo sapien
aaattactttgcctaatgatagcat

SEQ ID NO: 663176 - DNA, 25 bp, Homo sapien
ctttgcctaatgatagcatatagtt

SEQ ID NO: 663177 - DNA, 25 bp, Homo sapien
gcatatagttaatgttactgtgcaa

SEQ ID NO: 663178 - DNA, 25 bp, Homo sapien
gttactgtgcaaataactgtgcaaa

SEQ ID NO: 663179 - DNA, 25 bp, Homo sapien
aaataactgtgcaaatgaatgactt

SEQ ID NO: 663180 - DNA, 25 bp, Homo sapien
gcataggtaagaattaacttggtgt

SEQ ID NO: 663181 - DNA, 25 bp, Homo sapien
gaattaacttggtgtagcagatcat

SEQ ID NO: 663182 - DNA, 25 bp, Homo sapien
attaacttggtgtagcagatcatga

SEQ ID NO: 663183 - DNA, 25 bp, Homo sapien
taacttggtgtagcagatcatgaga

SEQ ID NO: 663184 - DNA, 25 bp, Homo sapien
acttggtgtagcagatcatgagatc

SEQ ID NO: 663185 - DNA, 25 bp, Homo sapien
tggtgtagcagatcatgagatcagg

SEQ ID NO: 663186 - DNA, 25 bp, Homo sapien
cctgttggcaggcatgtgtactccc

SEQ ID NO: 663187 - DNA, 25 bp, Homo sapien
tgttggcaggcatgtgtactcccag

SEQ ID NO: 663188 - DNA, 25 bp, Homo sapien
gttggcaggcatgtgtactcccagc

SEQ ID NO: 663189 - DNA, 25 bp, Homo sapien
ttggcaggcatgtgtactcccagct

SEQ ID NO: 663190 - DNA, 25 bp, Homo sapien
gcaggcatgtgtactcccagctgct

SEQ ID NO: 663191 - DNA, 25 bp, Homo sapien
ataaagtaggaataaagatgctgac

SEQ ID NO: 663192 - DNA, 25 bp, Homo sapien
taaagtaggaataaagatgctgact

SEQ ID NO: 663193 - DNA, 25 bp, Homo sapien
aaagtaggaataaagatgctgactt

SEQ ID NO: 663194 - DNA, 25 bp, Homo sapien
aagtaggaataaagatgctgacttc

SEQ ID NO: 663195 - DNA, 25 bp, Homo sapien
agtaggaataaagatgctgacttca

SEQ ID NO: 663196 - DNA, 25 bp, Homo sapien
gtaggaataaagatgctgacttcag

SEQ ID NO: 663197 - DNA, 25 bp, Homo sapien
taggaataaagatgctgacttcagc

SEQ ID NO: 663198 - DNA, 25 bp, Homo sapien
aggaataaagatgctgacttcagct

SEQ ID NO: 663199 - DNA, 25 bp, Homo sapien
ggaataaagatgctgacttcagctg

SEQ ID NO: 663200 - DNA, 25 bp, Homo sapien
gaataaagatgctgacttcagctgg

SEQ ID NO: 663201 - DNA, 25 bp, Homo sapien
aataaagatgctgacttcagctggg

SEQ ID NO: 663202 - DNA, 25 bp, Homo sapien
ccaagcaccattttatacctttaag

SEQ ID NO: 663203 - DNA, 25 bp, Homo sapien
caagcaccattttatacctttaaga

SEQ ID NO: 663204 - DNA, 25 bp, Homo sapien
cctttaagaatgtgtgggccggacg

SEQ ID NO: 663205 - DNA, 25 bp, Homo sapien
ctttaagaatgtgtgggccggacgt

SEQ ID NO: 663206 - DNA, 25 bp, Homo sapien
tttaagaatgtgtgggccggacgtg

SEQ ID NO: 663207 - DNA, 25 bp, Homo sapien
ttaagaatgtgtgggccggacgtgg

SEQ ID NO: 663208 - DNA, 25 bp, Homo sapien
taagaatgtgtgggccggacgtggt

SEQ ID NO: 663209 - DNA, 25 bp, Homo sapien
aagaatgtgtgggccggacgtggtg

SEQ ID NO: 663210 - DNA, 25 bp, Homo sapien
gccagcatatggaggaggcttccct

SEQ ID NO: 663211 - DNA, 25 bp, Homo sapien
atggaggaggcttcccttggccgct

SEQ ID NO: 663212 - DNA, 25 bp, Homo sapien
tcgtggcaggcctgaaggcagctac

SEQ ID NO: 663213 - DNA, 25 bp, Homo sapien
ggacagccagatccaatgaggaaac

SEQ ID NO: 663214 - DNA, 25 bp, Homo sapien
gcaccatgctgtcatgtgagctgga

SEQ ID NO: 663215 - DNA, 25 bp, Homo sapien
gggacttctgtcttataatgaaagc

SEQ ID NO: 663216 - DNA, 25 bp, Homo sapien
agaccttgagtcactttcacagaga

SEQ ID NO: 663217 - DNA, 25 bp, Homo sapien
gagagatttatcgagaatgctaaca

SEQ ID NO: 663218 - DNA, 25 bp, Homo sapien
agcacaggatacagtacttcccaac

SEQ ID NO: 663219 - DNA, 25 bp, Homo sapien
ttcccaacaaaaggtgcaaacgcgt

SEQ ID NO: 663220 - DNA, 25 bp, Homo sapien
gcaaacgcgtcacttagaaaggcat

SEQ ID NO: 663221 - DNA, 25 bp, Homo sapien
cacctataatcttcgcactctggga

SEQ ID NO: 663222 - DNA, 25 bp, Homo sapien
gtaatcccactactggggtgggtga

SEQ ID NO: 663223 - DNA, 25 bp, Homo sapien
gggtgggtgaggcccggaactgctt

SEQ ID NO: 663224 - DNA, 25 bp, Homo sapien
ggtgggtgaggcccggaactgcttc

SEQ ID NO: 663225 - DNA, 25 bp, Homo sapien
gggtgaggcccggaactgcttcaac

SEQ ID NO: 663226 - DNA, 25 bp, Homo sapien
ggtgaggcccggaactgcttcaacc

SEQ ID NO: 663227 - DNA, 25 bp, Homo sapien
gtgaggcccggaactgcttcaacct

SEQ ID NO: 663228 - DNA, 25 bp, Homo sapien
tgaggcccggaactgcttcaacctg

SEQ ID NO: 663229 - DNA, 25 bp, Homo sapien
gaggcccggaactgcttcaacctgg

SEQ ID NO: 663230 - DNA, 25 bp, Homo sapien
aggcccggaactgcttcaacctggg

SEQ ID NO: 663231 - DNA, 25 bp, Homo sapien
ggcccggaactgcttcaacctggga

SEQ ID NO: 663232 - DNA, 25 bp, Homo sapien
gggtgtctaacatacacagcaaata

SEQ ID NO: 663233 - DNA, 25 bp, Homo sapien
tacacagcaaatactttgtcccagt

SEQ ID NO: 663234 - DNA, 25 bp, Homo sapien
gcaaatactttgtcccagtgtgtca

SEQ ID NO: 663235 - DNA, 25 bp, Homo sapien
aatactttgtcccagtgtgtcactt

SEQ ID NO: 663236 - DNA, 25 bp, Homo sapien
atactttgtcccagtgtgtcacttt

SEQ ID NO: 663237 - DNA, 25 bp, Homo sapien
tttgtcccagtgtgtcactttttaa

SEQ ID NO: 663238 - DNA, 25 bp, Homo sapien
atcttcccaaggctgacctcagatg

SEQ ID NO: 663239 - DNA, 25 bp, Homo sapien
ttcccaaggctgacctcagatgtgg

SEQ ID NO: 663240 - DNA, 25 bp, Homo sapien
ggctgacctcagatgtggaatgttg

SEQ ID NO: 663241 - DNA, 25 bp, Homo sapien
acctcagatgtggaatgttgacagc

SEQ ID NO: 663242 - DNA, 25 bp, Homo sapien
atgttgacagcaacacctgttacct

SEQ ID NO: 663243 - DNA, 25 bp, Homo sapien
gtactgtgctccgaggcgctgctca

SEQ ID NO: 663244 - DNA, 25 bp, Homo sapien
gaggcgctgctcactgatttccggg

SEQ ID NO: 663245 - DNA, 25 bp, Homo sapien
gtggccgggcactcggagctggccg

SEQ ID NO: 663246 - DNA, 25 bp, Homo sapien
taggcccggaagtgtctggagaaaa

SEQ ID NO: 663247 - DNA, 25 bp, Homo sapien
aaggccaagggtcaccgatacctct

SEQ ID NO: 663248 - DNA, 25 bp, Homo sapien
aagggtcaccgatacctctgaggcg

SEQ ID NO: 663249 - DNA, 25 bp, Homo sapien
gtcaccgatacctctgaggcggctc

SEQ ID NO: 663250 - DNA, 25 bp, Homo sapien
ttctccaggtcacgtacctctccgt

SEQ ID NO: 663251 - DNA, 25 bp, Homo sapien
agcgctgagggcactccttttggga

SEQ ID NO: 663252 - DNA, 25 bp, Homo sapien
ctgagggcactccttttgggagcct

SEQ ID NO: 663253 - DNA, 25 bp, Homo sapien
gagggcactccttttgggagcctct

SEQ ID NO: 663254 - DNA, 25 bp, Homo sapien
agttcagtgaggagtctgagcccaa

SEQ ID NO: 663255 - DNA, 25 bp, Homo sapien
gagtctgagcccaaagaaggaaggt

SEQ ID NO: 663256 - DNA, 25 bp, Homo sapien
gccctgcaaggccagacagctgatt

SEQ ID NO: 663257 - DNA, 25 bp, Homo sapien
aaggccagacagctgattacataca

SEQ ID NO: 663258 - DNA, 25 bp, Homo sapien
agacagctgattacatacaggagaa

SEQ ID NO: 663259 - DNA, 25 bp, Homo sapien
aaactatattgaggctaatgggagc

SEQ ID NO: 663260 - DNA, 25 bp, Homo sapien
atgggagccagatttttccctgttg

SEQ ID NO: 663261 - DNA, 25 bp, Homo sapien
gaagggagttacaagtacagaaata

SEQ ID NO: 663262 - DNA, 25 bp, Homo sapien
agaagtttgtgtgattggattggaa

SEQ ID NO: 663263 - DNA, 25 bp, Homo sapien
attggagatattcatgtaaagtcat

SEQ ID NO: 663264 - DNA, 25 bp, Homo sapien
aagtcatggttcttaatacatgtag

SEQ ID NO: 663265 - DNA, 25 bp, Homo sapien
aaagtgcttgttattaatgatatag

SEQ ID NO: 663266 - DNA, 25 bp, Homo sapien
atatctgtaagttgattgaaagcaa

SEQ ID NO: 663267 - DNA, 25 bp, Homo sapien
tacttcatttttttgtgcagttttg

SEQ ID NO: 663268 - DNA, 25 bp, Homo sapien
gtgcagttttgaaacatcacgtttg

SEQ ID NO: 663269 - DNA, 25 bp, Homo sapien
catcacgtttgatgtttggcaaatg

SEQ ID NO: 663270 - DNA, 25 bp, Homo sapien
ttggcaaatgtgttgaggtaatcag

SEQ ID NO: 663271 - DNA, 25 bp, Homo sapien
ggtaatcagaattatgacactggaa

SEQ ID NO: 663272 - DNA, 25 bp, Homo sapien
cataatgactagttacatgtaagca

SEQ ID NO: 663273 - DNA, 25 bp, Homo sapien
tagttacatgtaagcaaaattcaag

SEQ ID NO: 663274 - DNA, 25 bp, Homo sapien
aagggaaataatactagctcagaaa

SEQ ID NO: 663275 - DNA, 25 bp, Homo sapien
tattctatgatctcaaatggaaact

SEQ ID NO: 663276 - DNA, 25 bp, Homo sapien
gaggaattgatgtaatgatgccaac

SEQ ID NO: 663277 - DNA, 25 bp, Homo sapien
ggaattgatgtaatgatgccaactt

SEQ ID NO: 663278 - DNA, 25 bp, Homo sapien
attgatgtaatgatgccaactttta

SEQ ID NO: 663279 - DNA, 25 bp, Homo sapien
tgatgtaatgatgccaacttttaat

SEQ ID NO: 663280 - DNA, 25 bp, Homo sapien
aaacattacattgacaggtattgac

SEQ ID NO: 663281 - DNA, 25 bp, Homo sapien
cattacattgacaggtattgactac

SEQ ID NO: 663282 - DNA, 25 bp, Homo sapien
ttacattgacaggtattgactacta

SEQ ID NO: 663283 - DNA, 25 bp, Homo sapien
acattgacaggtattgactactaac

SEQ ID NO: 663284 - DNA, 25 bp, Homo sapien
attgacaggtattgactactaacac

SEQ ID NO: 663285 - DNA, 25 bp, Homo sapien
gacaggtattgactactaacacctc

SEQ ID NO: 663286 - DNA, 25 bp, Homo sapien
acaggtattgactactaacacctct

SEQ ID NO: 663287 - DNA, 25 bp, Homo sapien
ctgaagatgacccagactactgtgt

SEQ ID NO: 663288 - DNA, 25 bp, Homo sapien
gaagatgacccagactactgtgtgt

SEQ ID NO: 663289 - DNA, 25 bp, Homo sapien
gtgggtcccacctgaaggtcaaagt

SEQ ID NO: 663290 - DNA, 25 bp, Homo sapien
tgggtcccacctgaaggtcaaagtg

SEQ ID NO: 663291 - DNA, 25 bp, Homo sapien
ggtcccacctgaaggtcaaagtgga

SEQ ID NO: 663292 - DNA, 25 bp, Homo sapien
acctgaaggtcaaagtggagatggc

SEQ ID NO: 663293 - DNA, 25 bp, Homo sapien
gtggagatggcagaacccatcttaa

SEQ ID NO: 663294 - DNA, 25 bp, Homo sapien
tggcagaacccatcttaatgacaag

SEQ ID NO: 663295 - DNA, 25 bp, Homo sapien
gcagaacccatcttaatgacaagta

SEQ ID NO: 663296 - DNA, 25 bp, Homo sapien
agaacccatcttaatgacaagtatg

SEQ ID NO: 663297 - DNA, 25 bp, Homo sapien
cccatcttaatgacaagtatggcta

SEQ ID NO: 663298 - DNA, 25 bp, Homo sapien
tggagggaggctgcctgttcttcca

SEQ ID NO: 663299 - DNA, 25 bp, Homo sapien
agggaggctgcctgttcttccacag

SEQ ID NO: 663300 - DNA, 25 bp, Homo sapien
tgttcttccacaggctggagggact

SEQ ID NO: 663301 - DNA, 25 bp, Homo sapien
agtgacctccccagtacaaagccgt

SEQ ID NO: 663302 - DNA, 25 bp, Homo sapien
agtacaaagccgtgacagcactgcc

SEQ ID NO: 663303 - DNA, 25 bp, Homo sapien
acaaagccgtgacagcactgcctct

SEQ ID NO: 663304 - DNA, 25 bp, Homo sapien
gcaggcaatgcttcacatgggtatt

SEQ ID NO: 663305 - DNA, 25 bp, Homo sapien
gcaatgcttcacatgggtatttaac

SEQ ID NO: 663306 - DNA, 25 bp, Homo sapien
gggtatttaacatgctcacatattt

SEQ ID NO: 663307 - DNA, 25 bp, Homo sapien
catatttagtttatccctcagcaaa

SEQ ID NO: 663308 - DNA, 25 bp, Homo sapien
ccctcagcaaaattataggactttt

SEQ ID NO: 663309 - DNA, 25 bp, Homo sapien
caatgggaccgatgggccacagtgt

SEQ ID NO: 663310 - DNA, 25 bp, Homo sapien
agtgtgacatctatcctattcatgt

SEQ ID NO: 663311 - DNA, 25 bp, Homo sapien
gggacagtctgtgtgactgctcgta

SEQ ID NO: 663312 - DNA, 25 bp, Homo sapien
gactgctcgtaggagattatccaat

SEQ ID NO: 663313 - DNA, 25 bp, Homo sapien
gattatccaattccttttgctctaa

SEQ ID NO: 663314 - DNA, 25 bp, Homo sapien
tgctctaatttcatggtcaccaaat

SEQ ID NO: 663315 - DNA, 25 bp, Homo sapien
atggtcaccaaatttctgcttgcta

SEQ ID NO: 663316 - DNA, 25 bp, Homo sapien
atttctgcttgctaactttgtttta

SEQ ID NO: 663317 - DNA, 25 bp, Homo sapien
tgagaagccagaactcttgagtgtg

SEQ ID NO: 663318 - DNA, 25 bp, Homo sapien
tgagtgtgttgagccttgtagagat

SEQ ID NO: 663319 - DNA, 25 bp, Homo sapien
gtagagattgaaccactctgggtca

SEQ ID NO: 663320 - DNA, 25 bp, Homo sapien
tgaagaatggaagcgcactatgtgt

SEQ ID NO: 663321 - DNA, 25 bp, Homo sapien
agcgcactatgtgtgaggctttggt

SEQ ID NO: 663322 - DNA, 25 bp, Homo sapien
tggaagagcattgtgaataggtcat

SEQ ID NO: 663323 - DNA, 25 bp, Homo sapien
gaataggtcatgctcattcttgtta

SEQ ID NO: 663324 - DNA, 25 bp, Homo sapien
ggtcatgctcattcttgttaaaaat

SEQ ID NO: 663325 - DNA, 25 bp, Homo sapien
taataaattcacttacacggagctt

SEQ ID NO: 663326 - DNA, 25 bp, Homo sapien
tacacggagcttaagaatttctatg

SEQ ID NO: 663327 - DNA, 25 bp, Homo sapien
gaagcagtatgccaaaacttattaa

SEQ ID NO: 663328 - DNA, 25 bp, Homo sapien
gagagtcagtattaggcaaaccagt

SEQ ID NO: 663329 - DNA, 25 bp, Homo sapien
ggcaaaccagtagtcgtttctagaa

SEQ ID NO: 663330 - DNA, 25 bp, Homo sapien
cagtagtcgtttctagaacgctttt

SEQ ID NO: 663331 - DNA, 25 bp, Homo sapien
gattcatgtcattttagggtaccta

SEQ ID NO: 663332 - DNA, 25 bp, Homo sapien
gggtacctagataattaagtctcag

SEQ ID NO: 663333 - DNA, 25 bp, Homo sapien
aagtctcagggctagacgtattcca

SEQ ID NO: 663334 - DNA, 25 bp, Homo sapien
cagggctagacgtattccaaatatt

SEQ ID NO: 663335 - DNA, 25 bp, Homo sapien
caaagtaatttgcacagacatagta

SEQ ID NO: 663336 - DNA, 25 bp, Homo sapien
ttcttggtgagaatttagtcttctg

SEQ ID NO: 663337 - DNA, 25 bp, Homo sapien
gtcttctgtgcaattttagccctaa

SEQ ID NO: 663338 - DNA, 25 bp, Homo sapien
gtgtttttgtacttataagcttgtg

SEQ ID NO: 663339 - DNA, 25 bp, Homo sapien
gtacttataagcttgtgaactaaca

SEQ ID NO: 663340 - DNA, 25 bp, Homo sapien
aagcttgtgaactaacaaaccataa

SEQ ID NO: 663341 - DNA, 25 bp, Homo sapien
tgaaaatatactgcactgagctctg

SEQ ID NO: 663342 - DNA, 25 bp, Homo sapien
cacacagaaaaaaagaggcaaagaa

SEQ ID NO: 663343 - DNA, 25 bp, Homo sapien
aagaggcaaagaaaacctcttgccg

SEQ ID NO: 663344 - DNA, 25 bp, Homo sapien
agaggcaaagaaaacctcttgccgg

SEQ ID NO: 663345 - DNA, 25 bp, Homo sapien
gaggcaaagaaaacctcttgccggg

SEQ ID NO: 663346 - DNA, 25 bp, Homo sapien
ggcaaagaaaacctcttgccgggcg

SEQ ID NO: 663347 - DNA, 25 bp, Homo sapien
gcaaagaaaacctcttgccgggcgt

SEQ ID NO: 663348 - DNA, 25 bp, Homo sapien
caaagaaaacctcttgccgggcgtg

SEQ ID NO: 663349 - DNA, 25 bp, Homo sapien
agaaaacctcttgccgggcgtggtg

SEQ ID NO: 663350 - DNA, 25 bp, Homo sapien
gaaaacctcttgccgggcgtggtgg

SEQ ID NO: 663351 - DNA, 25 bp, Homo sapien
atggccgtgaatactaggcacctaa

SEQ ID NO: 663352 - DNA, 25 bp, Homo sapien
actaggcacctaatgaatcaaaaag

SEQ ID NO: 663353 - DNA, 25 bp, Homo sapien
aaaaagctcaaagcagacagctgga

SEQ ID NO: 663354 - DNA, 25 bp, Homo sapien
gaaacatgagctggcagacttgaaa

SEQ ID NO: 663355 - DNA, 25 bp, Homo sapien
ccatccaagaaatcaaggctacatt

SEQ ID NO: 663356 - DNA, 25 bp, Homo sapien
tcaaggctacattaagcagcacaaa

SEQ ID NO: 663357 - DNA, 25 bp, Homo sapien
gcagcacaaagagccatcactgaat

SEQ ID NO: 663358 - DNA, 25 bp, Homo sapien
tcactgaattcatactaaggcacaa

SEQ ID NO: 663359 - DNA, 25 bp, Homo sapien
gtggcaggtgatgaatacacaccag

SEQ ID NO: 663360 - DNA, 25 bp, Homo sapien
acacaccagaacaatattgtcactg

SEQ ID NO: 663361 - DNA, 25 bp, Homo sapien
gtcactgcccagataaaaatcatga

SEQ ID NO: 663362 - DNA, 25 bp, Homo sapien
aagggctgcagctgatgatcccata

SEQ ID NO: 663363 - DNA, 25 bp, Homo sapien
ggctgcagctgatgatcccataaaa

SEQ ID NO: 663364 - DNA, 25 bp, Homo sapien
tgatgatcccataaaagtgtgtgag

SEQ ID NO: 663365 - DNA, 25 bp, Homo sapien
gtcatgtagatatcattttcttttc

SEQ ID NO: 663366 - DNA, 25 bp, Homo sapien
tttcttttcttgatgactgccaatt

SEQ ID NO: 663367 - DNA, 25 bp, Homo sapien
atgactgccaatttcaatgtcctct

SEQ ID NO: 663368 - DNA, 25 bp, Homo sapien
aatgtcctctgcctataggctggat

SEQ ID NO: 663369 - DNA, 25 bp, Homo sapien
ataggctggatatggtcactctgac

SEQ ID NO: 663370 - DNA, 25 bp, Homo sapien
ggatatggtcactctgacggcttat

SEQ ID NO: 663371 - DNA, 25 bp, Homo sapien
tggtcactctgacggcttatttgga

SEQ ID NO: 663372 - DNA, 25 bp, Homo sapien
ctgacggcttatttggaggaagtaa

SEQ ID NO: 663373 - DNA, 25 bp, Homo sapien
atggtgtattaagttctcacattac

SEQ ID NO: 663374 - DNA, 25 bp, Homo sapien
agttctcacattactatgttgctga

SEQ ID NO: 663375 - DNA, 25 bp, Homo sapien
cacattactatgttgctgaagcaac

SEQ ID NO: 663376 - DNA, 25 bp, Homo sapien
agactgacgcagtttatttcatgtg

SEQ ID NO: 663377 - DNA, 25 bp, Homo sapien
gacgcagtttatttcatgtgatttt

SEQ ID NO: 663378 - DNA, 25 bp, Homo sapien
ttaaaatcttggtctctgagatagg

SEQ ID NO: 663379 - DNA, 25 bp, Homo sapien
tggtctctgagataggaaagtagct

SEQ ID NO: 663380 - DNA, 25 bp, Homo sapien
taaatctctgtatctgacaaattgg

SEQ ID NO: 663381 - DNA, 25 bp, Homo sapien
ctctgtatctgacaaattggatcta

SEQ ID NO: 663382 - DNA, 25 bp, Homo sapien
ttggatctatatgagccttggcagc

SEQ ID NO: 663383 - DNA, 25 bp, Homo sapien
gagccttggcagcttaataactatt

SEQ ID NO: 663384 - DNA, 25 bp, Homo sapien
accaggcatggtggcgggcacttgt

SEQ ID NO: 663385 - DNA, 25 bp, Homo sapien
aggcatggtggcgggcacttgtaat

SEQ ID NO: 663386 - DNA, 25 bp, Homo sapien
gagaatcgcatgaactcatgaggtg

SEQ ID NO: 663387 - DNA, 25 bp, Homo sapien
agaatcgcatgaactcatgaggtgg

SEQ ID NO: 663388 - DNA, 25 bp, Homo sapien
gaatcgcatgaactcatgaggtgga

SEQ ID NO: 663389 - DNA, 25 bp, Homo sapien
aatcgcatgaactcatgaggtggag

SEQ ID NO: 663390 - DNA, 25 bp, Homo sapien
atcgcatgaactcatgaggtggagg

SEQ ID NO: 663391 - DNA, 25 bp, Homo sapien
tcgcatgaactcatgaggtggaggt

SEQ ID NO: 663392 - DNA, 25 bp, Homo sapien
cgcatgaactcatgaggtggaggtt

SEQ ID NO: 663393 - DNA, 25 bp, Homo sapien
catgaactcatgaggtggaggttgc

SEQ ID NO: 663394 - DNA, 25 bp, Homo sapien
atgaactcatgaggtggaggttgca

SEQ ID NO: 663395 - DNA, 25 bp, Homo sapien
aagaaagggatgataggccgggcgt

SEQ ID NO: 663396 - DNA, 25 bp, Homo sapien
agaaagggatgataggccgggcgtg

SEQ ID NO: 663397 - DNA, 25 bp, Homo sapien
gaaagggatgataggccgggcgtgg

SEQ ID NO: 663398 - DNA, 25 bp, Homo sapien
cgaggtcgggagatagagacatggt

SEQ ID NO: 663399 - DNA, 25 bp, Homo sapien
gaggtcgggagatagagacatggtg

SEQ ID NO: 663400 - DNA, 25 bp, Homo sapien
aggtcgggagatagagacatggtga

SEQ ID NO: 663401 - DNA, 25 bp, Homo sapien
ggtcgggagatagagacatggtgaa

SEQ ID NO: 663402 - DNA, 25 bp, Homo sapien
gtcgggagatagagacatggtgaaa

SEQ ID NO: 663403 - DNA, 25 bp, Homo sapien
tcgggagatagagacatggtgaaac

SEQ ID NO: 663404 - DNA, 25 bp, Homo sapien
cgggagatagagacatggtgaaacc

SEQ ID NO: 663405 - DNA, 25 bp, Homo sapien
gggagatagagacatggtgaaaccc

SEQ ID NO: 663406 - DNA, 25 bp, Homo sapien
tactggatgaattcccgggtctttt

SEQ ID NO: 663407 - DNA, 25 bp, Homo sapien
gggtcttttttagttccagctctct

SEQ ID NO: 663408 - DNA, 25 bp, Homo sapien
tcttttttagttccagctctctggg

SEQ ID NO: 663409 - DNA, 25 bp, Homo sapien
atttatcaagcctctagcacagcca

SEQ ID NO: 663410 - DNA, 25 bp, Homo sapien
cagccatccacacaaaggaggttat

SEQ ID NO: 663411 - DNA, 25 bp, Homo sapien
aattgattgttattactgccgcctt

SEQ ID NO: 663412 - DNA, 25 bp, Homo sapien
gattgttattactgccgccttacag

SEQ ID NO: 663413 - DNA, 25 bp, Homo sapien
tgccgccttacagctgctctaagga

SEQ ID NO: 663414 - DNA, 25 bp, Homo sapien
ttacagctgctctaaggagccgtct

SEQ ID NO: 663415 - DNA, 25 bp, Homo sapien
taaggagccgtctgccacattttgt

SEQ ID NO: 663416 - DNA, 25 bp, Homo sapien
cgtctgccacattttgtcctaataa

SEQ ID NO: 663417 - DNA, 25 bp, Homo sapien
atgccataatggaggaacctgtgaa

SEQ ID NO: 663418 - DNA, 25 bp, Homo sapien
aggctatgtttgtaaatgtccccga

SEQ ID NO: 663419 - DNA, 25 bp, Homo sapien
taaatgtccccgaggatttaatggg

SEQ ID NO: 663420 - DNA, 25 bp, Homo sapien
atttaatgggattcactgtcagcac

SEQ ID NO: 663421 - DNA, 25 bp, Homo sapien
gggattcactgtcagcacaacataa

SEQ ID NO: 663422 - DNA, 25 bp, Homo sapien
aatgcgaagttgagccttgcaaaaa

SEQ ID NO: 663423 - DNA, 25 bp, Homo sapien
ggaatatgtacagatcttgttgcta

SEQ ID NO: 663424 - DNA, 25 bp, Homo sapien
gatcttgttgctaactattcctgtg

SEQ ID NO: 663425 - DNA, 25 bp, Homo sapien
tattcctgtgagtgcccaggcgaat

SEQ ID NO: 663426 - DNA, 25 bp, Homo sapien
gagtgcccaggcgaatttatgggaa

SEQ ID NO: 663427 - DNA, 25 bp, Homo sapien
tcaatacaaatgctcaggcccactg

SEQ ID NO: 663428 - DNA, 25 bp, Homo sapien
gaagtcattagtgtggtccccaatt

SEQ ID NO: 663429 - DNA, 25 bp, Homo sapien
gagatttggacacagaaagacacaa

SEQ ID NO: 663430 - DNA, 25 bp, Homo sapien
aaagacacaaacaaggagaacacca

SEQ ID NO: 663431 - DNA, 25 bp, Homo sapien
gtgaagattgggatcatgtgaccaa

SEQ ID NO: 663432 - DNA, 25 bp, Homo sapien
ggatcatgtgaccaaaagccaagga

SEQ ID NO: 663433 - DNA, 25 bp, Homo sapien
agccaaggaactaccagaaggtaag

SEQ ID NO: 663434 - DNA, 25 bp, Homo sapien
ggaacaaatcctttcctagtgcctt

SEQ ID NO: 663435 - DNA, 25 bp, Homo sapien
aatcctttcctagtgccttcagagg

SEQ ID NO: 663436 - DNA, 25 bp, Homo sapien
gggagtgtgacctagttgacacctt

SEQ ID NO: 663437 - DNA, 25 bp, Homo sapien
agtgtgacctagttgacaccttgat

SEQ ID NO: 663438 - DNA, 25 bp, Homo sapien
cttctagcctctgaaattgtgagac

SEQ ID NO: 663439 - DNA, 25 bp, Homo sapien
aaactgcttggtgagcactaactgg

SEQ ID NO: 663440 - DNA, 25 bp, Homo sapien
aggagatagcatctggccttgtcca

SEQ ID NO: 663441 - DNA, 25 bp, Homo sapien
ggccttgtccacagaggcactagga

SEQ ID NO: 663442 - DNA, 25 bp, Homo sapien
gaggcactaggaatcaatctggagt

SEQ ID NO: 663443 - DNA, 25 bp, Homo sapien
tcaatctggagtcacgaggtcacat

SEQ ID NO: 663444 - DNA, 25 bp, Homo sapien
gaggtcacatgtggccccaaattgg

SEQ ID NO: 663445 - DNA, 25 bp, Homo sapien
gaccctccacaaagtaactcttgaa

SEQ ID NO: 663446 - DNA, 25 bp, Homo sapien
gaaactatgcatgctgccctgcaat

SEQ ID NO: 663447 - DNA, 25 bp, Homo sapien
gctgccctgcaatccctttgatgta

SEQ ID NO: 663448 - DNA, 25 bp, Homo sapien
tgtacctttaagttcatttggacct

SEQ ID NO: 663449 - DNA, 25 bp, Homo sapien
catttggaccttttgatatttgttc

SEQ ID NO: 663450 - DNA, 25 bp, Homo sapien
ttaagagaactgtgtagaagactat

SEQ ID NO: 663451 - DNA, 25 bp, Homo sapien
gagaactgtgtagaagactataaaa

SEQ ID NO: 663452 - DNA, 25 bp, Homo sapien
taaaaagggctttataactgatctt

SEQ ID NO: 663453 - DNA, 25 bp, Homo sapien
agggctttataactgatcttttgac

SEQ ID NO: 663454 - DNA, 25 bp, Homo sapien
ctgatcttttgacatactcactttg

SEQ ID NO: 663455 - DNA, 25 bp, Homo sapien
gatcttttgacatactcactttgag

SEQ ID NO: 663456 - DNA, 25 bp, Homo sapien
atcttttgacatactcactttgagt

SEQ ID NO: 663457 - DNA, 25 bp, Homo sapien
ttttgacatactcactttgagtggc

SEQ ID NO: 663458 - DNA, 25 bp, Homo sapien
actttgagtggcatatgcccaggaa

SEQ ID NO: 663459 - DNA, 25 bp, Homo sapien
tttgagtggcatatgcccaggaaaa

SEQ ID NO: 663460 - DNA, 25 bp, Homo sapien
tgagtggcatatgcccaggaaaata

SEQ ID NO: 663461 - DNA, 25 bp, Homo sapien
aagcatatgctctttagatttaatg

SEQ ID NO: 663462 - DNA, 25 bp, Homo sapien
tttccctttctaaagactcttacag

SEQ ID NO: 663463 - DNA, 25 bp, Homo sapien
tgtccttccctatctgtcttttcct

SEQ ID NO: 663464 - DNA, 25 bp, Homo sapien
tatctgtcttttcctcttcccagct

SEQ ID NO: 663465 - DNA, 25 bp, Homo sapien
tgtcttctttttgaatgctaaaatt

SEQ ID NO: 663466 - DNA, 25 bp, Homo sapien
atgttaataatcttccttgctggca

SEQ ID NO: 663467 - DNA, 25 bp, Homo sapien
aatcttccttgctggcagggcttgg

SEQ ID NO: 663468 - DNA, 25 bp, Homo sapien
tgggaaggcccttgaaactgcattg

SEQ ID NO: 663469 - DNA, 25 bp, Homo sapien
aggcccttgaaactgcattgccaaa

SEQ ID NO: 663470 - DNA, 25 bp, Homo sapien
ctgcattgccaaacttcccaaatgt

SEQ ID NO: 663471 - DNA, 25 bp, Homo sapien
cccccttgtcaatctcacataatta

SEQ ID NO: 663472 - DNA, 25 bp, Homo sapien
ggaacaacatgaggaacgtgcagat

SEQ ID NO: 663473 - DNA, 25 bp, Homo sapien
cgtgcagatgggacagagaatcact

SEQ ID NO: 663474 - DNA, 25 bp, Homo sapien
aatcactggtggagactgatcccaa

SEQ ID NO: 663475 - DNA, 25 bp, Homo sapien
aaagtggccagagtgcaaggtgctt

SEQ ID NO: 663476 - DNA, 25 bp, Homo sapien
gtgctttatggcactgcaccagttc

SEQ ID NO: 663477 - DNA, 25 bp, Homo sapien
tgcaccagttccctatgaaaccata

SEQ ID NO: 663478 - DNA, 25 bp, Homo sapien
gttccctatgaaaccatacacatct

SEQ ID NO: 663479 - DNA, 25 bp, Homo sapien
catctcattgagtaaggaaggaagc

SEQ ID NO: 663480 - DNA, 25 bp, Homo sapien
aggaagctgcctgtgactgagactc

SEQ ID NO: 663481 - DNA, 25 bp, Homo sapien
gactgagactctgaaatggaccagg

SEQ ID NO: 663482 - DNA, 25 bp, Homo sapien
gattgtgtaactttgcagtgagtgc

SEQ ID NO: 663483 - DNA, 25 bp, Homo sapien
atcagcactctgtagataggattgt

SEQ ID NO: 663484 - DNA, 25 bp, Homo sapien
cactctgtagataggattgtaaaac

SEQ ID NO: 663485 - DNA, 25 bp, Homo sapien
tagataggattgtaaaacgcaccaa

SEQ ID NO: 663486 - DNA, 25 bp, Homo sapien
tcagctctctgtggctagctagagg

SEQ ID NO: 663487 - DNA, 25 bp, Homo sapien
agctctctgtggctagctagaggtt

SEQ ID NO: 663488 - DNA, 25 bp, Homo sapien
tctctgtggctagctagaggtttct

SEQ ID NO: 663489 - DNA, 25 bp, Homo sapien
gggtccccatccctgttgtggtgta

SEQ ID NO: 663490 - DNA, 25 bp, Homo sapien
gtccccatccctgttgtggtgtatt

SEQ ID NO: 663491 - DNA, 25 bp, Homo sapien
cccatccctgttgtggtgtatttgt

SEQ ID NO: 663492 - DNA, 25 bp, Homo sapien
catccctgttgtggtgtatttgtta

SEQ ID NO: 663493 - DNA, 25 bp, Homo sapien
ccctgttgtggtgtatttgttattt

SEQ ID NO: 663494 - DNA, 25 bp, Homo sapien
acgttcacatcaaagctgcctacga

SEQ ID NO: 663495 - DNA, 25 bp, Homo sapien
gctgcctacgaatgattattttcca

SEQ ID NO: 663496 - DNA, 25 bp, Homo sapien
tattttccatgatgctatgctccct

SEQ ID NO: 663497 - DNA, 25 bp, Homo sapien
gtgacccagcaagtgtatccagggc

SEQ ID NO: 663498 - DNA, 25 bp, Homo sapien
gcaagtgtatccagggcatccctca

SEQ ID NO: 663499 - DNA, 25 bp, Homo sapien
catccctcactcttacttatttttg

SEQ ID NO: 663500 - DNA, 25 bp, Homo sapien
tttcatatttatgttggctgcagag

SEQ ID NO: 663501 - DNA, 25 bp, Homo sapien
gcataaatctgaataggttctccaa

SEQ ID NO: 663502 - DNA, 25 bp, Homo sapien
ggttctccaaagtaagctttttctg

SEQ ID NO: 663503 - DNA, 25 bp, Homo sapien
tctgcatgcatttgctcccaatgat

SEQ ID NO: 663504 - DNA, 25 bp, Homo sapien
tttgctcccaatgatgataggtatt

SEQ ID NO: 663505 - DNA, 25 bp, Homo sapien
ttctgaaatcgtgggcaaaattact

SEQ ID NO: 663506 - DNA, 25 bp, Homo sapien
aattacttaacttttggccatgtga

SEQ ID NO: 663507 - DNA, 25 bp, Homo sapien
ggttttccattaccttacaatgtat

SEQ ID NO: 663508 - DNA, 25 bp, Homo sapien
gtataggcccaaaagacaacttaag

SEQ ID NO: 663509 - DNA, 25 bp, Homo sapien
tatgtcatccaaaagatgcctgagc

SEQ ID NO: 663510 - DNA, 25 bp, Homo sapien
atgcctgagcatttgaaaacctgaa

SEQ ID NO: 663511 - DNA, 25 bp, Homo sapien
gaaaatatgttttcctgcgatgatg

SEQ ID NO: 663512 - DNA, 25 bp, Homo sapien
tttcctgcgatgatgggacattgct

SEQ ID NO: 663513 - DNA, 25 bp, Homo sapien
gggacattgcttgtagcatcagaaa

SEQ ID NO: 663514 - DNA, 25 bp, Homo sapien
atcagaaatgtatatgttgggcctc

SEQ ID NO: 663515 - DNA, 25 bp, Homo sapien
atatgttgggcctcttttctctggt

SEQ ID NO: 663516 - DNA, 25 bp, Homo sapien
actgggactacaggggttcaccact

SEQ ID NO: 663517 - DNA, 25 bp, Homo sapien
ctacaggggttcaccactacacctg

SEQ ID NO: 663518 - DNA, 25 bp, Homo sapien
gacatcaagtaatccatccgcctca

SEQ ID NO: 663519 - DNA, 25 bp, Homo sapien
ctgtgcctggccctgagcttaaaat

SEQ ID NO: 663520 - DNA, 25 bp, Homo sapien
tgtgcctggccctgagcttaaaata

SEQ ID NO: 663521 - DNA, 25 bp, Homo sapien
gtgcctggccctgagcttaaaataa

SEQ ID NO: 663522 - DNA, 25 bp, Homo sapien
tgcctggccctgagcttaaaataaa

SEQ ID NO: 663523 - DNA, 25 bp, Homo sapien
gcctggccctgagcttaaaataaaa

SEQ ID NO: 663524 - DNA, 25 bp, Homo sapien
cctggccctgagcttaaaataaaag

SEQ ID NO: 663525 - DNA, 25 bp, Homo sapien
ctggccctgagcttaaaataaaagt

SEQ ID NO: 663526 - DNA, 25 bp, Homo sapien
tggccctgagcttaaaataaaagtt

SEQ ID NO: 663527 - DNA, 25 bp, Homo sapien
tccaaaccaaatacagcacctactg

SEQ ID NO: 663528 - DNA, 25 bp, Homo sapien
tccaagaagtcatttgccagcagat

SEQ ID NO: 663529 - DNA, 25 bp, Homo sapien
gccagcagatttcttagaggtgcga

SEQ ID NO: 663530 - DNA, 25 bp, Homo sapien
gaagaggacattgccagtcgtcaca

SEQ ID NO: 663531 - DNA, 25 bp, Homo sapien
ttgccagtcgtcacagcagctgcaa

SEQ ID NO: 663532 - DNA, 25 bp, Homo sapien
agcagctgcaatagctcctctctat

SEQ ID NO: 663533 - DNA, 25 bp, Homo sapien
agctcctctctattgttaaacagtg

SEQ ID NO: 663534 - DNA, 25 bp, Homo sapien
cagtgggatatcttgtgcaggtttt

SEQ ID NO: 663535 - DNA, 25 bp, Homo sapien
gtgcaggttttcagttgacaatcaa

SEQ ID NO: 663536 - DNA, 25 bp, Homo sapien
taaagattagtttcggtccccatca

SEQ ID NO: 663537 - DNA, 25 bp, Homo sapien
ttcggtccccatcaatcaattattt

SEQ ID NO: 663538 - DNA, 25 bp, Homo sapien
ggaacacattaatgggtttgtattg

SEQ ID NO: 663539 - DNA, 25 bp, Homo sapien
gggtttgtattgatgtttgctctta

SEQ ID NO: 663540 - DNA, 25 bp, Homo sapien
gtattgatgtttgctcttatcaaaa

SEQ ID NO: 663541 - DNA, 25 bp, Homo sapien
gctcttatcaaaacgaatagcttag

SEQ ID NO: 663542 - DNA, 25 bp, Homo sapien
aaaacgaatagcttagtctcagtat

SEQ ID NO: 663543 - DNA, 25 bp, Homo sapien
gaatagcttagtctcagtattcatt

SEQ ID NO: 663544 - DNA, 25 bp, Homo sapien
gtttatcagcatataagagcaccat

SEQ ID NO: 663545 - DNA, 25 bp, Homo sapien
gagcaccatgggttctcattatgca

SEQ ID NO: 663546 - DNA, 25 bp, Homo sapien
accatgggttctcattatgcaaatg

SEQ ID NO: 663547 - DNA, 25 bp, Homo sapien
gaacattttagtcagctataatact

SEQ ID NO: 663548 - DNA, 25 bp, Homo sapien
cttttttctaaacagtggatttatg

SEQ ID NO: 663549 - DNA, 25 bp, Homo sapien
gtcaaagggctaaaactatagtaat

SEQ ID NO: 663550 - DNA, 25 bp, Homo sapien
gggctaaaactatagtaatgagtac

SEQ ID NO: 663551 - DNA, 25 bp, Homo sapien
gagtacattcttaatgagtttttct

SEQ ID NO: 663552 - DNA, 25 bp, Homo sapien
gtctcatcttatgttctaaaattgt

SEQ ID NO: 663553 - DNA, 25 bp, Homo sapien
gttctaaaattgtcacagcaaagtg

SEQ ID NO: 663554 - DNA, 25 bp, Homo sapien
aattgtcacagcaaagtgatcaagg

SEQ ID NO: 663555 - DNA, 25 bp, Homo sapien
agtgatcaaggaagctagagatttt

SEQ ID NO: 663556 - DNA, 25 bp, Homo sapien
ggaagctagagattttacatatgtt

SEQ ID NO: 663557 - DNA, 25 bp, Homo sapien
aagctagagattttacatatgttct

SEQ ID NO: 663558 - DNA, 25 bp, Homo sapien
tacatatgttcttctcaataagatg

SEQ ID NO: 663559 - DNA, 25 bp, Homo sapien
aataaatccttgatacatgaacgaa

SEQ ID NO: 663560 - DNA, 25 bp, Homo sapien
catctctacaaaacaacgacaacaa

SEQ ID NO: 663561 - DNA, 25 bp, Homo sapien
atctctacaaaacaacgacaacaac

SEQ ID NO: 663562 - DNA, 25 bp, Homo sapien
tctctacaaaacaacgacaacaaca

SEQ ID NO: 663563 - DNA, 25 bp, Homo sapien
ctctacaaaacaacgacaacaacaa

SEQ ID NO: 663564 - DNA, 25 bp, Homo sapien
tctacaaaacaacgacaacaacaaa

SEQ ID NO: 663565 - DNA, 25 bp, Homo sapien
caacgacaacaacaaaaattagcca

SEQ ID NO: 663566 - DNA, 25 bp, Homo sapien
ctaaggcaggaggatggtttgggcc

SEQ ID NO: 663567 - DNA, 25 bp, Homo sapien
taaggcaggaggatggtttgggccc

SEQ ID NO: 663568 - DNA, 25 bp, Homo sapien
aaggcaggaggatggtttgggccca

SEQ ID NO: 663569 - DNA, 25 bp, Homo sapien
tttaaggctctagtgagctgtgatt

SEQ ID NO: 663570 - DNA, 25 bp, Homo sapien
ttaaggctctagtgagctgtgattg

SEQ ID NO: 663571 - DNA, 25 bp, Homo sapien
tcagtttctagctggttgtgggcag

SEQ ID NO: 663572 - DNA, 25 bp, Homo sapien
ttgtgggcagttgccttgagttcct

SEQ ID NO: 663573 - DNA, 25 bp, Homo sapien
agttgccttgagttccttgccacat

SEQ ID NO: 663574 - DNA, 25 bp, Homo sapien
tgcttcttcaaagccggtgagagag

SEQ ID NO: 663575 - DNA, 25 bp, Homo sapien
gagaggctcttctaataagatggac

SEQ ID NO: 663576 - DNA, 25 bp, Homo sapien
tggactgtacaagctcacattatgt

SEQ ID NO: 663577 - DNA, 25 bp, Homo sapien
agaagcaacacctgtcacctttgtt

SEQ ID NO: 663578 - DNA, 25 bp, Homo sapien
cacctgtcacctttgttatacttta

SEQ ID NO: 663579 - DNA, 25 bp, Homo sapien
gcttagcatcaagtcacaattcctg

SEQ ID NO: 663580 - DNA, 25 bp, Homo sapien
aaaggtagggattacatcagggcgt

SEQ ID NO: 663581 - DNA, 25 bp, Homo sapien
ttacatcagggcgtgggcaccaaga

SEQ ID NO: 663582 - DNA, 25 bp, Homo sapien
gaagtctaagaatctcctgaaatgg

SEQ ID NO: 663583 - DNA, 25 bp, Homo sapien
aaatggtttgcaaaatatactgggc

SEQ ID NO: 663584 - DNA, 25 bp, Homo sapien
ggaatcatagcattcatcagctttt

SEQ ID NO: 663585 - DNA, 25 bp, Homo sapien
atagcattcatcagcttttcaaggg

SEQ ID NO: 663586 - DNA, 25 bp, Homo sapien
gggcccagagttcaaaagcagttaa

SEQ ID NO: 663587 - DNA, 25 bp, Homo sapien
ttttctagtggatataaggtgggac

SEQ ID NO: 663588 - DNA, 25 bp, Homo sapien
tggatataaggtgggactagattct

SEQ ID NO: 663589 - DNA, 25 bp, Homo sapien
gactagattctaaggtatttcttcc

SEQ ID NO: 663590 - DNA, 25 bp, Homo sapien
gattctaaggtatttcttcccccag

SEQ ID NO: 663591 - DNA, 25 bp, Homo sapien
cccaggtttaagattccttggactg

SEQ ID NO: 663592 - DNA, 25 bp, Homo sapien
ttaagattccttggactgttaaata

SEQ ID NO: 663593 - DNA, 25 bp, Homo sapien
tgcactagtctatgccatccttgtt

SEQ ID NO: 663594 - DNA, 25 bp, Homo sapien
tagtctatgccatccttgttatatg

SEQ ID NO: 663595 - DNA, 25 bp, Homo sapien
atgccatccttgttatatggacttg

SEQ ID NO: 663596 - DNA, 25 bp, Homo sapien
tatatggacttggagcatgctgcag

SEQ ID NO: 663597 - DNA, 25 bp, Homo sapien
ggagcatgctgcagtttccacttga

SEQ ID NO: 663598 - DNA, 25 bp, Homo sapien
tgcagtttccacttgacctggcaga

SEQ ID NO: 663599 - DNA, 25 bp, Homo sapien
agtttccacttgacctggcagaccc

SEQ ID NO: 663600 - DNA, 25 bp, Homo sapien
gcagacccatgtattagaacttcag

SEQ ID NO: 663601 - DNA, 25 bp, Homo sapien
cttcagaagacataggagcagttaa

SEQ ID NO: 663602 - DNA, 25 bp, Homo sapien
attggaggtcctcggaatcctactg

SEQ ID NO: 663603 - DNA, 25 bp, Homo sapien
ggaatcctactggtcttactttaat

SEQ ID NO: 663604 - DNA, 25 bp, Homo sapien
ggaaagcgagggtccccagagcatc

SEQ ID NO: 663605 - DNA, 25 bp, Homo sapien
gagggtccccagagcatcctgaagg

SEQ ID NO: 663606 - DNA, 25 bp, Homo sapien
ccccagagcatcctgaaggctgagt

SEQ ID NO: 663607 - DNA, 25 bp, Homo sapien
gagcatcctgaaggctgagttgacc

SEQ ID NO: 663608 - DNA, 25 bp, Homo sapien
tcctgaaggctgagttgacctggag

SEQ ID NO: 663609 - DNA, 25 bp, Homo sapien
agccccagctgcagaacgccggtgg

SEQ ID NO: 663610 - DNA, 25 bp, Homo sapien
gagggcgtccacagactggccccaa

SEQ ID NO: 663611 - DNA, 25 bp, Homo sapien
agactggccccaaatgtcagccgta

SEQ ID NO: 663612 - DNA, 25 bp, Homo sapien
tggccccaaatgtcagccgtatgtc

SEQ ID NO: 663613 - DNA, 25 bp, Homo sapien
aaatgtcagccgtatgtctgagaac

SEQ ID NO: 663614 - DNA, 25 bp, Homo sapien
cagccgtatgtctgagaacagcatt

SEQ ID NO: 663615 - DNA, 25 bp, Homo sapien
agtacatccaacctttccaggcctt

SEQ ID NO: 663616 - DNA, 25 bp, Homo sapien
tctctacgtctgcttgttccctgac

SEQ ID NO: 663617 - DNA, 25 bp, Homo sapien
gttccctgactcactctggtaaaat

SEQ ID NO: 663618 - DNA, 25 bp, Homo sapien
tggtaaaatctcacctcctatcttt

SEQ ID NO: 663619 - DNA, 25 bp, Homo sapien
tttctgccatccattattactactc

SEQ ID NO: 663620 - DNA, 25 bp, Homo sapien
gccatccattattactactctgcag

SEQ ID NO: 663621 - DNA, 25 bp, Homo sapien
actactctgcagaagtatttacatt

SEQ ID NO: 663622 - DNA, 25 bp, Homo sapien
gctgacactttggaatatggcatgt

SEQ ID NO: 663623 - DNA, 25 bp, Homo sapien
gaatatggcatgtacccaagttaat

SEQ ID NO: 663624 - DNA, 25 bp, Homo sapien
gtataaaactgtaccctttgtgata

SEQ ID NO: 663625 - DNA, 25 bp, Homo sapien
accctttgtgataatattaccttag

SEQ ID NO: 663626 - DNA, 25 bp, Homo sapien
ggagactcggagatatttactttct

SEQ ID NO: 663627 - DNA, 25 bp, Homo sapien
gagactcggagatatttactttctt

SEQ ID NO: 663628 - DNA, 25 bp, Homo sapien
gactcggagatatttactttcttgg

SEQ ID NO: 663629 - DNA, 25 bp, Homo sapien
ctcggagatatttactttcttggaa

SEQ ID NO: 663630 - DNA, 25 bp, Homo sapien
ggagatatttactttcttggaaaca

SEQ ID NO: 663631 - DNA, 25 bp, Homo sapien
gatatttactttcttggaaacacaa

SEQ ID NO: 663632 - DNA, 25 bp, Homo sapien
actttcttggaaacacaacagtcta

SEQ ID NO: 663633 - DNA, 25 bp, Homo sapien
tttcttggaaacacaacagtctatt

SEQ ID NO: 663634 - DNA, 25 bp, Homo sapien
tcttggaaacacaacagtctattaa

SEQ ID NO: 663635 - DNA, 25 bp, Homo sapien
tgggcacctataacctcagcctccc

SEQ ID NO: 663636 - DNA, 25 bp, Homo sapien
agctgtgactagagtgcaccaccac

SEQ ID NO: 663637 - DNA, 25 bp, Homo sapien
atagattagtggttcactagcggga

SEQ ID NO: 663638 - DNA, 25 bp, Homo sapien
agtggttcactagcgggagggattg

SEQ ID NO: 663639 - DNA, 25 bp, Homo sapien
ggtgataactaagggtatatagcat

SEQ ID NO: 663640 - DNA, 25 bp, Homo sapien
taagggtatatagcatttttggagg

SEQ ID NO: 663641 - DNA, 25 bp, Homo sapien
tctaaaattgtggtgctcactgtac

SEQ ID NO: 663642 - DNA, 25 bp, Homo sapien
taaaattgtggtgctcactgtacac

SEQ ID NO: 663643 - DNA, 25 bp, Homo sapien
tgtggtgctcactgtacacaatctg

SEQ ID NO: 663644 - DNA, 25 bp, Homo sapien
gtggtgctcactgtacacaatctgt

SEQ ID NO: 663645 - DNA, 25 bp, Homo sapien
gtgctcactgtacacaatctgtgaa

SEQ ID NO: 663646 - DNA, 25 bp, Homo sapien
ctcactgtacacaatctgtgaatat

SEQ ID NO: 663647 - DNA, 25 bp, Homo sapien
cactgtacacaatctgtgaatatac

SEQ ID NO: 663648 - DNA, 25 bp, Homo sapien
gtcccaatgatgagttgccatgcta

SEQ ID NO: 663649 - DNA, 25 bp, Homo sapien
cagttggcttaatgaatacctcccc

SEQ ID NO: 663650 - DNA, 25 bp, Homo sapien
tgaatacctccccattccatcatga

SEQ ID NO: 663651 - DNA, 25 bp, Homo sapien
gagaaatttctctttgacgatcaca

SEQ ID NO: 663652 - DNA, 25 bp, Homo sapien
ctttgacgatcacaccctcagtttg

SEQ ID NO: 663653 - DNA, 25 bp, Homo sapien
agtttgcctagtgtaggaccctcaa

SEQ ID NO: 663654 - DNA, 25 bp, Homo sapien
gtgtaggaccctcaaaggaaattgg

SEQ ID NO: 663655 - DNA, 25 bp, Homo sapien
gagttgccatgctaatactgagcca

SEQ ID NO: 663656 - DNA, 25 bp, Homo sapien
tgctaatactgagccaccaggtagg

SEQ ID NO: 663657 - DNA, 25 bp, Homo sapien
tgggtgccagtgagtttaacaaaac

SEQ ID NO: 663658 - DNA, 25 bp, Homo sapien
caaaacttctcacatgaagatctga

SEQ ID NO: 663659 - DNA, 25 bp, Homo sapien
ctggccaaaagaatgttcttgagct

SEQ ID NO: 663660 - DNA, 25 bp, Homo sapien
ggccaaaagaatgttcttgagcttt

SEQ ID NO: 663661 - DNA, 25 bp, Homo sapien
aagaatgttcttgagctttatattt

SEQ ID NO: 663662 - DNA, 25 bp, Homo sapien
agaatgttcttgagctttatatttt

SEQ ID NO: 663663 - DNA, 25 bp, Homo sapien
attttgacccaaattaggcaatagt

SEQ ID NO: 663664 - DNA, 25 bp, Homo sapien
tgacccaaattaggcaatagttacc

SEQ ID NO: 663665 - DNA, 25 bp, Homo sapien
caaaatcattttggctttattaaag

SEQ ID NO: 663666 - DNA, 25 bp, Homo sapien
gctcctcaaaaaactctagaattag

SEQ ID NO: 663667 - DNA, 25 bp, Homo sapien
actctagaattagggctttcttaag

SEQ ID NO: 663668 - DNA, 25 bp, Homo sapien
gctttcttaagttactttttagcag

SEQ ID NO: 663669 - DNA, 25 bp, Homo sapien
ttactttttagcagaaacatttacg

SEQ ID NO: 663670 - DNA, 25 bp, Homo sapien
agagacctgggtaattgtggccttg

SEQ ID NO: 663671 - DNA, 25 bp, Homo sapien
ctgggtaattgtggccttggaggaa

SEQ ID NO: 663672 - DNA, 25 bp, Homo sapien
gaggaaggcgctggccccagcattc

SEQ ID NO: 663673 - DNA, 25 bp, Homo sapien
caggaggtgaagacgggcaaggcaa

SEQ ID NO: 663674 - DNA, 25 bp, Homo sapien
gcaaggcaagccagttctttgggct

SEQ ID NO: 663675 - DNA, 25 bp, Homo sapien
cttctcctgatggagctgtccgtgt

SEQ ID NO: 663676 - DNA, 25 bp, Homo sapien
ctgatggagctgtccgtgtgcactg

SEQ ID NO: 663677 - DNA, 25 bp, Homo sapien
tgtgcactgtggcaggtgatggtgg

SEQ ID NO: 663678 - DNA, 25 bp, Homo sapien
aggaacagacactcagcactgaagc

SEQ ID NO: 663679 - DNA, 25 bp, Homo sapien
cagacactcagcactgaagcagaga

SEQ ID NO: 663680 - DNA, 25 bp, Homo sapien
tcagcactgaagcagagacctgggt

SEQ ID NO: 663681 - DNA, 25 bp, Homo sapien
ggtgccaggctctttctaagagcca

SEQ ID NO: 663682 - DNA, 25 bp, Homo sapien
agctctcctggaacaaatacagtga

SEQ ID NO: 663683 - DNA, 25 bp, Homo sapien
gcagggagggcatcagtctattcat

SEQ ID NO: 663684 - DNA, 25 bp, Homo sapien
gggcatcagtctattcatgatccaa

SEQ ID NO: 663685 - DNA, 25 bp, Homo sapien
gtctattcatgatccaaatacctcc

SEQ ID NO: 663686 - DNA, 25 bp, Homo sapien
cattaggccccaccgaaaacgctgg

SEQ ID NO: 663687 - DNA, 25 bp, Homo sapien
aaacgctgggaatcagatttcaaca

SEQ ID NO: 663688 - DNA, 25 bp, Homo sapien
gattcaaactatagcacagggccgt

SEQ ID NO: 663689 - DNA, 25 bp, Homo sapien
tagcacagggccgtagagtctctgt

SEQ ID NO: 663690 - DNA, 25 bp, Homo sapien
cacagggccgtagagtctctgtcac

SEQ ID NO: 663691 - DNA, 25 bp, Homo sapien
gtagaggaaaaacagccatacataa

SEQ ID NO: 663692 - DNA, 25 bp, Homo sapien
tcttgcccaggcttgcaatttatag

SEQ ID NO: 663693 - DNA, 25 bp, Homo sapien
caatttatagagctccagacaccct

SEQ ID NO: 663694 - DNA, 25 bp, Homo sapien
cagacaccctcattggtagctgctt

SEQ ID NO: 663695 - DNA, 25 bp, Homo sapien
gtagctgcttctgataaattccaca

SEQ ID NO: 663696 - DNA, 25 bp, Homo sapien
gatggcagcaaaccaccagcttcag

SEQ ID NO: 663697 - DNA, 25 bp, Homo sapien
gtggcccaggacaccggaccaggtt

SEQ ID NO: 663698 - DNA, 25 bp, Homo sapien
aatctgagcttcacattcctagacc

SEQ ID NO: 663699 - DNA, 25 bp, Homo sapien
agacctccagaggttctcttcatgg

SEQ ID NO: 663700 - DNA, 25 bp, Homo sapien
catggccacctggacaactggcaaa

SEQ ID NO: 663701 - DNA, 25 bp, Homo sapien
aaaccattctgtttccttacacgtg

SEQ ID NO: 663702 - DNA, 25 bp, Homo sapien
cttacacgtgcacatatcatccaga

SEQ ID NO: 663703 - DNA, 25 bp, Homo sapien
agtgacatgtcatagcaggagctga

SEQ ID NO: 663704 - DNA, 25 bp, Homo sapien
gccagactagggagcatcggccgct

SEQ ID NO: 663705 - DNA, 25 bp, Homo sapien
gccgcttgttccatcctgtgcttgt

SEQ ID NO: 663706 - DNA, 25 bp, Homo sapien
tgcctctctgtcatgagacgcattc

SEQ ID NO: 663707 - DNA, 25 bp, Homo sapien
gcattcgaagagtcctgggcccaaa

SEQ ID NO: 663708 - DNA, 25 bp, Homo sapien
tgggcccaaaagcaactcacagtcc

SEQ ID NO: 663709 - DNA, 25 bp, Homo sapien
agtccaggaagacgtccaggccttg

SEQ ID NO: 663710 - DNA, 25 bp, Homo sapien
cttgggtgacgctcagtctcataaa

SEQ ID NO: 663711 - DNA, 25 bp, Homo sapien
agacggagaatggtggcctcctcca

SEQ ID NO: 663712 - DNA, 25 bp, Homo sapien
gaatggtgctcatcattagccatga

SEQ ID NO: 663713 - DNA, 25 bp, Homo sapien
agccatgacaagcttcaatgttcaa

SEQ ID NO: 663714 - DNA, 25 bp, Homo sapien
taggtttaactttttggcatggtgg

SEQ ID NO: 663715 - DNA, 25 bp, Homo sapien
gagaattgtttgagtctaagagtac

SEQ ID NO: 663716 - DNA, 25 bp, Homo sapien
gagtctaagagtacgttaccaacct

SEQ ID NO: 663717 - DNA, 25 bp, Homo sapien
gtctaagagtacgttaccaacctag

SEQ ID NO: 663718 - DNA, 25 bp, Homo sapien
taagagtacgttaccaacctaggtg

SEQ ID NO: 663719 - DNA, 25 bp, Homo sapien
gagtacgttaccaacctaggtgaca

SEQ ID NO: 663720 - DNA, 25 bp, Homo sapien
gtacgttaccaacctaggtgacata

SEQ ID NO: 663721 - DNA, 25 bp, Homo sapien
accaacctaggtgacataacaagat

SEQ ID NO: 663722 - DNA, 25 bp, Homo sapien
aacctaggtgacataacaagatcct

SEQ ID NO: 663723 - DNA, 25 bp, Homo sapien
gattgcacaactgcactttggcctg

SEQ ID NO: 663724 - DNA, 25 bp, Homo sapien
attgcacaactgcactttggcctgg

SEQ ID NO: 663725 - DNA, 25 bp, Homo sapien
tatataggcccttttttgatgtgtg

SEQ ID NO: 663726 - DNA, 25 bp, Homo sapien
atataggcccttttttgatgtgtgg

SEQ ID NO: 663727 - DNA, 25 bp, Homo sapien
tataggcccttttttgatgtgtggt

SEQ ID NO: 663728 - DNA, 25 bp, Homo sapien
ataggcccttttttgatgtgtggtt

SEQ ID NO: 663729 - DNA, 25 bp, Homo sapien
taggcccttttttgatgtgtggttt

SEQ ID NO: 663730 - DNA, 25 bp, Homo sapien
ggcccttttttgatgtgtggtttct

SEQ ID NO: 663731 - DNA, 25 bp, Homo sapien
gcccttttttgatgtgtggtttcta

SEQ ID NO: 663732 - DNA, 25 bp, Homo sapien
ccttttttgatgtgtggtttctaag

SEQ ID NO: 663733 - DNA, 25 bp, Homo sapien
tttgatgtgtggtttctaagaggca

SEQ ID NO: 663734 - DNA, 25 bp, Homo sapien
tgatgtgtggtttctaagaggcaga

SEQ ID NO: 663735 - DNA, 25 bp, Homo sapien
ttctaagaggcagagggccaggcgc

SEQ ID NO: 663736 - DNA, 25 bp, Homo sapien
agacctcatatcattttacctgcag

SEQ ID NO: 663737 - DNA, 25 bp, Homo sapien
ttttacctgcagatactgggccata

SEQ ID NO: 663738 - DNA, 25 bp, Homo sapien
gatactgggccataaagatctgtaa

SEQ ID NO: 663739 - DNA, 25 bp, Homo sapien
cataacccaaatatcctatcactgc

SEQ ID NO: 663740 - DNA, 25 bp, Homo sapien
aaatatcctatcactgccagcaata

SEQ ID NO: 663741 - DNA, 25 bp, Homo sapien
taacatcatctaatattcaggccat

SEQ ID NO: 663742 - DNA, 25 bp, Homo sapien
tattcaggccatatccaattttccc

SEQ ID NO: 663743 - DNA, 25 bp, Homo sapien
ccaattttccctgattgtcttgaaa

SEQ ID NO: 663744 - DNA, 25 bp, Homo sapien
gtcttgaaaactatccattgcttgc

SEQ ID NO: 663745 - DNA, 25 bp, Homo sapien
gctgttctttttcataatctgtctt

SEQ ID NO: 663746 - DNA, 25 bp, Homo sapien
aatctgtctttttccttgatagaac

SEQ ID NO: 663747 - DNA, 25 bp, Homo sapien
gaaagcaggatgatcaatggcctat

SEQ ID NO: 663748 - DNA, 25 bp, Homo sapien
gcaggatgatcaatggcctatgaaa

SEQ ID NO: 663749 - DNA, 25 bp, Homo sapien
aatggcctatgaaaggatcctcagc

SEQ ID NO: 663750 - DNA, 25 bp, Homo sapien
ggcctatgaaaggatcctcagctgt

SEQ ID NO: 663751 - DNA, 25 bp, Homo sapien
tatgaaaggatcctcagctgtggct

SEQ ID NO: 663752 - DNA, 25 bp, Homo sapien
tgaaaggatcctcagctgtggctag

SEQ ID NO: 663753 - DNA, 25 bp, Homo sapien
aaaggatcctcagctgtggctaggc

SEQ ID NO: 663754 - DNA, 25 bp, Homo sapien
aggatcctcagctgtggctaggcgc

SEQ ID NO: 663755 - DNA, 25 bp, Homo sapien
atcctcagctgtggctaggcgcagt

SEQ ID NO: 663756 - DNA, 25 bp, Homo sapien
gcgttcgagactggcatgggaaaca

SEQ ID NO: 663757 - DNA, 25 bp, Homo sapien
cgagactggcatgggaaacatggca

SEQ ID NO: 663758 - DNA, 25 bp, Homo sapien
ttggcaaatgcctgaggtggtatga

SEQ ID NO: 663759 - DNA, 25 bp, Homo sapien
tcctagactatatgaaatccttttt

SEQ ID NO: 663760 - DNA, 25 bp, Homo sapien
atcctttttaaatctccttattctg

SEQ ID NO: 663761 - DNA, 25 bp, Homo sapien
aaatttagaccactcatgggattta

SEQ ID NO: 663762 - DNA, 25 bp, Homo sapien
atactgtatttcgtgactataatca

SEQ ID NO: 663763 - DNA, 25 bp, Homo sapien
atcaaactggagacattatgcaaac

SEQ ID NO: 663764 - DNA, 25 bp, Homo sapien
gcaaacatagagctcttatattttc

SEQ ID NO: 663765 - DNA, 25 bp, Homo sapien
tttcattcttctactttaggtcgca

SEQ ID NO: 663766 - DNA, 25 bp, Homo sapien
cttctactttaggtcgcaattgtct

SEQ ID NO: 663767 - DNA, 25 bp, Homo sapien
gtcgcaattgtctatctctgcatta

SEQ ID NO: 663768 - DNA, 25 bp, Homo sapien
gtctatctctgcattatgtgcaaac

SEQ ID NO: 663769 - DNA, 25 bp, Homo sapien
gaactctcgcctgatgttaacaaaa

SEQ ID NO: 663770 - DNA, 25 bp, Homo sapien
agagcccaagatcaagaagtctgta

SEQ ID NO: 663771 - DNA, 25 bp, Homo sapien
gatcaagaagtctgtaagtcatgaa

SEQ ID NO: 663772 - DNA, 25 bp, Homo sapien
gtaagtcatgaaagagtctccaaaa

SEQ ID NO: 663773 - DNA, 25 bp, Homo sapien
aagggatcacctttttctcatctga

SEQ ID NO: 663774 - DNA, 25 bp, Homo sapien
gggatcacctttttctcatctgaga

SEQ ID NO: 663775 - DNA, 25 bp, Homo sapien
gagcaagaaatatgagagacccaag

SEQ ID NO: 663776 - DNA, 25 bp, Homo sapien
gagacccaaggatgatcgagaggaa

SEQ ID NO: 663777 - DNA, 25 bp, Homo sapien
agatggaagatgacgaactggaagc

SEQ ID NO: 663778 - DNA, 25 bp, Homo sapien
ggccaagagacatgactatgaggtg

SEQ ID NO: 663779 - DNA, 25 bp, Homo sapien
atgaggtggacatcacagtgctcaa

SEQ ID NO: 663780 - DNA, 25 bp, Homo sapien
tgttcatgtctgtcccctctgccat

SEQ ID NO: 663781 - DNA, 25 bp, Homo sapien
gggttctgttcacctgaccatggca

SEQ ID NO: 663782 - DNA, 25 bp, Homo sapien
tctgttcacctgaccatggcagagt

SEQ ID NO: 663783 - DNA, 25 bp, Homo sapien
atggcagagttgttttgcccacctg

SEQ ID NO: 663784 - DNA, 25 bp, Homo sapien
tgttttgcccacctgtgaaaaccac

SEQ ID NO: 663785 - DNA, 25 bp, Homo sapien
tgaaaaccactccaaccatcatggt

SEQ ID NO: 663786 - DNA, 25 bp, Homo sapien
atcatggttaccattgcattgcatg

SEQ ID NO: 663787 - DNA, 25 bp, Homo sapien
taccattgcattgcatgttggcaaa

SEQ ID NO: 663788 - DNA, 25 bp, Homo sapien
ggaacatcaccttccaggccactta

SEQ ID NO: 663789 - DNA, 25 bp, Homo sapien
caggccacttacagcactcgaataa

SEQ ID NO: 663790 - DNA, 25 bp, Homo sapien
gcactcgaataagggctttgacaaa

SEQ ID NO: 663791 - DNA, 25 bp, Homo sapien
tgcctctgtaccaaaagcaataata

SEQ ID NO: 663792 - DNA, 25 bp, Homo sapien
actatgtgctagaggtattggaact

SEQ ID NO: 663793 - DNA, 25 bp, Homo sapien
aatcctcataacaacccttctattt

SEQ ID NO: 663794 - DNA, 25 bp, Homo sapien
cataacaacccttctatttaagacg

SEQ ID NO: 663795 - DNA, 25 bp, Homo sapien
ataacttgctgaatgtcccacttac

SEQ ID NO: 663796 - DNA, 25 bp, Homo sapien
tgctgaatgtcccacttactaagtg

SEQ ID NO: 663797 - DNA, 25 bp, Homo sapien
acttactaagtgaaggatcccagat

SEQ ID NO: 663798 - DNA, 25 bp, Homo sapien
aaggatcccagatttaaggccaggc

SEQ ID NO: 663799 - DNA, 25 bp, Homo sapien
ggcagtgtatctcctgtttgcattc

SEQ ID NO: 663800 - DNA, 25 bp, Homo sapien
gtatctcctgtttgcattcttaact

SEQ ID NO: 663801 - DNA, 25 bp, Homo sapien
cattcttaactactatgctgtacta

SEQ ID NO: 663802 - DNA, 25 bp, Homo sapien
ataaagatcacagactctgaagcca

SEQ ID NO: 663803 - DNA, 25 bp, Homo sapien
gactggcaagattcaaatcccgact

SEQ ID NO: 663804 - DNA, 25 bp, Homo sapien
tcaaatcccgactgccatttttaac

SEQ ID NO: 663805 - DNA, 25 bp, Homo sapien
caaatcccgactgccatttttaact

SEQ ID NO: 663806 - DNA, 25 bp, Homo sapien
tacctaacctctctgtacctgtgta

SEQ ID NO: 663807 - DNA, 25 bp, Homo sapien
ctaacctctctgtacctgtgtaaaa

SEQ ID NO: 663808 - DNA, 25 bp, Homo sapien
aacctctctgtacctgtgtaaaatg

SEQ ID NO: 663809 - DNA, 25 bp, Homo sapien
ctctctgtacctgtgtaaaatggag

SEQ ID NO: 663810 - DNA, 25 bp, Homo sapien
ggagataacagtagtatccacttca

SEQ ID NO: 663811 - DNA, 25 bp, Homo sapien
ataacagtagtatccacttcacaga

SEQ ID NO: 663812 - DNA, 25 bp, Homo sapien
acagtagtatccacttcacagagtt

SEQ ID NO: 663813 - DNA, 25 bp, Homo sapien
aacagccatcttatatcacaaacgt

SEQ ID NO: 663814 - DNA, 25 bp, Homo sapien
atatcacaaacgtcatctctgcttc

SEQ ID NO: 663815 - DNA, 25 bp, Homo sapien
caaacgtcatctctgcttccagagg

SEQ ID NO: 663816 - DNA, 25 bp, Homo sapien
gggcttaactcctcagtgatgttaa

SEQ ID NO: 663817 - DNA, 25 bp, Homo sapien
actcctcagtgatgttaagtatcct

SEQ ID NO: 663818 - DNA, 25 bp, Homo sapien
ttaagtatcctgactgaagcctggg

SEQ ID NO: 663819 - DNA, 25 bp, Homo sapien
gaagcctgggaatgttccacactca

SEQ ID NO: 663820 - DNA, 25 bp, Homo sapien
aatgttccacactcactgtcctgtg

SEQ ID NO: 663821 - DNA, 25 bp, Homo sapien
cctgtggcccggacaaatgagagtt

SEQ ID NO: 663822 - DNA, 25 bp, Homo sapien
caaatgagagttgtttatctttcaa

SEQ ID NO: 663823 - DNA, 25 bp, Homo sapien
gtttatctttcaactccacttagaa

SEQ ID NO: 663824 - DNA, 25 bp, Homo sapien
ttctgaactgctgtccagggcttgg

SEQ ID NO: 663825 - DNA, 25 bp, Homo sapien
gaactgctgtccagggcttggagct

SEQ ID NO: 663826 - DNA, 25 bp, Homo sapien
ttggagctggtgacaagtaaggtac

SEQ ID NO: 663827 - DNA, 25 bp, Homo sapien
gtaaggtacaccgacttggagatgt

SEQ ID NO: 663828 - DNA, 25 bp, Homo sapien
tggagatgtctgctgacaccaggat

SEQ ID NO: 663829 - DNA, 25 bp, Homo sapien
ggatttgggctgatagggccctctc

SEQ ID NO: 663830 - DNA, 25 bp, Homo sapien
gccctctcttgggtgagtactggca

SEQ ID NO: 663831 - DNA, 25 bp, Homo sapien
tcttgggtgagtactggcattgcag

SEQ ID NO: 663832 - DNA, 25 bp, Homo sapien
agaagccagcattgggcttgtccca

SEQ ID NO: 663833 - DNA, 25 bp, Homo sapien
gcattgggcttgtcccagattgtgt

SEQ ID NO: 663834 - DNA, 25 bp, Homo sapien
tcccagattgtgtaatgagacttct

SEQ ID NO: 663835 - DNA, 25 bp, Homo sapien
tgtgcacgcatgtacatgcacacag

SEQ ID NO: 663836 - DNA, 25 bp, Homo sapien
catgtacatgcacacagacacactc

SEQ ID NO: 663837 - DNA, 25 bp, Homo sapien
agacacactcatgcattcacgcact

SEQ ID NO: 663838 - DNA, 25 bp, Homo sapien
actcacacacaccaagatctgacgg

SEQ ID NO: 663839 - DNA, 25 bp, Homo sapien
acaccaagatctgacggttgtagct

SEQ ID NO: 663840 - DNA, 25 bp, Homo sapien
agatctgacggttgtagctggatag

SEQ ID NO: 663841 - DNA, 25 bp, Homo sapien
caggatgaagaagccataggagcat

SEQ ID NO: 663842 - DNA, 25 bp, Homo sapien
agaagccataggagcatgatcttac

SEQ ID NO: 663843 - DNA, 25 bp, Homo sapien
gagtggagagagtacctgtgtcata

SEQ ID NO: 663844 - DNA, 25 bp, Homo sapien
gagagagtacctgtgtcatagccct

SEQ ID NO: 663845 - DNA, 25 bp, Homo sapien
gagagtacctgtgtcatagccctga

SEQ ID NO: 663846 - DNA, 25 bp, Homo sapien
tttcctggaagaaattcgggagagg

SEQ ID NO: 663847 - DNA, 25 bp, Homo sapien
gagaggaggttgatgcccaagtgtc

SEQ ID NO: 663848 - DNA, 25 bp, Homo sapien
atgcccaagtgtctggactccagtt

SEQ ID NO: 663849 - DNA, 25 bp, Homo sapien
aagtgtctggactccagttggttgg

SEQ ID NO: 663850 - DNA, 25 bp, Homo sapien
ggaaggccttttgcacgtagaacag

SEQ ID NO: 663851 - DNA, 25 bp, Homo sapien
ggccttttgcacgtagaacagcaag

SEQ ID NO: 663852 - DNA, 25 bp, Homo sapien
tgcacgtagaacagcaaggtgaaca

SEQ ID NO: 663853 - DNA, 25 bp, Homo sapien
gtgaacatgaattaaccaggtggaa

SEQ ID NO: 663854 - DNA, 25 bp, Homo sapien
atgaattaaccaggtggaaaccaag

SEQ ID NO: 663855 - DNA, 25 bp, Homo sapien
accaaggaacaggtattctcagcct

SEQ ID NO: 663856 - DNA, 25 bp, Homo sapien
gctgagatgtcttgtgggcctagag

SEQ ID NO: 663857 - DNA, 25 bp, Homo sapien
gcctgcactgggcacccaacatttt

SEQ ID NO: 663858 - DNA, 25 bp, Homo sapien
cattttcccggagtgcgaggtcctg

SEQ ID NO: 663859 - DNA, 25 bp, Homo sapien
ttttcccggagtgcgaggtcctgct

SEQ ID NO: 663860 - DNA, 25 bp, Homo sapien
cggagtgcgaggtcctgctggtcct

SEQ ID NO: 663861 - DNA, 25 bp, Homo sapien
gtcctggaggcagaagaccgctttt

SEQ ID NO: 663862 - DNA, 25 bp, Homo sapien
ggaggcagaagaccgcttttctctc

SEQ ID NO: 663863 - DNA, 25 bp, Homo sapien
gcagaagaccgcttttctctctgcc

SEQ ID NO: 663864 - DNA, 25 bp, Homo sapien
tttctcctttccaatatccctctgt

SEQ ID NO: 663865 - DNA, 25 bp, Homo sapien
catctgtccttttctcgctccattc

SEQ ID NO: 663866 - DNA, 25 bp, Homo sapien
tccctttctctctgtttctgttcct

SEQ ID NO: 663867 - DNA, 25 bp, Homo sapien
tatatgatcccattgtgtgtatctg

SEQ ID NO: 663868 - DNA, 25 bp, Homo sapien
attccttcttcggtcgggcacggtg

SEQ ID NO: 663869 - DNA, 25 bp, Homo sapien
ttccttcttcggtcgggcacggtgg

SEQ ID NO: 663870 - DNA, 25 bp, Homo sapien
tccttcttcggtcgggcacggtggc

SEQ ID NO: 663871 - DNA, 25 bp, Homo sapien
ccttcttcggtcgggcacggtggct

SEQ ID NO: 663872 - DNA, 25 bp, Homo sapien
cttcttcggtcgggcacggtggctc

SEQ ID NO: 663873 - DNA, 25 bp, Homo sapien
tagcgctttgagtggccaaggtggt

SEQ ID NO: 663874 - DNA, 25 bp, Homo sapien
agcgctttgagtggccaaggtggtt

SEQ ID NO: 663875 - DNA, 25 bp, Homo sapien
gcgctttgagtggccaaggtggttg

SEQ ID NO: 663876 - DNA, 25 bp, Homo sapien
cgctttgagtggccaaggtggttgg

SEQ ID NO: 663877 - DNA, 25 bp, Homo sapien
gctttgagtggccaaggtggttgga

SEQ ID NO: 663878 - DNA, 25 bp, Homo sapien
gagtggccaaggtggttggatcacg

SEQ ID NO: 663879 - DNA, 25 bp, Homo sapien
agccccatatctttgggaacaaggg

SEQ ID NO: 663880 - DNA, 25 bp, Homo sapien
gggaacaagggtttgcacagccacc

SEQ ID NO: 663881 - DNA, 25 bp, Homo sapien
cctgggatgccctgggactcctgac

SEQ ID NO: 663882 - DNA, 25 bp, Homo sapien
tgaccgcacaggaccccagcaggga

SEQ ID NO: 663883 - DNA, 25 bp, Homo sapien
gagggtctggtctaacagccggact

SEQ ID NO: 663884 - DNA, 25 bp, Homo sapien
taacagccggacttggtcttgaacc

SEQ ID NO: 663885 - DNA, 25 bp, Homo sapien
acttggtcttgaaccgtcgccctgt

SEQ ID NO: 663886 - DNA, 25 bp, Homo sapien
agtggagctgccaggaggcctccca

SEQ ID NO: 663887 - DNA, 25 bp, Homo sapien
tcacagccttggtgttctccgggtc

SEQ ID NO: 663888 - DNA, 25 bp, Homo sapien
ggtgttctccgggtcacccagagga

SEQ ID NO: 663889 - DNA, 25 bp, Homo sapien
cagaggaccgtcaaatgctggattt

SEQ ID NO: 663890 - DNA, 25 bp, Homo sapien
gattaatcgctgatattatatgact

SEQ ID NO: 663891 - DNA, 25 bp, Homo sapien
attaatcgctgatattatatgactt

SEQ ID NO: 663892 - DNA, 25 bp, Homo sapien
ttaatcgctgatattatatgacttc

SEQ ID NO: 663893 - DNA, 25 bp, Homo sapien
taatcgctgatattatatgacttcg

SEQ ID NO: 663894 - DNA, 25 bp, Homo sapien
aatcgctgatattatatgacttcgt

SEQ ID NO: 663895 - DNA, 25 bp, Homo sapien
gaatcaggggagaattgctagagcc

SEQ ID NO: 663896 - DNA, 25 bp, Homo sapien
gagaattgctagagcctaggagtta

SEQ ID NO: 663897 - DNA, 25 bp, Homo sapien
agaattgctagagcctaggagttag

SEQ ID NO: 663898 - DNA, 25 bp, Homo sapien
gcgagcctgggggaacataagacat

SEQ ID NO: 663899 - DNA, 25 bp, Homo sapien
agcctgggggaacataagacatttt

SEQ ID NO: 663900 - DNA, 25 bp, Homo sapien
gggaacataagacattttctctaaa

SEQ ID NO: 663901 - DNA, 25 bp, Homo sapien
taactgctgcaatttgagcttgagt

SEQ ID NO: 663902 - DNA, 25 bp, Homo sapien
attcctttataatttcttcatctac

SEQ ID NO: 663903 - DNA, 25 bp, Homo sapien
cacatcacctcctactagcaatata

SEQ ID NO: 663904 - DNA, 25 bp, Homo sapien
gcaatatattttggcatgcttcttg

SEQ ID NO: 663905 - DNA, 25 bp, Homo sapien
ggcatgcttcttgaaatgtcaacag

SEQ ID NO: 663906 - DNA, 25 bp, Homo sapien
aatgtcaacagtattgagccaaaag

SEQ ID NO: 663907 - DNA, 25 bp, Homo sapien
atttgtgttggatatgccagatctg

SEQ ID NO: 663908 - DNA, 25 bp, Homo sapien
gccagatctgaattgtggtatcata

SEQ ID NO: 663909 - DNA, 25 bp, Homo sapien
tgtggtatcatatttactgtattga

SEQ ID NO: 663910 - DNA, 25 bp, Homo sapien
tttctccactatctctgaaatatag

SEQ ID NO: 663911 - DNA, 25 bp, Homo sapien
actgtatatcagttgccaaaacatt

SEQ ID NO: 663912 - DNA, 25 bp, Homo sapien
aaaagtctggaaacagcccagctct

SEQ ID NO: 663913 - DNA, 25 bp, Homo sapien
agctctctcaaaaagggtctggcaa

SEQ ID NO: 663914 - DNA, 25 bp, Homo sapien
aagggtctggcaaaataacctcagg

SEQ ID NO: 663915 - DNA, 25 bp, Homo sapien
gaggagcagcgaacacttattgagt

SEQ ID NO: 663916 - DNA, 25 bp, Homo sapien
ttactgcacaccaggcactgtccta

SEQ ID NO: 663917 - DNA, 25 bp, Homo sapien
ctgtcctaagccatttacaagcttt

SEQ ID NO: 663918 - DNA, 25 bp, Homo sapien
agctttatcttattgaatctccaca

SEQ ID NO: 663919 - DNA, 25 bp, Homo sapien
atgctgttatctttggatcacaaat

SEQ ID NO: 663920 - DNA, 25 bp, Homo sapien
tggctcaacattaaacaactggctt

SEQ ID NO: 663921 - DNA, 25 bp, Homo sapien
tggcttgaacgagagcattctgcct

SEQ ID NO: 663922 - DNA, 25 bp, Homo sapien
attctgcctccaaagactatgctct

SEQ ID NO: 663923 - DNA, 25 bp, Homo sapien
gaaaggccaaagcttctgggcccac

SEQ ID NO: 663924 - DNA, 25 bp, Homo sapien
aacgcagctccgctttcatttcttt

SEQ ID NO: 663925 - DNA, 25 bp, Homo sapien
ttctttcacatacaactttccacat

SEQ ID NO: 663926 - DNA, 25 bp, Homo sapien
ttggtcatggctttccttgcaggca

SEQ ID NO: 663927 - DNA, 25 bp, Homo sapien
caggcatgggatggaccagcgaaaa

SEQ ID NO: 663928 - DNA, 25 bp, Homo sapien
attgcagttgcctgggacatttttc

SEQ ID NO: 663929 - DNA, 25 bp, Homo sapien
tgggacatttttcagccccttcttt

SEQ ID NO: 663930 - DNA, 25 bp, Homo sapien
ccttctttttggactaattggagca

SEQ ID NO: 663931 - DNA, 25 bp, Homo sapien
tattgcatctctcagaccagaaact

SEQ ID NO: 663932 - DNA, 25 bp, Homo sapien
gaaactgtaggaagcgcggattcta

SEQ ID NO: 663933 - DNA, 25 bp, Homo sapien
gcgcggattctattactggaaactt

SEQ ID NO: 663934 - DNA, 25 bp, Homo sapien
ctggttccagaggatcatattcagt

SEQ ID NO: 663935 - DNA, 25 bp, Homo sapien
atctgcattttacaagccctccagg

SEQ ID NO: 663936 - DNA, 25 bp, Homo sapien
tttacaagccctccaggtataagga

SEQ ID NO: 663937 - DNA, 25 bp, Homo sapien
aggagagcctcacagtctgcagact

SEQ ID NO: 663938 - DNA, 25 bp, Homo sapien
gtctgcagactattctgcaacgctc

SEQ ID NO: 663939 - DNA, 25 bp, Homo sapien
tattctgcaacgctctgctccagga

SEQ ID NO: 663940 - DNA, 25 bp, Homo sapien
gggtctatcctacatattctttctg

SEQ ID NO: 663941 - DNA, 25 bp, Homo sapien
tctttctgaggctctgtgagtctca

SEQ ID NO: 663942 - DNA, 25 bp, Homo sapien
tgaggctctgtgagtctcatgcgaa

SEQ ID NO: 663943 - DNA, 25 bp, Homo sapien
ctcatgcgaaggatgctgaatgctt

SEQ ID NO: 663944 - DNA, 25 bp, Homo sapien
taaaaatgcttcttgcggctgggcg

SEQ ID NO: 663945 - DNA, 25 bp, Homo sapien
aaggaattcgtggtgaaactggaca

SEQ ID NO: 663946 - DNA, 25 bp, Homo sapien
ggacacaattgttgagggatttcca

SEQ ID NO: 663947 - DNA, 25 bp, Homo sapien
ttgttgagggatttccagagctgat

SEQ ID NO: 663948 - DNA, 25 bp, Homo sapien
cagagctgatgaacgttgtggacct

SEQ ID NO: 663949 - DNA, 25 bp, Homo sapien
gaacgttgtggacctgtggcttaca

SEQ ID NO: 663950 - DNA, 25 bp, Homo sapien
gtggcttacaccaaacagggtgggt

SEQ ID NO: 663951 - DNA, 25 bp, Homo sapien
tgtgagctcggcacagctaggacgc

SEQ ID NO: 663952 - DNA, 25 bp, Homo sapien
caccaaagtcagtgaggagatctta

SEQ ID NO: 663953 - DNA, 25 bp, Homo sapien
gagatcttagtgtctcccggagaga

SEQ ID NO: 663954 - DNA, 25 bp, Homo sapien
tctcccggagagagccgaccgaggc

SEQ ID NO: 663955 - DNA, 25 bp, Homo sapien
ccgaccgaggctggcgcatgtctga

SEQ ID NO: 663956 - DNA, 25 bp, Homo sapien
ggaactgggttgagtcacagcacaa

SEQ ID NO: 663957 - DNA, 25 bp, Homo sapien
gaggaggtccctgttctgacagaag

SEQ ID NO: 663958 - DNA, 25 bp, Homo sapien
aagccctgagccgtgactgtggact

SEQ ID NO: 663959 - DNA, 25 bp, Homo sapien
gtgactgtggactgacacccactgc

SEQ ID NO: 663960 - DNA, 25 bp, Homo sapien
tgtgaccttgggtgggttacataac

SEQ ID NO: 663961 - DNA, 25 bp, Homo sapien
cttgtggcctgagctaacctgggta

SEQ ID NO: 663962 - DNA, 25 bp, Homo sapien
aacctgggtagtgggagccctatct

SEQ ID NO: 663963 - DNA, 25 bp, Homo sapien
ggagccctatctgtgaattgccaag

SEQ ID NO: 663964 - DNA, 25 bp, Homo sapien
tgtgaattgccaagggactgccatg

SEQ ID NO: 663965 - DNA, 25 bp, Homo sapien
gactggtgagaacacagctctgcaa

SEQ ID NO: 663966 - DNA, 25 bp, Homo sapien
ctctgcaaggcccttttgatttgtt

SEQ ID NO: 663967 - DNA, 25 bp, Homo sapien
aaccttgatggtaaccttggagaag

SEQ ID NO: 663968 - DNA, 25 bp, Homo sapien
taagctgtgcctggatttctgactc

SEQ ID NO: 663969 - DNA, 25 bp, Homo sapien
gtgcctggatttctgactcactgaa

SEQ ID NO: 663970 - DNA, 25 bp, Homo sapien
tctgactcactgaaactgtgggata

SEQ ID NO: 663971 - DNA, 25 bp, Homo sapien
aatgtgtgttattttcagccaataa

SEQ ID NO: 663972 - DNA, 25 bp, Homo sapien
attttcagccaataaatttgcagta

SEQ ID NO: 663973 - DNA, 25 bp, Homo sapien
attatctttcagtaccttatccttg

SEQ ID NO: 663974 - DNA, 25 bp, Homo sapien
ttcagtaccttatccttgattgatg

SEQ ID NO: 663975 - DNA, 25 bp, Homo sapien
ccttgattgatgtttgttctgtata

SEQ ID NO: 663976 - DNA, 25 bp, Homo sapien
aaataatagtatcttctaacccata

SEQ ID NO: 663977 - DNA, 25 bp, Homo sapien
tggccaaaaccttgatggtaacctt

SEQ ID NO: 663978 - DNA, 25 bp, Homo sapien
tccctgattgccttcttagaggtct

SEQ ID NO: 663979 - DNA, 25 bp, Homo sapien
tcttagaggtcttcaggctgtcact

SEQ ID NO: 663980 - DNA, 25 bp, Homo sapien
gctgtcactgaagaagtcgctgcct

SEQ ID NO: 663981 - DNA, 25 bp, Homo sapien
gaagaagtcgctgcctgattccatc

SEQ ID NO: 663982 - DNA, 25 bp, Homo sapien
gattccatcctcatgaaacgcctga

SEQ ID NO: 663983 - DNA, 25 bp, Homo sapien
aaacgcctgaggaacatcatggaca

SEQ ID NO: 663984 - DNA, 25 bp, Homo sapien
gacacgctgaccttcagcatctata

SEQ ID NO: 663985 - DNA, 25 bp, Homo sapien
agcatctataaccacggctgcacag

SEQ ID NO: 663986 - DNA, 25 bp, Homo sapien
tgcacagggctgtttgagaggcaca

SEQ ID NO: 663987 - DNA, 25 bp, Homo sapien
aagggagagtccctcaagaagaact

SEQ ID NO: 663988 - DNA, 25 bp, Homo sapien
gaaacatttccctggagaaaagcaa

SEQ ID NO: 663989 - DNA, 25 bp, Homo sapien
tcaccaatagtatgtctaagtaatt

SEQ ID NO: 663990 - DNA, 25 bp, Homo sapien
tttaatttaatgtccagatgctgtc

SEQ ID NO: 663991 - DNA, 25 bp, Homo sapien
ttaatgtccagatgctgtcagtcct

SEQ ID NO: 663992 - DNA, 25 bp, Homo sapien
tgtcagtcctgagagcaaaatgcaa

SEQ ID NO: 663993 - DNA, 25 bp, Homo sapien
gtcctgagagcaaaatgcaacttga

SEQ ID NO: 663994 - DNA, 25 bp, Homo sapien
gacagctctgatggggaccacataa

SEQ ID NO: 663995 - DNA, 25 bp, Homo sapien
tgcccaagttcaacagaatagtgag

SEQ ID NO: 663996 - DNA, 25 bp, Homo sapien
cagaatagtgagaaaacggagacct

SEQ ID NO: 663997 - DNA, 25 bp, Homo sapien
aacggagacctatttgaaagatcaa

SEQ ID NO: 663998 - DNA, 25 bp, Homo sapien
gatcaaagattgatgctcttattag

SEQ ID NO: 663999 - DNA, 25 bp, Homo sapien
gattgatgctcttattagatttggg

SEQ ID NO: 664000 - DNA, 25 bp, Homo sapien
atcctatatgtctccaatcctgcca

SEQ ID NO: 664001 - DNA, 25 bp, Homo sapien
ctatatgtctccaatcctgccaggt

SEQ ID NO: 664002 - DNA, 25 bp, Homo sapien
aatcctgccaggtgtagagtcagat

SEQ ID NO: 664003 - DNA, 25 bp, Homo sapien
tcctgccaggtgtagagtcagatag

SEQ ID NO: 664004 - DNA, 25 bp, Homo sapien
aggtgtagagtcagatagttggctt

SEQ ID NO: 664005 - DNA, 25 bp, Homo sapien
ttggcctttaattttgctgctagct

SEQ ID NO: 664006 - DNA, 25 bp, Homo sapien
ggcctttaattttgctgctagctat

SEQ ID NO: 664007 - DNA, 25 bp, Homo sapien
cctttaattttgctgctagctatta

SEQ ID NO: 664008 - DNA, 25 bp, Homo sapien
tttgctgctagctattaaatttaaa

SEQ ID NO: 664009 - DNA, 25 bp, Homo sapien
tctgaaattaattttcccctcccag

SEQ ID NO: 664010 - DNA, 25 bp, Homo sapien
ttcagatctgcaaacaataaaggat

SEQ ID NO: 664011 - DNA, 25 bp, Homo sapien
tcccattctgagtacttctccgcaa

SEQ ID NO: 664012 - DNA, 25 bp, Homo sapien
cttctccgcaaaccctttgtttcat

SEQ ID NO: 664013 - DNA, 25 bp, Homo sapien
ttgtttcattaaggactgttttaca

SEQ ID NO: 664014 - DNA, 25 bp, Homo sapien
gactgttttacatgaagggtgcaaa

SEQ ID NO: 664015 - DNA, 25 bp, Homo sapien
gaaccctagggtgaaacacgtgaca

SEQ ID NO: 664016 - DNA, 25 bp, Homo sapien
tattgaatagtcctcttctctaccc

SEQ ID NO: 664017 - DNA, 25 bp, Homo sapien
aagagatgagcattcaagtcaggca

SEQ ID NO: 664018 - DNA, 25 bp, Homo sapien
gtcaggcagacctgaatttgggtca

SEQ ID NO: 664019 - DNA, 25 bp, Homo sapien
gaatttgggtcaaggctgcgccact

SEQ ID NO: 664020 - DNA, 25 bp, Homo sapien
aggctgcgccactcaaaagctatat

SEQ ID NO: 664021 - DNA, 25 bp, Homo sapien
agctatatgacctctatatgagcag

SEQ ID NO: 664022 - DNA, 25 bp, Homo sapien
gacagtgctgtggacacgcagacac

SEQ ID NO: 664023 - DNA, 25 bp, Homo sapien
cgcagacacagggaagaagccaggc

SEQ ID NO: 664024 - DNA, 25 bp, Homo sapien
gcatctacaagccaacggacggcaa

SEQ ID NO: 664025 - DNA, 25 bp, Homo sapien
acaagccaacggacggcaaggattt

SEQ ID NO: 664026 - DNA, 25 bp, Homo sapien
gaagccgacaacagattctctcaga

SEQ ID NO: 664027 - DNA, 25 bp, Homo sapien
gattctctcagagcctccagttaga

SEQ ID NO: 664028 - DNA, 25 bp, Homo sapien
ctcagagcctccagttagaaccaat

SEQ ID NO: 664029 - DNA, 25 bp, Homo sapien
gcctccagttagaaccaatcaacct

SEQ ID NO: 664030 - DNA, 25 bp, Homo sapien
tagaaccaatcaaccttggttttgg

SEQ ID NO: 664031 - DNA, 25 bp, Homo sapien
ttggttttggccctttagcatgaca

SEQ ID NO: 664032 - DNA, 25 bp, Homo sapien
ggccctttagcatgacaaactgtaa

SEQ ID NO: 664033 - DNA, 25 bp, Homo sapien
ctgccagtgctaagacaacatccca

SEQ ID NO: 664034 - DNA, 25 bp, Homo sapien
gacaacatcccacatctttcaacag

SEQ ID NO: 664035 - DNA, 25 bp, Homo sapien
tttcaacagcctctaaattcatcag

SEQ ID NO: 664036 - DNA, 25 bp, Homo sapien
aaattcatcagcaggaggccacacc

SEQ ID NO: 664037 - DNA, 25 bp, Homo sapien
ggaggccacaccaggtacacaggat

SEQ ID NO: 664038 - DNA, 25 bp, Homo sapien
ggtacacaggatgagcaaagccaga

SEQ ID NO: 664039 - DNA, 25 bp, Homo sapien
gcaaagccagagacttacactcaga

SEQ ID NO: 664040 - DNA, 25 bp, Homo sapien
gaactgtgaccacattttcttcttg

SEQ ID NO: 664041 - DNA, 25 bp, Homo sapien
ggagaaacaaccctgataagaactt

SEQ ID NO: 664042 - DNA, 25 bp, Homo sapien
aaacaatgattttcactttgtctta

SEQ ID NO: 664043 - DNA, 25 bp, Homo sapien
ttatctttcttataggttggtggcc

SEQ ID NO: 664044 - DNA, 25 bp, Homo sapien
gaattcttaaccagacccatttagg

SEQ ID NO: 664045 - DNA, 25 bp, Homo sapien
attcttaaccagacccatttaggat

SEQ ID NO: 664046 - DNA, 25 bp, Homo sapien
ttcttaaccagacccatttaggatt

SEQ ID NO: 664047 - DNA, 25 bp, Homo sapien
taaccagacccatttaggattaagt

SEQ ID NO: 664048 - DNA, 25 bp, Homo sapien
ccagacccatttaggattaagtaag

SEQ ID NO: 664049 - DNA, 25 bp, Homo sapien
cagacccatttaggattaagtaagt

SEQ ID NO: 664050 - DNA, 25 bp, Homo sapien
aaaagtaccaaaatgagccaagcat

SEQ ID NO: 664051 - DNA, 25 bp, Homo sapien
aaagtaccaaaatgagccaagcatg

SEQ ID NO: 664052 - DNA, 25 bp, Homo sapien
aagtaccaaaatgagccaagcatgg

SEQ ID NO: 664053 - DNA, 25 bp, Homo sapien
agtaccaaaatgagccaagcatggt

SEQ ID NO: 664054 - DNA, 25 bp, Homo sapien
gtaccaaaatgagccaagcatggtg

SEQ ID NO: 664055 - DNA, 25 bp, Homo sapien
tctggactaataacttctctacatc

SEQ ID NO: 664056 - DNA, 25 bp, Homo sapien
ctctacatccccttcatggattaga

SEQ ID NO: 664057 - DNA, 25 bp, Homo sapien
gtattggttttcagcaacagggaca

SEQ ID NO: 664058 - DNA, 25 bp, Homo sapien
gcaacagggacaacactgtagagga

SEQ ID NO: 664059 - DNA, 25 bp, Homo sapien
ggaattaccagctggaaaccgactt

SEQ ID NO: 664060 - DNA, 25 bp, Homo sapien
gctggaaaccgacttattcatgtta

SEQ ID NO: 664061 - DNA, 25 bp, Homo sapien
aaccgacttattcatgttaatgtag

SEQ ID NO: 664062 - DNA, 25 bp, Homo sapien
tatataacaaggcatcaggctttcc

SEQ ID NO: 664063 - DNA, 25 bp, Homo sapien
caggctttccttggcctgaaccatg

SEQ ID NO: 664064 - DNA, 25 bp, Homo sapien
tattctgtaagtgccaagttctttg

SEQ ID NO: 664065 - DNA, 25 bp, Homo sapien
gtaatcttcatgtcaagtttgtaaa

SEQ ID NO: 664066 - DNA, 25 bp, Homo sapien
ttctgaagttctggaaagaagtact

SEQ ID NO: 664067 - DNA, 25 bp, Homo sapien
gaagttctggaaagaagtactggat

SEQ ID NO: 664068 - DNA, 25 bp, Homo sapien
acaacgtcccaaagaaaggcagagt

SEQ ID NO: 664069 - DNA, 25 bp, Homo sapien
acgtcccaaagaaaggcagagtcca

SEQ ID NO: 664070 - DNA, 25 bp, Homo sapien
cccaaagaaaggcagagtccaggta

SEQ ID NO: 664071 - DNA, 25 bp, Homo sapien
ccaagccctggatgagcactggagg

SEQ ID NO: 664072 - DNA, 25 bp, Homo sapien
catggaaagcccctacgtttgtgga

SEQ ID NO: 664073 - DNA, 25 bp, Homo sapien
tggaaagcccctacgtttgtggaat

SEQ ID NO: 664074 - DNA, 25 bp, Homo sapien
ggaaagcccctacgtttgtggaatg

SEQ ID NO: 664075 - DNA, 25 bp, Homo sapien
gaaagcccctacgtttgtggaatga

SEQ ID NO: 664076 - DNA, 25 bp, Homo sapien
aagcccctacgtttgtggaatgaat

SEQ ID NO: 664077 - DNA, 25 bp, Homo sapien
tgagctactgcacatacctcaaggc

SEQ ID NO: 664078 - DNA, 25 bp, Homo sapien
tgcaccaaattacactgaatctagg

SEQ ID NO: 664079 - DNA, 25 bp, Homo sapien
ggcagtggcggtatgaaaaaccatt

SEQ ID NO: 664080 - DNA, 25 bp, Homo sapien
aaaccattgaacagttttctcgatg

SEQ ID NO: 664081 - DNA, 25 bp, Homo sapien
gaacagttttctcgatggcctgact

SEQ ID NO: 664082 - DNA, 25 bp, Homo sapien
tggcctgactcccttataaaccaga

SEQ ID NO: 664083 - DNA, 25 bp, Homo sapien
ataaaccagagccttcagacccctt

SEQ ID NO: 664084 - DNA, 25 bp, Homo sapien
ttcagaccccttacaaaggcttaat

SEQ ID NO: 664085 - DNA, 25 bp, Homo sapien
ttacaaaggcttaatgggcacattt

SEQ ID NO: 664086 - DNA, 25 bp, Homo sapien
gcttggaagtgagttaagcgttttt

SEQ ID NO: 664087 - DNA, 25 bp, Homo sapien
ttccctaagaaaatcgcaggcttct

SEQ ID NO: 664088 - DNA, 25 bp, Homo sapien
aatacatgctgttccttaaaattac

SEQ ID NO: 664089 - DNA, 25 bp, Homo sapien
taaaattacatagcacacccacgga

SEQ ID NO: 664090 - DNA, 25 bp, Homo sapien
attacatagcacacccacggaattg

SEQ ID NO: 664091 - DNA, 25 bp, Homo sapien
catagcacacccacggaattgtctt

SEQ ID NO: 664092 - DNA, 25 bp, Homo sapien
cacggaattgtcttgcctttggcta

SEQ ID NO: 664093 - DNA, 25 bp, Homo sapien
aattgtcttgcctttggctatttca

SEQ ID NO: 664094 - DNA, 25 bp, Homo sapien
catgattttctctcttccttgtatt

SEQ ID NO: 664095 - DNA, 25 bp, Homo sapien
gattttctctcttccttgtattttc

SEQ ID NO: 664096 - DNA, 25 bp, Homo sapien
tctaatttccaaaaacttcatatat

SEQ ID NO: 664097 - DNA, 25 bp, Homo sapien
agctgtcagtgtttactgaagtgca

SEQ ID NO: 664098 - DNA, 25 bp, Homo sapien
cagtgtttactgaagtgcaaaataa

SEQ ID NO: 664099 - DNA, 25 bp, Homo sapien
gggcccattttgaggtggctgtgag

SEQ ID NO: 664100 - DNA, 25 bp, Homo sapien
gtgagtgtacttggggttccttcaa

SEQ ID NO: 664101 - DNA, 25 bp, Homo sapien
aggcccagcaggtcacctgcagaag

SEQ ID NO: 664102 - DNA, 25 bp, Homo sapien
agcaggtcacctgcagaaggccttg

SEQ ID NO: 664103 - DNA, 25 bp, Homo sapien
gtcacctgcagaaggccttgggcag

SEQ ID NO: 664104 - DNA, 25 bp, Homo sapien
agaggaccaggcccaggcaaggctg

SEQ ID NO: 664105 - DNA, 25 bp, Homo sapien
aaggctgggaatgcttagccgacct

SEQ ID NO: 664106 - DNA, 25 bp, Homo sapien
tgggaatgcttagccgacctgctca

SEQ ID NO: 664107 - DNA, 25 bp, Homo sapien
gacctgctcagcatgaagctcctgc

SEQ ID NO: 664108 - DNA, 25 bp, Homo sapien
agaggctgaggtgcccagggtgtca

SEQ ID NO: 664109 - DNA, 25 bp, Homo sapien
tgtcaggacggccaccctgaaggcc

SEQ ID NO: 664110 - DNA, 25 bp, Homo sapien
ctgtcagtgccgtggactggagtgc

SEQ ID NO: 664111 - DNA, 25 bp, Homo sapien
actggagtgcgaacttgtgttgcct

SEQ ID NO: 664112 - DNA, 25 bp, Homo sapien
agtgcgaacttgtgttgccttttct

SEQ ID NO: 664113 - DNA, 25 bp, Homo sapien
atggaccagtcagcatgaacttccc

SEQ ID NO: 664114 - DNA, 25 bp, Homo sapien
ccagagctgagcagacgtcggatga

SEQ ID NO: 664115 - DNA, 25 bp, Homo sapien
agcagacgtcggatgaccagctgta

SEQ ID NO: 664116 - DNA, 25 bp, Homo sapien
ggatgaccagctgtagtgaggaact

SEQ ID NO: 664117 - DNA, 25 bp, Homo sapien
agctgtagtgaggaactgccctctc

SEQ ID NO: 664118 - DNA, 25 bp, Homo sapien
tagtgaggaactgccctctccaggg

SEQ ID NO: 664119 - DNA, 25 bp, Homo sapien
gcctcctctgagctattgtcactca

SEQ ID NO: 664120 - DNA, 25 bp, Homo sapien
tcctctgagctattgtcactcaata

SEQ ID NO: 664121 - DNA, 25 bp, Homo sapien
gccactgcggccttagagagagctg

SEQ ID NO: 664122 - DNA, 25 bp, Homo sapien
aatgggacttctcacgtgctctcca

SEQ ID NO: 664123 - DNA, 25 bp, Homo sapien
tgctctccacagtggaaccacaggt

SEQ ID NO: 664124 - DNA, 25 bp, Homo sapien
agcagctgaatggagcctctaccct

SEQ ID NO: 664125 - DNA, 25 bp, Homo sapien
ctctggatgcctttcttgtcactta

SEQ ID NO: 664126 - DNA, 25 bp, Homo sapien
ctcattctggtactttatctgctgg

SEQ ID NO: 664127 - DNA, 25 bp, Homo sapien
atgtattactaatgtccttccaaac

SEQ ID NO: 664128 - DNA, 25 bp, Homo sapien
taatgtccttccaaacagactccac

SEQ ID NO: 664129 - DNA, 25 bp, Homo sapien
acagactccacatgggaattttcat

SEQ ID NO: 664130 - DNA, 25 bp, Homo sapien
ggaattttcatgatatcttggctat

SEQ ID NO: 664131 - DNA, 25 bp, Homo sapien
aagattagcttgcaggaaacacaaa

SEQ ID NO: 664132 - DNA, 25 bp, Homo sapien
tatgtgttttcagcggcttctcact

SEQ ID NO: 664133 - DNA, 25 bp, Homo sapien
ttcttttggcccatcaaggaaacca

SEQ ID NO: 664134 - DNA, 25 bp, Homo sapien
ggaaaccaacacatccgaggagagt

SEQ ID NO: 664135 - DNA, 25 bp, Homo sapien
gataggctgctcttagccgggacca

SEQ ID NO: 664136 - DNA, 25 bp, Homo sapien
ccgggaccacacttgtgctttgaaa

SEQ ID NO: 664137 - DNA, 25 bp, Homo sapien
aaaatccctgcaggcaattgaagga

SEQ ID NO: 664138 - DNA, 25 bp, Homo sapien
cgagaacatcctcccagggagcaga

SEQ ID NO: 664139 - DNA, 25 bp, Homo sapien
agggagcagatacccattctgtaga

SEQ ID NO: 664140 - DNA, 25 bp, Homo sapien
gtagaagctctaagcctgctgggct

SEQ ID NO: 664141 - DNA, 25 bp, Homo sapien
ggtaggaccaccatgttgcatgact

SEQ ID NO: 664142 - DNA, 25 bp, Homo sapien
tgcatgacttttctgtgtgccccgt

SEQ ID NO: 664143 - DNA, 25 bp, Homo sapien
cagccgtttggcctggctaaaattg

SEQ ID NO: 664144 - DNA, 25 bp, Homo sapien
tttggcctggctaaaattgggtaat

SEQ ID NO: 664145 - DNA, 25 bp, Homo sapien
gtggatattgaagctctaactgcct

SEQ ID NO: 664146 - DNA, 25 bp, Homo sapien
gatattgaagctctaactgcctgga

SEQ ID NO: 664147 - DNA, 25 bp, Homo sapien
attgaagctctaactgcctggactt

SEQ ID NO: 664148 - DNA, 25 bp, Homo sapien
gaagctctaactgcctggacttctt

SEQ ID NO: 664149 - DNA, 25 bp, Homo sapien
ttcttgggaaaaacagaaggcacca

SEQ ID NO: 664150 - DNA, 25 bp, Homo sapien
aacagaaggcaccagaaatcccttt

SEQ ID NO: 664151 - DNA, 25 bp, Homo sapien
agaaggcaccagaaatccctttctg

SEQ ID NO: 664152 - DNA, 25 bp, Homo sapien
tctggccctcttcttccaagggctc

SEQ ID NO: 664153 - DNA, 25 bp, Homo sapien
aagccaataaccagttaagaaacat

SEQ ID NO: 664154 - DNA, 25 bp, Homo sapien
acatttttcatttatcagtctggca

SEQ ID NO: 664155 - DNA, 25 bp, Homo sapien
gtctggcaaagaggttcaaaatttt

SEQ ID NO: 664156 - DNA, 25 bp, Homo sapien
caaaattttttaacagccagtggtg

SEQ ID NO: 664157 - DNA, 25 bp, Homo sapien
gaaaggcgcaggtgagccttctcac

SEQ ID NO: 664158 - DNA, 25 bp, Homo sapien
ttaaacgctttaactcacacacacc

SEQ ID NO: 664159 - DNA, 25 bp, Homo sapien
acacacacccattgttcgtttttgg

SEQ ID NO: 664160 - DNA, 25 bp, Homo sapien
cattgttcgtttttggaattatcca

SEQ ID NO: 664161 - DNA, 25 bp, Homo sapien
gtggatccatgcaaagacagcaatt

SEQ ID NO: 664162 - DNA, 25 bp, Homo sapien
gacagcaatttcaagaggctcatca

SEQ ID NO: 664163 - DNA, 25 bp, Homo sapien
tcaagaggctcatcacagggttatt

SEQ ID NO: 664164 - DNA, 25 bp, Homo sapien
cagtccaacaataggatgctggtta

SEQ ID NO: 664165 - DNA, 25 bp, Homo sapien
aaattggttggactcaatatggcca

SEQ ID NO: 664166 - DNA, 25 bp, Homo sapien
gagcttgctgacattgcaacctgaa

SEQ ID NO: 664167 - DNA, 25 bp, Homo sapien
gtgcatgtttcataacagctccctc

SEQ ID NO: 664168 - DNA, 25 bp, Homo sapien
gtacatgtgatccatgcgatagaat

SEQ ID NO: 664169 - DNA, 25 bp, Homo sapien
agttaactgtatgcccagggacttt

SEQ ID NO: 664170 - DNA, 25 bp, Homo sapien
cagggactttctagaccttctcttt

SEQ ID NO: 664171 - DNA, 25 bp, Homo sapien
tttccttccaccaattatttgatca

SEQ ID NO: 664172 - DNA, 25 bp, Homo sapien
ttatttgatcatctcagaatccacc

SEQ ID NO: 664173 - DNA, 25 bp, Homo sapien
gaatccacctcctgaaactttttgt

SEQ ID NO: 664174 - DNA, 25 bp, Homo sapien
aatactgctttgaagccagcatggg

SEQ ID NO: 664175 - DNA, 25 bp, Homo sapien
aaaacttgagtttgacatgcctgtc

SEQ ID NO: 664176 - DNA, 25 bp, Homo sapien
acagagcgagactaccttccacaaa

SEQ ID NO: 664177 - DNA, 25 bp, Homo sapien
agagcgagactaccttccacaaaaa

SEQ ID NO: 664178 - DNA, 25 bp, Homo sapien
aaagcaaaaggaatcggtcactggt

SEQ ID NO: 664179 - DNA, 25 bp, Homo sapien
ggaatcggtcactggtgagccacat

SEQ ID NO: 664180 - DNA, 25 bp, Homo sapien
ggtcactggtgagccacatttctaa

SEQ ID NO: 664181 - DNA, 25 bp, Homo sapien
ctggtgagccacatttctaagacag

SEQ ID NO: 664182 - DNA, 25 bp, Homo sapien
aagacagtctttaggctacaggaac

SEQ ID NO: 664183 - DNA, 25 bp, Homo sapien
taggctacaggaacgtgacgcccga

SEQ ID NO: 664184 - DNA, 25 bp, Homo sapien
tacaggaacgtgacgcccgaggaca

SEQ ID NO: 664185 - DNA, 25 bp, Homo sapien
gtgacgcccgaggacagccagaatc

SEQ ID NO: 664186 - DNA, 25 bp, Homo sapien
cgtaaacaaggcagaaagggtggat

SEQ ID NO: 664187 - DNA, 25 bp, Homo sapien
acaacgcagagcacgcggggtatta

SEQ ID NO: 664188 - DNA, 25 bp, Homo sapien
caacgcagagcacgcggggtattag

SEQ ID NO: 664189 - DNA, 25 bp, Homo sapien
aacgcagagcacgcggggtattagt

SEQ ID NO: 664190 - DNA, 25 bp, Homo sapien
acgcagagcacgcggggtattagta

SEQ ID NO: 664191 - DNA, 25 bp, Homo sapien
cgcagagcacgcggggtattagtag

SEQ ID NO: 664192 - DNA, 25 bp, Homo sapien
gcagagcacgcggggtattagtagc

SEQ ID NO: 664193 - DNA, 25 bp, Homo sapien
cagagcacgcggggtattagtagcc

SEQ ID NO: 664194 - DNA, 25 bp, Homo sapien
agagcacgcggggtattagtagcct

SEQ ID NO: 664195 - DNA, 25 bp, Homo sapien
gagcacgcggggtattagtagcctt

SEQ ID NO: 664196 - DNA, 25 bp, Homo sapien
agcacgcggggtattagtagccttt

SEQ ID NO: 664197 - DNA, 25 bp, Homo sapien
tcaccagtgaaaagagcctcccagg

SEQ ID NO: 664198 - DNA, 25 bp, Homo sapien
caggctatcttactgctggtgagtt

SEQ ID NO: 664199 - DNA, 25 bp, Homo sapien
gctggtgagttttgtcttcacatac

SEQ ID NO: 664200 - DNA, 25 bp, Homo sapien
atactgggtggactttacgttctca

SEQ ID NO: 664201 - DNA, 25 bp, Homo sapien
ggactttacgttctcattttcagga

SEQ ID NO: 664202 - DNA, 25 bp, Homo sapien
aatgattctctgctagtgtggctcc

SEQ ID NO: 664203 - DNA, 25 bp, Homo sapien
agtgtggctccaggttattgtggcc

SEQ ID NO: 664204 - DNA, 25 bp, Homo sapien
gtggccaatagctatgccgcaatta

SEQ ID NO: 664205 - DNA, 25 bp, Homo sapien
gctatgccgcaattagtcctttgat

SEQ ID NO: 664206 - DNA, 25 bp, Homo sapien
gtcctttgatgctaatttatgctga

SEQ ID NO: 664207 - DNA, 25 bp, Homo sapien
tcaagactctgcaaatgttatggtt

SEQ ID NO: 664208 - DNA, 25 bp, Homo sapien
gttgccactcacctgaggatgtggg

SEQ ID NO: 664209 - DNA, 25 bp, Homo sapien
gatgtggggtcttgccatttgccca

SEQ ID NO: 664210 - DNA, 25 bp, Homo sapien
tgagccactacacacagcccggagt

SEQ ID NO: 664211 - DNA, 25 bp, Homo sapien
atgcttcatttaagtgtatgtctct

SEQ ID NO: 664212 - DNA, 25 bp, Homo sapien
gcttcatttaagtgtatgtctctaa

SEQ ID NO: 664213 - DNA, 25 bp, Homo sapien
ttcatttaagtgtatgtctctaaga

SEQ ID NO: 664214 - DNA, 25 bp, Homo sapien
aaaacgagtggcagtagccctgaaa

SEQ ID NO: 664215 - DNA, 25 bp, Homo sapien
aaacgagtggcagtagccctgaaac

SEQ ID NO: 664216 - DNA, 25 bp, Homo sapien
aacgagtggcagtagccctgaaaca

SEQ ID NO: 664217 - DNA, 25 bp, Homo sapien
acgagtggcagtagccctgaaacag

SEQ ID NO: 664218 - DNA, 25 bp, Homo sapien
cgagtggcagtagccctgaaacagc

SEQ ID NO: 664219 - DNA, 25 bp, Homo sapien
tgaagatgcccaaaccacagactga

SEQ ID NO: 664220 - DNA, 25 bp, Homo sapien
accacagactgacttgtaggctaga

SEQ ID NO: 664221 - DNA, 25 bp, Homo sapien
gagccaccctttctacatgatacgg

SEQ ID NO: 664222 - DNA, 25 bp, Homo sapien
atgatacggcgcacattcttgagac

SEQ ID NO: 664223 - DNA, 25 bp, Homo sapien
ggcgcacattcttgagacctgaagt

SEQ ID NO: 664224 - DNA, 25 bp, Homo sapien
gttacctaccaattaggctagcgat

SEQ ID NO: 664225 - DNA, 25 bp, Homo sapien
aggctagcgatttctctgtctttta

SEQ ID NO: 664226 - DNA, 25 bp, Homo sapien
atgtttcatctttctagaattcatt

SEQ ID NO: 664227 - DNA, 25 bp, Homo sapien
atttttcacatcttcattcactggg

SEQ ID NO: 664228 - DNA, 25 bp, Homo sapien
acatcttcattcactgggattctgg

SEQ ID NO: 664229 - DNA, 25 bp, Homo sapien
actgggattctggaccataatatat

SEQ ID NO: 664230 - DNA, 25 bp, Homo sapien
acaaagtcacactattaccactgcc

SEQ ID NO: 664231 - DNA, 25 bp, Homo sapien
aaccaacctataacgcagtcacact

SEQ ID NO: 664232 - DNA, 25 bp, Homo sapien
gtcacactattactcactgctacac

SEQ ID NO: 664233 - DNA, 25 bp, Homo sapien
ctgctacacactcgacctataagaa

SEQ ID NO: 664234 - DNA, 25 bp, Homo sapien
atggtattaccgctgcatatccgac

SEQ ID NO: 664235 - DNA, 25 bp, Homo sapien
gacaaagtcaccctattactcactg

SEQ ID NO: 664236 - DNA, 25 bp, Homo sapien
gctgcatactcaatcccagatttac

SEQ ID NO: 664237 - DNA, 25 bp, Homo sapien
acaatcggaagcctctgctggtgaa

SEQ ID NO: 664238 - DNA, 25 bp, Homo sapien
ggaagtcaatactgaatgtcccttt

SEQ ID NO: 664239 - DNA, 25 bp, Homo sapien
gaatgtccctttctttgccataaaa

SEQ ID NO: 664240 - DNA, 25 bp, Homo sapien
ctttgccataaaactgccatcacac

SEQ ID NO: 664241 - DNA, 25 bp, Homo sapien
aaatggcagtaagagctatagagaa

SEQ ID NO: 664242 - DNA, 25 bp, Homo sapien
tgggcaggaaaggtctcactaagaa

SEQ ID NO: 664243 - DNA, 25 bp, Homo sapien
aggtctcactaagaacagtttaagc

SEQ ID NO: 664244 - DNA, 25 bp, Homo sapien
aacagtttaagcaaagacctggaag

SEQ ID NO: 664245 - DNA, 25 bp, Homo sapien
aagaagccaggcagcgagccccgag

SEQ ID NO: 664246 - DNA, 25 bp, Homo sapien
gaagagcatggcaggcagagataca

SEQ ID NO: 664247 - DNA, 25 bp, Homo sapien
caggcagagatacagcaagggcaaa

SEQ ID NO: 664248 - DNA, 25 bp, Homo sapien
aggccttgaggcctgccttggtcaa

SEQ ID NO: 664249 - DNA, 25 bp, Homo sapien
cttgaggcctgccttggtcaaggaa

SEQ ID NO: 664250 - DNA, 25 bp, Homo sapien
aggcctgccttggtcaaggaaaaat

SEQ ID NO: 664251 - DNA, 25 bp, Homo sapien
ggaaaaataaagaggcctgagcaga

SEQ ID NO: 664252 - DNA, 25 bp, Homo sapien
gaagttgctggttgggatttctctg

SEQ ID NO: 664253 - DNA, 25 bp, Homo sapien
aagttgctggttgggatttctctgt

SEQ ID NO: 664254 - DNA, 25 bp, Homo sapien
gttgctggttgggatttctctgttc

SEQ ID NO: 664255 - DNA, 25 bp, Homo sapien
tgctggttgggatttctctgttctt

SEQ ID NO: 664256 - DNA, 25 bp, Homo sapien
gctggttgggatttctctgttcttt

SEQ ID NO: 664257 - DNA, 25 bp, Homo sapien
gggacacctcagttaaagcaagatc

SEQ ID NO: 664258 - DNA, 25 bp, Homo sapien
ggacacctcagttaaagcaagatca

SEQ ID NO: 664259 - DNA, 25 bp, Homo sapien
gacacctcagttaaagcaagatcag

SEQ ID NO: 664260 - DNA, 25 bp, Homo sapien
acctcagttaaagcaagatcagtct

SEQ ID NO: 664261 - DNA, 25 bp, Homo sapien
agttaaagcaagatcagtctgttgg

SEQ ID NO: 664262 - DNA, 25 bp, Homo sapien
gatcagtctgttggccgagagtggt

SEQ ID NO: 664263 - DNA, 25 bp, Homo sapien
accagatgcttccatcatcagtact

SEQ ID NO: 664264 - DNA, 25 bp, Homo sapien
catcatcagtactccttgtttttct

SEQ ID NO: 664265 - DNA, 25 bp, Homo sapien
gtttttctgttatctcctttgaggt

SEQ ID NO: 664266 - DNA, 25 bp, Homo sapien
atctcctttgaggtagctaaaaatg

SEQ ID NO: 664267 - DNA, 25 bp, Homo sapien
agaagatagggtcaacttcttcagt

SEQ ID NO: 664268 - DNA, 25 bp, Homo sapien
gggcagtgacaccatgccaaacact

SEQ ID NO: 664269 - DNA, 25 bp, Homo sapien
cactgttaaattcatgccattaaaa

SEQ ID NO: 664270 - DNA, 25 bp, Homo sapien
aacagtggagtgttctgcaaagccc

SEQ ID NO: 664271 - DNA, 25 bp, Homo sapien
ggagtgttctgcaaagcccgattct

SEQ ID NO: 664272 - DNA, 25 bp, Homo sapien
tgcaaagcccgattctctgcagctt

SEQ ID NO: 664273 - DNA, 25 bp, Homo sapien
tctgcagctttaagactggacagta

SEQ ID NO: 664274 - DNA, 25 bp, Homo sapien
tctacggagagaaagatgccagaca

SEQ ID NO: 664275 - DNA, 25 bp, Homo sapien
tgccagacacaaaagcccacatgct

SEQ ID NO: 664276 - DNA, 25 bp, Homo sapien
gtagattggtggatacctagggcat

SEQ ID NO: 664277 - DNA, 25 bp, Homo sapien
gtggagaataactgccaacagattt

SEQ ID NO: 664278 - DNA, 25 bp, Homo sapien
aataactgccaacagatttgtggtt

SEQ ID NO: 664279 - DNA, 25 bp, Homo sapien
aatgttctggaattacaccgtggcg

SEQ ID NO: 664280 - DNA, 25 bp, Homo sapien
tgttctggaattacaccgtggcgat

SEQ ID NO: 664281 - DNA, 25 bp, Homo sapien
gaattacaccgtggcgatgcatgta

SEQ ID NO: 664282 - DNA, 25 bp, Homo sapien
ccgtggcgatgcatgtacagcatag

SEQ ID NO: 664283 - DNA, 25 bp, Homo sapien
gcatgtacagcatagtgaatatact

SEQ ID NO: 664284 - DNA, 25 bp, Homo sapien
actaaagccactgaagtataaactt

SEQ ID NO: 664285 - DNA, 25 bp, Homo sapien
tttcaggtgcctcatagtaacttca

SEQ ID NO: 664286 - DNA, 25 bp, Homo sapien
ggttgttgtaactagctgactctaa

SEQ ID NO: 664287 - DNA, 25 bp, Homo sapien
gctgactctaattgtatagcaaagt

SEQ ID NO: 664288 - DNA, 25 bp, Homo sapien
gcttagatgattaccacttgctcct

SEQ ID NO: 664289 - DNA, 25 bp, Homo sapien
taccacttgctcctcaattctgtat

SEQ ID NO: 664290 - DNA, 25 bp, Homo sapien
tgctcctcaattctgtatgcttggc

SEQ ID NO: 664291 - DNA, 25 bp, Homo sapien
gcttggcattgtggtaagcactaaa

SEQ ID NO: 664292 - DNA, 25 bp, Homo sapien
gaaaatacatggactccgtccttga

SEQ ID NO: 664293 - DNA, 25 bp, Homo sapien
gactccgtccttgaggaggatctca

SEQ ID NO: 664294 - DNA, 25 bp, Homo sapien
gtccttgaggaggatctcatggtta

SEQ ID NO: 664295 - DNA, 25 bp, Homo sapien
atcatgtgcactattatactttcca

SEQ ID NO: 664296 - DNA, 25 bp, Homo sapien
agttaacaatgaacacatctgccat

SEQ ID NO: 664297 - DNA, 25 bp, Homo sapien
gaacacatctgccattgttctgaag

SEQ ID NO: 664298 - DNA, 25 bp, Homo sapien
cattgttctgaagggagacgctacc

SEQ ID NO: 664299 - DNA, 25 bp, Homo sapien
tgaagggagacgctaccccaatctt

SEQ ID NO: 664300 - DNA, 25 bp, Homo sapien
tcttccacacctgttcactatataa

SEQ ID NO: 664301 - DNA, 25 bp, Homo sapien
taggtggagaatgcctctgctcaca

SEQ ID NO: 664302 - DNA, 25 bp, Homo sapien
agatgtgcagaaacgtgagaggctc

SEQ ID NO: 664303 - DNA, 25 bp, Homo sapien
aaacgtgagaggctcatggagaact

SEQ ID NO: 664304 - DNA, 25 bp, Homo sapien
tggagaactgtttccctacaatgac

SEQ ID NO: 664305 - DNA, 25 bp, Homo sapien
gtttccctacaatgacaaaatgctg

SEQ ID NO: 664306 - DNA, 25 bp, Homo sapien
aatgctgacgatatattgttatgta

SEQ ID NO: 664307 - DNA, 25 bp, Homo sapien
ctcaccaccctgtgagaaaggtgcc

SEQ ID NO: 664308 - DNA, 25 bp, Homo sapien
tcaccaccctgtgagaaaggtgcct

SEQ ID NO: 664309 - DNA, 25 bp, Homo sapien
caccaccctgtgagaaaggtgcctt

SEQ ID NO: 664310 - DNA, 25 bp, Homo sapien
ccttcacgtgaactgcctccatgat

SEQ ID NO: 664311 - DNA, 25 bp, Homo sapien
cttcacgtgaactgcctccatgatt

SEQ ID NO: 664312 - DNA, 25 bp, Homo sapien
ttcacgtgaactgcctccatgattg

SEQ ID NO: 664313 - DNA, 25 bp, Homo sapien
cacgtgaactgcctccatgattgta

SEQ ID NO: 664314 - DNA, 25 bp, Homo sapien
acgtgaactgcctccatgattgtaa

SEQ ID NO: 664315 - DNA, 25 bp, Homo sapien
ccccagctataaggaactgtgagcc

SEQ ID NO: 664316 - DNA, 25 bp, Homo sapien
cccagctataaggaactgtgagcca

SEQ ID NO: 664317 - DNA, 25 bp, Homo sapien
ccagctataaggaactgtgagccaa

SEQ ID NO: 664318 - DNA, 25 bp, Homo sapien
cctttttatagtcttctacacagtt

SEQ ID NO: 664319 - DNA, 25 bp, Homo sapien
atagtcttctacacagttctcttaa

SEQ ID NO: 664320 - DNA, 25 bp, Homo sapien
tctacacagttctcttaaaaggcta

SEQ ID NO: 664321 - DNA, 25 bp, Homo sapien
taaaaggctactaataccccgcgtg

SEQ ID NO: 664322 - DNA, 25 bp, Homo sapien
ataccccgcgtgctctgcgttgtta

SEQ ID NO: 664323 - DNA, 25 bp, Homo sapien
tgctctgcgttgttaccactgctta

SEQ ID NO: 664324 - DNA, 25 bp, Homo sapien
actgcttacgcgtactctgcgttgt

SEQ ID NO: 664325 - DNA, 25 bp, Homo sapien
tactctgcgttgttaccactgctta

SEQ ID NO: 664326 - DNA, 25 bp, Homo sapien
gttaccactgcttacgcgtactctg

SEQ ID NO: 664327 - DNA, 25 bp, Homo sapien
gtgagtatgtcaaaagatcagttat

SEQ ID NO: 664328 - DNA, 25 bp, Homo sapien
agatcagttataaagccctttttat

SEQ ID NO: 664329 - DNA, 25 bp, Homo sapien
gtcaaagggctaaaactatagtaat

SEQ ID NO: 664330 - DNA, 25 bp, Homo sapien
gagtacattcttaatgagtttttct

SEQ ID NO: 664331 - DNA, 25 bp, Homo sapien
tgagtttttctttaactaccacaat

SEQ ID NO: 664332 - DNA, 25 bp, Homo sapien
gtctcatcttatgttctaaaattgt

SEQ ID NO: 664333 - DNA, 25 bp, Homo sapien
gttctaaaattgtcacagcaaagtg

SEQ ID NO: 664334 - DNA, 25 bp, Homo sapien
aattgtcacagcaaagtgatcaagg

SEQ ID NO: 664335 - DNA, 25 bp, Homo sapien
agtgatcaaggaagctagagatttt

SEQ ID NO: 664336 - DNA, 25 bp, Homo sapien
ggaagctagagattttacatatgtt

SEQ ID NO: 664337 - DNA, 25 bp, Homo sapien
tacatatgttcttctcaataagatg

SEQ ID NO: 664338 - DNA, 25 bp, Homo sapien
tgtatctcttctatatcaagtaaat

SEQ ID NO: 664339 - DNA, 25 bp, Homo sapien
aataaatccttgatacatgaacgaa

SEQ ID NO: 664340 - DNA, 25 bp, Homo sapien
ggttctaatagttaactctgaaact

SEQ ID NO: 664341 - DNA, 25 bp, Homo sapien
aatagttaactctgaaactggaagc

SEQ ID NO: 664342 - DNA, 25 bp, Homo sapien
agccagtgacaaggagttgaaacta

SEQ ID NO: 664343 - DNA, 25 bp, Homo sapien
aactaaagaagacaggagacctccg

SEQ ID NO: 664344 - DNA, 25 bp, Homo sapien
gagacctccgtaaatgtccttccag

SEQ ID NO: 664345 - DNA, 25 bp, Homo sapien
atgtccttccagcatagacctgagg

SEQ ID NO: 664346 - DNA, 25 bp, Homo sapien
cttccagcatagacctgaggttctg

SEQ ID NO: 664347 - DNA, 25 bp, Homo sapien
tagacctgaggttctgagcaactgt

SEQ ID NO: 664348 - DNA, 25 bp, Homo sapien
ctgaggttctgagcaactgtgggta

SEQ ID NO: 664349 - DNA, 25 bp, Homo sapien
gttctgagcaactgtgggtaacgca

SEQ ID NO: 664350 - DNA, 25 bp, Homo sapien
gtgggtaacgcacaaaccattatta

SEQ ID NO: 664351 - DNA, 25 bp, Homo sapien
attttgtctgtgttatgtagaatgc

SEQ ID NO: 664352 - DNA, 25 bp, Homo sapien
agaatgcagattccctacgtttttc

SEQ ID NO: 664353 - DNA, 25 bp, Homo sapien
tgccccgtttatgtcatcttatgta

SEQ ID NO: 664354 - DNA, 25 bp, Homo sapien
aaaacatgcagattcatggagccag

SEQ ID NO: 664355 - DNA, 25 bp, Homo sapien
aaaggcatgactatcttttcccacc

SEQ ID NO: 664356 - DNA, 25 bp, Homo sapien
aggcatgactatcttttcccaccca

SEQ ID NO: 664357 - DNA, 25 bp, Homo sapien
ccttacctgaaaattgtgtacttct

SEQ ID NO: 664358 - DNA, 25 bp, Homo sapien
tgtgtacttctcaatatcctgccct

SEQ ID NO: 664359 - DNA, 25 bp, Homo sapien
gaaagatgtctgtctcctgggtgcg

SEQ ID NO: 664360 - DNA, 25 bp, Homo sapien
aagatgtctgtctcctgggtgcgtg

SEQ ID NO: 664361 - DNA, 25 bp, Homo sapien
ctgggtgcgtgtccttaactttggc

SEQ ID NO: 664362 - DNA, 25 bp, Homo sapien
caatgcattgattccagatatcttt

SEQ ID NO: 664363 - DNA, 25 bp, Homo sapien
ttaaatgtgcttacctctgtgtgcg

SEQ ID NO: 664364 - DNA, 25 bp, Homo sapien
ttacctctgtgtgcgttgttacctg

SEQ ID NO: 664365 - DNA, 25 bp, Homo sapien
ttgttacctgttccctctttgaatc

SEQ ID NO: 664366 - DNA, 25 bp, Homo sapien
gaagcattgtccacaaggcatctcc

SEQ ID NO: 664367 - DNA, 25 bp, Homo sapien
aaggcatctcccactctagaggtct

SEQ ID NO: 664368 - DNA, 25 bp, Homo sapien
gttaatttattatcgcttgtctgtc

SEQ ID NO: 664369 - DNA, 25 bp, Homo sapien
ttatcgcttgtctgtcaaacaagga

SEQ ID NO: 664370 - DNA, 25 bp, Homo sapien
atttgccacacaacatgttttccta

SEQ ID NO: 664371 - DNA, 25 bp, Homo sapien
atgttttcctaaagcaatgtttttg

SEQ ID NO: 664372 - DNA, 25 bp, Homo sapien
gcaatgtttttgtacaatttcctga

SEQ ID NO: 664373 - DNA, 25 bp, Homo sapien
actgcttacgcgtactctgcgttgt

SEQ ID NO: 664374 - DNA, 25 bp, Homo sapien
tgcttacgcgtactctgcgttgtta

SEQ ID NO: 664375 - DNA, 25 bp, Homo sapien
ttacgcgtactctgcgttgttacca

SEQ ID NO: 664376 - DNA, 25 bp, Homo sapien
gcgtactctgcgttgttaccactgc

SEQ ID NO: 664377 - DNA, 25 bp, Homo sapien
tactctgcgttgttaccactgctta

SEQ ID NO: 664378 - DNA, 25 bp, Homo sapien
ctctgcgttgttaccactgcttacg

SEQ ID NO: 664379 - DNA, 25 bp, Homo sapien
gcgttgttaccactgcttacgcgta

SEQ ID NO: 664380 - DNA, 25 bp, Homo sapien
gttgttaccactgcttacgcgtact

SEQ ID NO: 664381 - DNA, 25 bp, Homo sapien
ttgttaccactgcttacgcgtactc

SEQ ID NO: 664382 - DNA, 25 bp, Homo sapien
gttaccactgcttacgcgtactctg

SEQ ID NO: 664383 - DNA, 25 bp, Homo sapien
taccactgcttacgcgtactctgcg

SEQ ID NO: 664384 - DNA, 25 bp, Homo sapien
agagagaggcctgaggtcctcagct

SEQ ID NO: 664385 - DNA, 25 bp, Homo sapien
tcagctaccatctctttggtgcagt

SEQ ID NO: 664386 - DNA, 25 bp, Homo sapien
atctctttggtgcagttccaggagc

SEQ ID NO: 664387 - DNA, 25 bp, Homo sapien
gttccaggagctatgcacaagtaat

SEQ ID NO: 664388 - DNA, 25 bp, Homo sapien
ggctttgtcttgtgtaaatcacacc

SEQ ID NO: 664389 - DNA, 25 bp, Homo sapien
gtgtaaatcacaccatctttcacag

SEQ ID NO: 664390 - DNA, 25 bp, Homo sapien
agaaagcatggaggcccagaacaag

SEQ ID NO: 664391 - DNA, 25 bp, Homo sapien
ggttcattgtttgggttagatttct

SEQ ID NO: 664392 - DNA, 25 bp, Homo sapien
tagatttctgtatacccatcttccc

SEQ ID NO: 664393 - DNA, 25 bp, Homo sapien
tcttcccacttgttgggaattggga

SEQ ID NO: 664394 - DNA, 25 bp, Homo sapien
aacactacttactatatgccaatca

SEQ ID NO: 664395 - DNA, 25 bp, Homo sapien
tttgagagccattgcctggttctgc

SEQ ID NO: 664396 - DNA, 25 bp, Homo sapien
attgcctggttctgccttgttcttt

SEQ ID NO: 664397 - DNA, 25 bp, Homo sapien
ttgttcttttctttgggtcacaagg

SEQ ID NO: 664398 - DNA, 25 bp, Homo sapien
ttgggtcacaaggacggcagcttcc

SEQ ID NO: 664399 - DNA, 25 bp, Homo sapien
ggcagcttcccaggtacaatctgct

SEQ ID NO: 664400 - DNA, 25 bp, Homo sapien
aggtacaatctgctctctcagtgtg

SEQ ID NO: 664401 - DNA, 25 bp, Homo sapien
gctctctcagtgtgcatcttgatat

SEQ ID NO: 664402 - DNA, 25 bp, Homo sapien
tgcgaccaatggcatttcaacctcc

SEQ ID NO: 664403 - DNA, 25 bp, Homo sapien
ttcaacctccctctacagtttgata

SEQ ID NO: 664404 - DNA, 25 bp, Homo sapien
tccctctacagtttgataccttctt

SEQ ID NO: 664405 - DNA, 25 bp, Homo sapien
ttgataccttcttctatagttacag

SEQ ID NO: 664406 - DNA, 25 bp, Homo sapien
acaacaatggcaactataccctcat

SEQ ID NO: 664407 - DNA, 25 bp, Homo sapien
caactataccctcattgccaaaaac

SEQ ID NO: 664408 - DNA, 25 bp, Homo sapien
ttgccaaaaacccactgggcacagc

SEQ ID NO: 664409 - DNA, 25 bp, Homo sapien
ggcacagccaaccagaccatcaatg

SEQ ID NO: 664410 - DNA, 25 bp, Homo sapien
catcaatggccacttcctcaaggag

SEQ ID NO: 664411 - DNA, 25 bp, Homo sapien
atggccacttcctcaaggagccctt

SEQ ID NO: 664412 - DNA, 25 bp, Homo sapien
tgacgaagtgagtcccacacctcct

SEQ ID NO: 664413 - DNA, 25 bp, Homo sapien
ggtatccatagcagttggacttgct

SEQ ID NO: 664414 - DNA, 25 bp, Homo sapien
gtggttctcttcgtcatgatcaaca

SEQ ID NO: 664415 - DNA, 25 bp, Homo sapien
gatcaacaaatatggtcgacggtcc

SEQ ID NO: 664416 - DNA, 25 bp, Homo sapien
tatggtcgacggtccaaatttggaa

SEQ ID NO: 664417 - DNA, 25 bp, Homo sapien
aactctgcagacagcctccttgagt

SEQ ID NO: 664418 - DNA, 25 bp, Homo sapien
tgcagacagcctccttgagttcaac

SEQ ID NO: 664419 - DNA, 25 bp, Homo sapien
acagcctccttgagttcaactccag

SEQ ID NO: 664420 - DNA, 25 bp, Homo sapien
aactccaggctctgacacttctttg

SEQ ID NO: 664421 - DNA, 25 bp, Homo sapien
tctttgctttggtgccttgggcaaa

SEQ ID NO: 664422 - DNA, 25 bp, Homo sapien
ttgctttggtgccttgggcaaagtc

SEQ ID NO: 664423 - DNA, 25 bp, Homo sapien
tgatttcctcatcagtacaatggga

SEQ ID NO: 664424 - DNA, 25 bp, Homo sapien
atgggaataactgtcattacgtcac

SEQ ID NO: 664425 - DNA, 25 bp, Homo sapien
tgtcattacgtcacagaatcacttg

SEQ ID NO: 664426 - DNA, 25 bp, Homo sapien
tttaatcctcatgaaagcccatagg

SEQ ID NO: 664427 - DNA, 25 bp, Homo sapien
gaaagcccataggaccaggcatagt

SEQ ID NO: 664428 - DNA, 25 bp, Homo sapien
atactagttgtattgacagtgcctc

SEQ ID NO: 664429 - DNA, 25 bp, Homo sapien
attgacagtgcctcactatataaag

SEQ ID NO: 664430 - DNA, 25 bp, Homo sapien
gtgcctcactatataaagacaattg

SEQ ID NO: 664431 - DNA, 25 bp, Homo sapien
aggctaaagggttgccacttgaaat

SEQ ID NO: 664432 - DNA, 25 bp, Homo sapien
aagttctttttccctgatgcaattt

SEQ ID NO: 664433 - DNA, 25 bp, Homo sapien
gatgcaatttcagtaatagtggcta

SEQ ID NO: 664434 - DNA, 25 bp, Homo sapien
gtggctattaacagcactagttggt

SEQ ID NO: 664435 - DNA, 25 bp, Homo sapien
gattgaaactggtcaaggtaaacct

SEQ ID NO: 664436 - DNA, 25 bp, Homo sapien
aaaatcctgaatagcacagggaagc

SEQ ID NO: 664437 - DNA, 25 bp, Homo sapien
gcacagggaagcagacaaaattctt

SEQ ID NO: 664438 - DNA, 25 bp, Homo sapien
caaaattcttcacaatcaaggctgt

SEQ ID NO: 664439 - DNA, 25 bp, Homo sapien
cgagattgaaaacctaactcaggag

SEQ ID NO: 664440 - DNA, 25 bp, Homo sapien
aggagtatgtacctgagcacctcac

SEQ ID NO: 664441 - DNA, 25 bp, Homo sapien
tgagcacctcaccaacagctgagcg

SEQ ID NO: 664442 - DNA, 25 bp, Homo sapien
aacagctgagcgttggccaatttca

SEQ ID NO: 664443 - DNA, 25 bp, Homo sapien
agcgttggccaatttcagcagccat

SEQ ID NO: 664444 - DNA, 25 bp, Homo sapien
ctcaaccactcatacactcttgagt

SEQ ID NO: 664445 - DNA, 25 bp, Homo sapien
cactcttgagtgtgcaaactgtgtt

SEQ ID NO: 664446 - DNA, 25 bp, Homo sapien
caaacatcagcctgtaaccaatcca

SEQ ID NO: 664447 - DNA, 25 bp, Homo sapien
tcaaccacatggctgcactgaattc

SEQ ID NO: 664448 - DNA, 25 bp, Homo sapien
ggctgcactgaattctctttcaatc

SEQ ID NO: 664449 - DNA, 25 bp, Homo sapien
tctttcaatccgctgtgattccggg

SEQ ID NO: 664450 - DNA, 25 bp, Homo sapien
atgggtggactcacaggaagtcctt

SEQ ID NO: 664451 - DNA, 25 bp, Homo sapien
ggactcacaggaagtccttcccctt

SEQ ID NO: 664452 - DNA, 25 bp, Homo sapien
taaaggctcagagagcaggcgagcc

SEQ ID NO: 664453 - DNA, 25 bp, Homo sapien
gagcaggcgagccccaatctctagc

SEQ ID NO: 664454 - DNA, 25 bp, Homo sapien
tcccaacttggtctcacacaacaaa

SEQ ID NO: 664455 - DNA, 25 bp, Homo sapien
ttggtctcacacaacaaacctcatt

SEQ ID NO: 664456 - DNA, 25 bp, Homo sapien
aaacctcattcgacaaaccaatcca

SEQ ID NO: 664457 - DNA, 25 bp, Homo sapien
attcgacaaaccaatccaggcctgg

SEQ ID NO: 664458 - DNA, 25 bp, Homo sapien
caaaccaatccaggcctggagcagt

SEQ ID NO: 664459 - DNA, 25 bp, Homo sapien
ccaacagttcgggaggcagagttag

SEQ ID NO: 664460 - DNA, 25 bp, Homo sapien
aggcagagttaggtggatcaattga

SEQ ID NO: 664461 - DNA, 25 bp, Homo sapien
agatggctgggctccccggaacaaa

SEQ ID NO: 664462 - DNA, 25 bp, Homo sapien
aggtgtaactcttacaccacagcct

SEQ ID NO: 664463 - DNA, 25 bp, Homo sapien
gtgtgtcgcagagaaaaatactata

SEQ ID NO: 664464 - DNA, 25 bp, Homo sapien
acacacagagttcttgtcaccgatg

SEQ ID NO: 664465 - DNA, 25 bp, Homo sapien
gtcaccgatggaacagtctgtcttt

SEQ ID NO: 664466 - DNA, 25 bp, Homo sapien
gaacagtctgtctttgtctttcatc

SEQ ID NO: 664467 - DNA, 25 bp, Homo sapien
acattcatgtccagatcccattgcg

SEQ ID NO: 664468 - DNA, 25 bp, Homo sapien
atgtccagatcccattgcgctgcat

SEQ ID NO: 664469 - DNA, 25 bp, Homo sapien
gctgcatcacacgtgaacccagtga

SEQ ID NO: 664470 - DNA, 25 bp, Homo sapien
gaacccagtgaggtcaacaatgaat

SEQ ID NO: 664471 - DNA, 25 bp, Homo sapien
aatggatggtgttcacaaagaaacc

SEQ ID NO: 664472 - DNA, 25 bp, Homo sapien
acccaacagatgttccaaacgaaag

SEQ ID NO: 664473 - DNA, 25 bp, Homo sapien
gagaactctttctttggaccagctt

SEQ ID NO: 664474 - DNA, 25 bp, Homo sapien
tggaccagcttgtatgaaagcagac

SEQ ID NO: 664475 - DNA, 25 bp, Homo sapien
ggacaacatgacctcctgcaaggag

SEQ ID NO: 664476 - DNA, 25 bp, Homo sapien
ctgcttccatcctttcgaggctggg

SEQ ID NO: 664477 - DNA, 25 bp, Homo sapien
atggataccccaaaagaaatgtctt

SEQ ID NO: 664478 - DNA, 25 bp, Homo sapien
ttagtcgtgacaatagcagctccca

SEQ ID NO: 664479 - DNA, 25 bp, Homo sapien
gtgacaatagcagctcccacaatgc

SEQ ID NO: 664480 - DNA, 25 bp, Homo sapien
gctcccacaatgcaccagggcatat

SEQ ID NO: 664481 - DNA, 25 bp, Homo sapien
gggcatatgcaaagtcaccattctg

SEQ ID NO: 664482 - DNA, 25 bp, Homo sapien
gcaaagtcaccattctgtgaaatat

SEQ ID NO: 664483 - DNA, 25 bp, Homo sapien
gacacggaaatattggtattagcta

SEQ ID NO: 664484 - DNA, 25 bp, Homo sapien
agctaattaattgctttaccgtgac

SEQ ID NO: 664485 - DNA, 25 bp, Homo sapien
ttaattgctttaccgtgacccacgt

SEQ ID NO: 664486 - DNA, 25 bp, Homo sapien
gtgacccacgtaacaacaggtttgg

SEQ ID NO: 664487 - DNA, 25 bp, Homo sapien
acaggtttggtgtcattgattgtaa

SEQ ID NO: 664488 - DNA, 25 bp, Homo sapien
aactatagacccataaactgtgaat

SEQ ID NO: 664489 - DNA, 25 bp, Homo sapien
acagaaggcatatttgggactcaac

SEQ ID NO: 664490 - DNA, 25 bp, Homo sapien
gggactcaacccatgtgtctgactt

SEQ ID NO: 664491 - DNA, 25 bp, Homo sapien
gtgtctgactttgcattacctttga

SEQ ID NO: 664492 - DNA, 25 bp, Homo sapien
gactttgcattacctttgagcttct

SEQ ID NO: 664493 - DNA, 25 bp, Homo sapien
attacctttgagcttctaataaagt

SEQ ID NO: 664494 - DNA, 25 bp, Homo sapien
cccctgcctcagtctactgcgtagc

SEQ ID NO: 664495 - DNA, 25 bp, Homo sapien
aggcttgaaccactgtacccagact

SEQ ID NO: 664496 - DNA, 25 bp, Homo sapien
gcttgaaccactgtacccagactgg

SEQ ID NO: 664497 - DNA, 25 bp, Homo sapien
ttgaaccactgtacccagactggaa

SEQ ID NO: 664498 - DNA, 25 bp, Homo sapien
tgaaccactgtacccagactggaat

SEQ ID NO: 664499 - DNA, 25 bp, Homo sapien
accactgtacccagactggaattgt

SEQ ID NO: 664500 - DNA, 25 bp, Homo sapien
actgtacccagactggaattgtttt

SEQ ID NO: 664501 - DNA, 25 bp, Homo sapien
gtacccagactggaattgttttctt

SEQ ID NO: 664502 - DNA, 25 bp, Homo sapien
ttcattttttatttgctcataacta

SEQ ID NO: 664503 - DNA, 25 bp, Homo sapien
tcattttttatttgctcataactac

SEQ ID NO: 664504 - DNA, 25 bp, Homo sapien
cattttttatttgctcataactact

SEQ ID NO: 664505 - DNA, 25 bp, Homo sapien
aaacgctggtcttcttttaatgtgg

SEQ ID NO: 664506 - DNA, 25 bp, Homo sapien
aacagctagtgcttcagtcctagga

SEQ ID NO: 664507 - DNA, 25 bp, Homo sapien
aggaattatgtctctgctgtgggca

SEQ ID NO: 664508 - DNA, 25 bp, Homo sapien
gtgggcagttgtcataaactcttct

SEQ ID NO: 664509 - DNA, 25 bp, Homo sapien
taaactcttctcacaatccgagctg

SEQ ID NO: 664510 - DNA, 25 bp, Homo sapien
gaatgaaggtacttttgcttccatt

SEQ ID NO: 664511 - DNA, 25 bp, Homo sapien
tttgcttccatttcatccaaggatg

SEQ ID NO: 664512 - DNA, 25 bp, Homo sapien
atgtatagcatctgcccaaacctaa

SEQ ID NO: 664513 - DNA, 25 bp, Homo sapien
tgtgtttatcacgagagctttgtaa

SEQ ID NO: 664514 - DNA, 25 bp, Homo sapien
tgtaaggtacttcacttccacttta

SEQ ID NO: 664515 - DNA, 25 bp, Homo sapien
gtgctcaaaaccaactattgtgggt

SEQ ID NO: 664516 - DNA, 25 bp, Homo sapien
catgaacagatgtgcctgcggcagt

SEQ ID NO: 664517 - DNA, 25 bp, Homo sapien
ggcgccaagctgtgactcgggccac

SEQ ID NO: 664518 - DNA, 25 bp, Homo sapien
gactcgggccaccaaaaccagagtg

SEQ ID NO: 664519 - DNA, 25 bp, Homo sapien
aggacagtgcctcagagctgctccg

SEQ ID NO: 664520 - DNA, 25 bp, Homo sapien
cgccacactctaaagctctgtaata

SEQ ID NO: 664521 - DNA, 25 bp, Homo sapien
gctctgtaatatcagggaccgcatc

SEQ ID NO: 664522 - DNA, 25 bp, Homo sapien
gaccgcatcccttacatagagagca

SEQ ID NO: 664523 - DNA, 25 bp, Homo sapien
agcagaggcctgatcaatatacatc

SEQ ID NO: 664524 - DNA, 25 bp, Homo sapien
aatatacatcctttgcctgcttggg

SEQ ID NO: 664525 - DNA, 25 bp, Homo sapien
ccttgctaggagcagttgccggcaa

SEQ ID NO: 664526 - DNA, 25 bp, Homo sapien
agttgccggcaagcatcctcagtct

SEQ ID NO: 664527 - DNA, 25 bp, Homo sapien
aaaaaatgtcaagtccaatgtccct

SEQ ID NO: 664528 - DNA, 25 bp, Homo sapien
aaaatgtcaagtccaatgtcccttt

SEQ ID NO: 664529 - DNA, 25 bp, Homo sapien
aatgtcaagtccaatgtcccttttc

SEQ ID NO: 664530 - DNA, 25 bp, Homo sapien
ctttacagtatatacaagtgtctct

SEQ ID NO: 664531 - DNA, 25 bp, Homo sapien
gtatatacaagtgtctctatcaaca

SEQ ID NO: 664532 - DNA, 25 bp, Homo sapien
tacaagtgtctctatcaacattagg

SEQ ID NO: 664533 - DNA, 25 bp, Homo sapien
caagtgtctctatcaacattaggtt

SEQ ID NO: 664534 - DNA, 25 bp, Homo sapien
tcaacattaggttttgaggttgagt

SEQ ID NO: 664535 - DNA, 25 bp, Homo sapien
gaggttgagtgcagtggcccacacc

SEQ ID NO: 664536 - DNA, 25 bp, Homo sapien
agaggtggaggatcgttcaacccca

SEQ ID NO: 664537 - DNA, 25 bp, Homo sapien
ggtggaggatcgttcaaccccagga

SEQ ID NO: 664538 - DNA, 25 bp, Homo sapien
aggtaataaacttcccatcactaag

SEQ ID NO: 664539 - DNA, 25 bp, Homo sapien
acttcccatcactaagttcaaatgg

SEQ ID NO: 664540 - DNA, 25 bp, Homo sapien
cactaagttcaaatggagtctgtgt

SEQ ID NO: 664541 - DNA, 25 bp, Homo sapien
caagatgacttttagagctcctttt

SEQ ID NO: 664542 - DNA, 25 bp, Homo sapien
gagctccttttagacctgagattct

SEQ ID NO: 664543 - DNA, 25 bp, Homo sapien
gacctgagattctattattcactga

SEQ ID NO: 664544 - DNA, 25 bp, Homo sapien
gagattctattattcactgatacag

SEQ ID NO: 664545 - DNA, 25 bp, Homo sapien
cagatataaatcactggagctctca

SEQ ID NO: 664546 - DNA, 25 bp, Homo sapien
ggagctctcatttaagcagtttctt

SEQ ID NO: 664547 - DNA, 25 bp, Homo sapien
agtttcttttgctgccccataacta

SEQ ID NO: 664548 - DNA, 25 bp, Homo sapien
tttgctgccccataactaggtgatg

SEQ ID NO: 664549 - DNA, 25 bp, Homo sapien
gggaattccagcaggtgacccaatc

SEQ ID NO: 664550 - DNA, 25 bp, Homo sapien
cagcaggtgacccaatcgagacagc

SEQ ID NO: 664551 - DNA, 25 bp, Homo sapien
aatcgagacagctgggcaggctcct

SEQ ID NO: 664552 - DNA, 25 bp, Homo sapien
atggagggccttcaactcattggat

SEQ ID NO: 664553 - DNA, 25 bp, Homo sapien
gagggccttcaactcattggatgaa

SEQ ID NO: 664554 - DNA, 25 bp, Homo sapien
gaagcccacccttattcccaaggat

SEQ ID NO: 664555 - DNA, 25 bp, Homo sapien
gataatctcctttactcaaggtcaa

SEQ ID NO: 664556 - DNA, 25 bp, Homo sapien
aaaatgtcttcacagcaacgggatt

SEQ ID NO: 664557 - DNA, 25 bp, Homo sapien
caacgggattgcttcacagtaatgg

SEQ ID NO: 664558 - DNA, 25 bp, Homo sapien
ggtcaaatggtaattatccttatga

SEQ ID NO: 664559 - DNA, 25 bp, Homo sapien
ccattgtcttttctctaccttactt

SEQ ID NO: 664560 - DNA, 25 bp, Homo sapien
tatttgtgcagagctgaatacctta

SEQ ID NO: 664561 - DNA, 25 bp, Homo sapien
tatgcacacactttctcattcaatc

SEQ ID NO: 664562 - DNA, 25 bp, Homo sapien
agcaggcaaggcaggccccattctc

SEQ ID NO: 664563 - DNA, 25 bp, Homo sapien
cccattctccccattgcaaaaagga

SEQ ID NO: 664564 - DNA, 25 bp, Homo sapien
ggtgttgaggacttgcccagcatct

SEQ ID NO: 664565 - DNA, 25 bp, Homo sapien
agcatctcacagctcaagaggactg

SEQ ID NO: 664566 - DNA, 25 bp, Homo sapien
tggagcctgaccttggaccagattc

SEQ ID NO: 664567 - DNA, 25 bp, Homo sapien
ttggaccagattctcaggctctcta

SEQ ID NO: 664568 - DNA, 25 bp, Homo sapien
agattctcaggctctctaccgagtc

SEQ ID NO: 664569 - DNA, 25 bp, Homo sapien
ggaggagaagctttctaagctctaa

SEQ ID NO: 664570 - DNA, 25 bp, Homo sapien
aaagttgtgtgaaggtttgtgccca

SEQ ID NO: 664571 - DNA, 25 bp, Homo sapien
gaagtctaagaatctcctgaaatgg

SEQ ID NO: 664572 - DNA, 25 bp, Homo sapien
ctcctgaaatggtttgcaaaatata

SEQ ID NO: 664573 - DNA, 25 bp, Homo sapien
aaatggtttgcaaaatatactgggc

SEQ ID NO: 664574 - DNA, 25 bp, Homo sapien
ggaatcatagcattcatcagctttt

SEQ ID NO: 664575 - DNA, 25 bp, Homo sapien
atagcattcatcagcttttcaaggg

SEQ ID NO: 664576 - DNA, 25 bp, Homo sapien
atcagcttttcaagggggcccagag

SEQ ID NO: 664577 - DNA, 25 bp, Homo sapien
ggggcccagagttcaaaagcagtta

SEQ ID NO: 664578 - DNA, 25 bp, Homo sapien
ttttctagtggatataaggtgggac

SEQ ID NO: 664579 - DNA, 25 bp, Homo sapien
tggatataaggtgggactagattct

SEQ ID NO: 664580 - DNA, 25 bp, Homo sapien
gactagattctaaggtatttcttcc

SEQ ID NO: 664581 - DNA, 25 bp, Homo sapien
gattctaaggtatttcttcccccag

SEQ ID NO: 664582 - DNA, 25 bp, Homo sapien
gtggtaacaacgcagagtacgcgta

SEQ ID NO: 664583 - DNA, 25 bp, Homo sapien
cagagtacgcgtaagcagtggtaac

SEQ ID NO: 664584 - DNA, 25 bp, Homo sapien
gtaagcagtggtaacaacgcagagt

SEQ ID NO: 664585 - DNA, 25 bp, Homo sapien
tcgcggccgaggtacgcgggaagca

SEQ ID NO: 664586 - DNA, 25 bp, Homo sapien
tggtaacaacgcagaacacgcgtaa

SEQ ID NO: 664587 - DNA, 25 bp, Homo sapien
gtaacaacgcagaacacgcgtaagc

SEQ ID NO: 664588 - DNA, 25 bp, Homo sapien
acaacgcagaacacgcgtaagcagt

SEQ ID NO: 664589 - DNA, 25 bp, Homo sapien
gcagaacacgcgtaagcagtggtaa

SEQ ID NO: 664590 - DNA, 25 bp, Homo sapien
agaacacgcgtaagcagtggtaaca

SEQ ID NO: 664591 - DNA, 25 bp, Homo sapien
gaacacgcgtaagcagtggtaacaa

SEQ ID NO: 664592 - DNA, 25 bp, Homo sapien
gaagcagtggtaacaacgcagagta

SEQ ID NO: 664593 - DNA, 25 bp, Homo sapien
accattacacgtgggaggcaggcaa

SEQ ID NO: 664594 - DNA, 25 bp, Homo sapien
gcaggcaacagatgaggccagctgt

SEQ ID NO: 664595 - DNA, 25 bp, Homo sapien
aggccagctgtgtcgcgaagcctgt

SEQ ID NO: 664596 - DNA, 25 bp, Homo sapien
agctgtgtcgcgaagcctgtgacat

SEQ ID NO: 664597 - DNA, 25 bp, Homo sapien
gaagcctgtgacatgggcagctctt

SEQ ID NO: 664598 - DNA, 25 bp, Homo sapien
gggcagctcttgaagtacaccgggt

SEQ ID NO: 664599 - DNA, 25 bp, Homo sapien
tcttgaagtacaccgggttcgaggc

SEQ ID NO: 664600 - DNA, 25 bp, Homo sapien
aaaactggagatttggtcccatgca

SEQ ID NO: 664601 - DNA, 25 bp, Homo sapien
agatttggtcccatgcagtaagagg

SEQ ID NO: 664602 - DNA, 25 bp, Homo sapien
ggccaccaatttgtggaccattaca

SEQ ID NO: 664603 - DNA, 25 bp, Homo sapien
atttgtggaccattacacgtgggag

SEQ ID NO: 664604 - DNA, 25 bp, Homo sapien
acctacgtttatttagctctcttcg

SEQ ID NO: 664605 - DNA, 25 bp, Homo sapien
agctctcttcgataattccagttgg

SEQ ID NO: 664606 - DNA, 25 bp, Homo sapien
attccagttggtggctagtgaacac

SEQ ID NO: 664607 - DNA, 25 bp, Homo sapien
actgctgcactaatcattgcctgtt

SEQ ID NO: 664608 - DNA, 25 bp, Homo sapien
tgcctgttttccaactattagccct

SEQ ID NO: 664609 - DNA, 25 bp, Homo sapien
aactattagcccttttgttctcatg

SEQ ID NO: 664610 - DNA, 25 bp, Homo sapien
cttttgttctcatgtgccgtgaccc

SEQ ID NO: 664611 - DNA, 25 bp, Homo sapien
agatccaggctctgcagtatctgct

SEQ ID NO: 664612 - DNA, 25 bp, Homo sapien
gaacagagccatccaaagcatcctt

SEQ ID NO: 664613 - DNA, 25 bp, Homo sapien
aagcatccttgcattggtgagcacc

SEQ ID NO: 664614 - DNA, 25 bp, Homo sapien
agcacctttgcattatgttacgccc

SEQ ID NO: 664615 - DNA, 25 bp, Homo sapien
gcaaaaatactcagtgcaatggact

SEQ ID NO: 664616 - DNA, 25 bp, Homo sapien
gactgaatgttagtgtccttccaaa

SEQ ID NO: 664617 - DNA, 25 bp, Homo sapien
atgttagtgtccttccaaaattcat

SEQ ID NO: 664618 - DNA, 25 bp, Homo sapien
gttgaaaccctaatctactatgtgt

SEQ ID NO: 664619 - DNA, 25 bp, Homo sapien
gttaggattaggaggtaaagccatt

SEQ ID NO: 664620 - DNA, 25 bp, Homo sapien
aatgagggtggagttctcaggaata

SEQ ID NO: 664621 - DNA, 25 bp, Homo sapien
ctcaggaataggattggtgctctta

SEQ ID NO: 664622 - DNA, 25 bp, Homo sapien
ggattggtgctcttatcaacggaac

SEQ ID NO: 664623 - DNA, 25 bp, Homo sapien
tcaacggaaccccagatagctctct

SEQ ID NO: 664624 - DNA, 25 bp, Homo sapien
gatacaagaagtctgcagtgtgcaa

SEQ ID NO: 664625 - DNA, 25 bp, Homo sapien
aagtctgcagtgtgcaatctggaaa

SEQ ID NO: 664626 - DNA, 25 bp, Homo sapien
aactgaactgtgtacaacgctgagc

SEQ ID NO: 664627 - DNA, 25 bp, Homo sapien
acaacgctgagcacacacgtggttt

SEQ ID NO: 664628 - DNA, 25 bp, Homo sapien
acacacgtggtttggagagcagccc

SEQ ID NO: 664629 - DNA, 25 bp, Homo sapien
agcagccccttgtcaggatccaaaa

SEQ ID NO: 664630 - DNA, 25 bp, Homo sapien
ggatccaaaatgttcccaagccttg

SEQ ID NO: 664631 - DNA, 25 bp, Homo sapien
caagccttgttgatatttgggtcac

SEQ ID NO: 664632 - DNA, 25 bp, Homo sapien
atttgggtcactgcagatctctgag

SEQ ID NO: 664633 - DNA, 25 bp, Homo sapien
aactcattctcaatttctctctctg

SEQ ID NO: 664634 - DNA, 25 bp, Homo sapien
tctctgaaaccacctgtgaacacac

SEQ ID NO: 664635 - DNA, 25 bp, Homo sapien
gatgcatactgttcatgcttatatt

SEQ ID NO: 664636 - DNA, 25 bp, Homo sapien
tatttttctgtaaccgtcatatcta

SEQ ID NO: 664637 - DNA, 25 bp, Homo sapien
gagagcctttgcatggctcttgttc

SEQ ID NO: 664638 - DNA, 25 bp, Homo sapien
ggctcttgttccacctggaatgaga

SEQ ID NO: 664639 - DNA, 25 bp, Homo sapien
agatttctaactcttggctacctca

SEQ ID NO: 664640 - DNA, 25 bp, Homo sapien
tccccatgtctctggcattctcatt

SEQ ID NO: 664641 - DNA, 25 bp, Homo sapien
catagaacacatcacaaagccattt

SEQ ID NO: 664642 - DNA, 25 bp, Homo sapien
aaagccatttgctcatgcatgatgt

SEQ ID NO: 664643 - DNA, 25 bp, Homo sapien
tattgtctattttctatctccctgc

SEQ ID NO: 664644 - DNA, 25 bp, Homo sapien
ttctatctccctgctagagggtaag

SEQ ID NO: 664645 - DNA, 25 bp, Homo sapien
gatgctcaagaacactgctctgtct

SEQ ID NO: 664646 - DNA, 25 bp, Homo sapien
tccctggacccagaaaatgcttggc

SEQ ID NO: 664647 - DNA, 25 bp, Homo sapien
aatgcttggcgtgtggtagaactta

SEQ ID NO: 664648 - DNA, 25 bp, Homo sapien
cattttcccggagtgcgaggtcctg

SEQ ID NO: 664649 - DNA, 25 bp, Homo sapien
attttcccggagtgcgaggtcctgc

SEQ ID NO: 664650 - DNA, 25 bp, Homo sapien
ttttcccggagtgcgaggtcctgct

SEQ ID NO: 664651 - DNA, 25 bp, Homo sapien
ttcccggagtgcgaggtcctgctgg

SEQ ID NO: 664652 - DNA, 25 bp, Homo sapien
cggagtgcgaggtcctgctggtcct

SEQ ID NO: 664653 - DNA, 25 bp, Homo sapien
ctccctactttctcctttccaatat

SEQ ID NO: 664654 - DNA, 25 bp, Homo sapien
tttctcctttccaatatccctctgt

SEQ ID NO: 664655 - DNA, 25 bp, Homo sapien
tcctttccaatatccctctgtccat

SEQ ID NO: 664656 - DNA, 25 bp, Homo sapien
ctgtccatctgtccttttctcgctc

SEQ ID NO: 664657 - DNA, 25 bp, Homo sapien
atctgtccttttctcgctccattcc

SEQ ID NO: 664658 - DNA, 25 bp, Homo sapien
tttctcgctccattcctccctttct

SEQ ID NO: 664659 - DNA, 25 bp, Homo sapien
taagctggcaaaaggtcaggaggct

SEQ ID NO: 664660 - DNA, 25 bp, Homo sapien
aaaaggtcaggaggctgcatttcac

SEQ ID NO: 664661 - DNA, 25 bp, Homo sapien
ggaggctgcatttcactgaagatgg

SEQ ID NO: 664662 - DNA, 25 bp, Homo sapien
ttcactgaagatggatcgcacagat

SEQ ID NO: 664663 - DNA, 25 bp, Homo sapien
cacagatgaatattgcgcttgctta

SEQ ID NO: 664664 - DNA, 25 bp, Homo sapien
tattgcgcttgcttaatgaagtcaa

SEQ ID NO: 664665 - DNA, 25 bp, Homo sapien
tcaatttcaccttcatagaccacgc

SEQ ID NO: 664666 - DNA, 25 bp, Homo sapien
gccactaatcccagccaatcatttt

SEQ ID NO: 664667 - DNA, 25 bp, Homo sapien
aatcccagccaatcattttgtagat

SEQ ID NO: 664668 - DNA, 25 bp, Homo sapien
tgtagatatgtgcaactggtgacta

SEQ ID NO: 664669 - DNA, 25 bp, Homo sapien
gtgcaactggtgactaagggactag

SEQ ID NO: 664670 - DNA, 25 bp, Homo sapien
tttttattcccatgtgaatgtccaa

SEQ ID NO: 664671 - DNA, 25 bp, Homo sapien
gaatgtccaatttatccaacaccat

SEQ ID NO: 664672 - DNA, 25 bp, Homo sapien
tctctcactgtactgttgtgtctcc

SEQ ID NO: 664673 - DNA, 25 bp, Homo sapien
gttgtgtctcccctattataaattt

SEQ ID NO: 664674 - DNA, 25 bp, Homo sapien
ttggcacttctatacatgttgggct

SEQ ID NO: 664675 - DNA, 25 bp, Homo sapien
atgttgggctagttctggactttcc

SEQ ID NO: 664676 - DNA, 25 bp, Homo sapien
ttttatctttgcaccaagaccaccc

SEQ ID NO: 664677 - DNA, 25 bp, Homo sapien
gaccaccctgtcttaattactattg

SEQ ID NO: 664678 - DNA, 25 bp, Homo sapien
catgctagacttagtaactctccta

SEQ ID NO: 664679 - DNA, 25 bp, Homo sapien
gtaactctcctattgttgaacattt

SEQ ID NO: 664680 - DNA, 25 bp, Homo sapien
ggttgttgccaatgttttattataa

SEQ ID NO: 664681 - DNA, 25 bp, Homo sapien
tgagccatgatagcatcagctgcac

SEQ ID NO: 664682 - DNA, 25 bp, Homo sapien
aagtcaatttacaattaatgtggta

SEQ ID NO: 664683 - DNA, 25 bp, Homo sapien
gtaaagattacttgtatgtaccaat

SEQ ID NO: 664684 - DNA, 25 bp, Homo sapien
gtatgtaccaatgtaacttgacttt

SEQ ID NO: 664685 - DNA, 25 bp, Homo sapien
gtaccaatgtaacttgacttttgat

SEQ ID NO: 664686 - DNA, 25 bp, Homo sapien
atgtaacttgacttttgatattgaa

SEQ ID NO: 664687 - DNA, 25 bp, Homo sapien
acttgacttttgatattgaaatgta

SEQ ID NO: 664688 - DNA, 25 bp, Homo sapien
gtgtaataatgtatagaccccctct

SEQ ID NO: 664689 - DNA, 25 bp, Homo sapien
ataatgtatagaccccctctgaaag

SEQ ID NO: 664690 - DNA, 25 bp, Homo sapien
gtatagaccccctctgaaagacgag

SEQ ID NO: 664691 - DNA, 25 bp, Homo sapien
tagaccccctctgaaagacgagggt

SEQ ID NO: 664692 - DNA, 25 bp, Homo sapien
agtgcctgtgcctctgagcccgggt

SEQ ID NO: 664693 - DNA, 25 bp, Homo sapien
catctccttggcttgttaactcggt

SEQ ID NO: 664694 - DNA, 25 bp, Homo sapien
ttggcttgttaactcggtcagtccc

SEQ ID NO: 664695 - DNA, 25 bp, Homo sapien
taactcggtcagtccctgggatttt

SEQ ID NO: 664696 - DNA, 25 bp, Homo sapien
ctgggattttatcaggcgcctctga

SEQ ID NO: 664697 - DNA, 25 bp, Homo sapien
tttatcaggcgcctctgaggtgccc

SEQ ID NO: 664698 - DNA, 25 bp, Homo sapien
atttctgggcagcagcattgcagga

SEQ ID NO: 664699 - DNA, 25 bp, Homo sapien
tgtgacagagcagggcaccagctca

SEQ ID NO: 664700 - DNA, 25 bp, Homo sapien
gggcaccagctcaggtcccaacggg

SEQ ID NO: 664701 - DNA, 25 bp, Homo sapien
gggctgagttctagcccagctccct

SEQ ID NO: 664702 - DNA, 25 bp, Homo sapien
tcacttccacgcatgggctcagaac

SEQ ID NO: 664703 - DNA, 25 bp, Homo sapien
aatcccttcgagtaacacccacaga

SEQ ID NO: 664704 - DNA, 25 bp, Homo sapien
cgagtaacacccacagaactgaaat

SEQ ID NO: 664705 - DNA, 25 bp, Homo sapien
attccatttcttggtggtcttctac

SEQ ID NO: 664706 - DNA, 25 bp, Homo sapien
ttggtggtcttctaccaatccagtc

SEQ ID NO: 664707 - DNA, 25 bp, Homo sapien
aatccagtcctcctgaggaccataa

SEQ ID NO: 664708 - DNA, 25 bp, Homo sapien
cataaaaactattggttcctctcct

SEQ ID NO: 664709 - DNA, 25 bp, Homo sapien
gttcctctcctaaactgctgtaaaa

SEQ ID NO: 664710 - DNA, 25 bp, Homo sapien
gtaaaatatatcctgtgagacccag

SEQ ID NO: 664711 - DNA, 25 bp, Homo sapien
aatctttctgaggttgagcattcca

SEQ ID NO: 664712 - DNA, 25 bp, Homo sapien
gagcattccatggagactcaatatt

SEQ ID NO: 664713 - DNA, 25 bp, Homo sapien
tatttctcaggatctctttgttcat

SEQ ID NO: 664714 - DNA, 25 bp, Homo sapien
gttactgctggaacccggacacggg

SEQ ID NO: 664715 - DNA, 25 bp, Homo sapien
ggaaagcgagggtccccagagcatc

SEQ ID NO: 664716 - DNA, 25 bp, Homo sapien
gagggtccccagagcatcctgaagg

SEQ ID NO: 664717 - DNA, 25 bp, Homo sapien
cccagagcatcctgaaggctgagtt

SEQ ID NO: 664718 - DNA, 25 bp, Homo sapien
atcctgaaggctgagttgacctgga

SEQ ID NO: 664719 - DNA, 25 bp, Homo sapien
agccccagctgcagaacgccggtgg

SEQ ID NO: 664720 - DNA, 25 bp, Homo sapien
gagggcgtccacagactggccccaa

SEQ ID NO: 664721 - DNA, 25 bp, Homo sapien
agactggccccaaatgtcagccgta

SEQ ID NO: 664722 - DNA, 25 bp, Homo sapien
aaatgtcagccgtatgtctgagaac

SEQ ID NO: 664723 - DNA, 25 bp, Homo sapien
cagccgtatgtctgagaacagcatt

SEQ ID NO: 664724 - DNA, 25 bp, Homo sapien
atggaggagttccagcgttactgct

SEQ ID NO: 664725 - DNA, 25 bp, Homo sapien
aacccaggtgcaaactagagccaca

SEQ ID NO: 664726 - DNA, 25 bp, Homo sapien
aaccattcccagctgaactgtatcc

SEQ ID NO: 664727 - DNA, 25 bp, Homo sapien
gcagttggcttagaattacaatcag

SEQ ID NO: 664728 - DNA, 25 bp, Homo sapien
attggcaatgttccagtcccaagtc

SEQ ID NO: 664729 - DNA, 25 bp, Homo sapien
agtcccaagtctaggcctcgggagg

SEQ ID NO: 664730 - DNA, 25 bp, Homo sapien
ctcgggaggcttgcattttgccaaa

SEQ ID NO: 664731 - DNA, 25 bp, Homo sapien
ttttgccaaattatgatccccttct

SEQ ID NO: 664732 - DNA, 25 bp, Homo sapien
aattatgatccccttctcagctgct

SEQ ID NO: 664733 - DNA, 25 bp, Homo sapien
tgctctttcagcatggacgctatca

SEQ ID NO: 664734 - DNA, 25 bp, Homo sapien
ggacgctatcacaaacacatggaaa

SEQ ID NO: 664735 - DNA, 25 bp, Homo sapien
tggaaaatggccttccctagttaat

SEQ ID NO: 664736 - DNA, 25 bp, Homo sapien
aatacatgctgttccttaaaattac

SEQ ID NO: 664737 - DNA, 25 bp, Homo sapien
taaaattacatagcacacccacgga

SEQ ID NO: 664738 - DNA, 25 bp, Homo sapien
aaattacatagcacacccacggaat

SEQ ID NO: 664739 - DNA, 25 bp, Homo sapien
attacatagcacacccacggaattg

SEQ ID NO: 664740 - DNA, 25 bp, Homo sapien
ttacatagcacacccacggaattgt

SEQ ID NO: 664741 - DNA, 25 bp, Homo sapien
catagcacacccacggaattgtctt

SEQ ID NO: 664742 - DNA, 25 bp, Homo sapien
cacggaattgtcttgcctttggcta

SEQ ID NO: 664743 - DNA, 25 bp, Homo sapien
cggaattgtcttgcctttggctatt

SEQ ID NO: 664744 - DNA, 25 bp, Homo sapien
aattgtcttgcctttggctatttca

SEQ ID NO: 664745 - DNA, 25 bp, Homo sapien
tctaatttccaaaaacttcatatat

SEQ ID NO: 664746 - DNA, 25 bp, Homo sapien
cagtgtttactgaagtgcaaaataa

SEQ ID NO: 664747 - DNA, 25 bp, Homo sapien
gatttggtaatgaggatgtaaccct

SEQ ID NO: 664748 - DNA, 25 bp, Homo sapien
tgtaaccctcatgaatagaattagt

SEQ ID NO: 664749 - DNA, 25 bp, Homo sapien
aaatgaggaaccagagaactacctt

SEQ ID NO: 664750 - DNA, 25 bp, Homo sapien
cagagaactaccttgtccctttcac

SEQ ID NO: 664751 - DNA, 25 bp, Homo sapien
tccctttcactatatgaggacacag

SEQ ID NO: 664752 - DNA, 25 bp, Homo sapien
gacacagctagaggacaccttctat

SEQ ID NO: 664753 - DNA, 25 bp, Homo sapien
gaggacaccttctatgaatccggaa

SEQ ID NO: 664754 - DNA, 25 bp, Homo sapien
gaatccggaaatggatcctcaacga

SEQ ID NO: 664755 - DNA, 25 bp, Homo sapien
tggatcctcaacgagacacttcatc

SEQ ID NO: 664756 - DNA, 25 bp, Homo sapien
gagacacttcatcagcagatgcctt

SEQ ID NO: 664757 - DNA, 25 bp, Homo sapien
atcagcagatgccttatcttggact

SEQ ID NO: 664758 - DNA, 25 bp, Homo sapien
gtaaaagtaacgtggcattctggct

SEQ ID NO: 664759 - DNA, 25 bp, Homo sapien
tctggcttctagtaatggtgcaata

SEQ ID NO: 664760 - DNA, 25 bp, Homo sapien
gcaatactgtagagttaccttccta

SEQ ID NO: 664761 - DNA, 25 bp, Homo sapien
gtagagttaccttcctatagataac

SEQ ID NO: 664762 - DNA, 25 bp, Homo sapien
gcagacaaactggaggagagcctat

SEQ ID NO: 664763 - DNA, 25 bp, Homo sapien
ggaggagagcctattcttaaaacat

SEQ ID NO: 664764 - DNA, 25 bp, Homo sapien
ttcatgagttggtgggtttttgtct

SEQ ID NO: 664765 - DNA, 25 bp, Homo sapien
gtttttgtctgagggtgctctgtaa

SEQ ID NO: 664766 - DNA, 25 bp, Homo sapien
agggtgctctgtaatcctcctgcta

SEQ ID NO: 664767 - DNA, 25 bp, Homo sapien
aatcctcctgctacttggtgaagaa

SEQ ID NO: 664768 - DNA, 25 bp, Homo sapien
gaataccacaaccttatttgcatga

SEQ ID NO: 664769 - DNA, 25 bp, Homo sapien
gattaatcgctgatattatatgact

SEQ ID NO: 664770 - DNA, 25 bp, Homo sapien
attaatcgctgatattatatgactt

SEQ ID NO: 664771 - DNA, 25 bp, Homo sapien
ttaatcgctgatattatatgacttc

SEQ ID NO: 664772 - DNA, 25 bp, Homo sapien
taatcgctgatattatatgacttcg

SEQ ID NO: 664773 - DNA, 25 bp, Homo sapien
aatcgctgatattatatgacttcgt

SEQ ID NO: 664774 - DNA, 25 bp, Homo sapien
gaatcaggggagaattgctagagcc

SEQ ID NO: 664775 - DNA, 25 bp, Homo sapien
atcaggggagaattgctagagccta

SEQ ID NO: 664776 - DNA, 25 bp, Homo sapien
aggggagaattgctagagcctagga

SEQ ID NO: 664777 - DNA, 25 bp, Homo sapien
gcgagcctgggggaacataagacat

SEQ ID NO: 664778 - DNA, 25 bp, Homo sapien
agcctgggggaacataagacatttt

SEQ ID NO: 664779 - DNA, 25 bp, Homo sapien
gcctgggggaacataagacattttc

SEQ ID NO: 664780 - DNA, 25 bp, Homo sapien
agcgtctatattgaggaaacccaca

SEQ ID NO: 664781 - DNA, 25 bp, Homo sapien
ggcagcctctagaaaccatgggtgg

SEQ ID NO: 664782 - DNA, 25 bp, Homo sapien
ccatgggtggcctcttcgatttgaa

SEQ ID NO: 664783 - DNA, 25 bp, Homo sapien
ttcgatttgaaggtagcttccagct

SEQ ID NO: 664784 - DNA, 25 bp, Homo sapien
gtagcttccagctgacaaccagtaa

SEQ ID NO: 664785 - DNA, 25 bp, Homo sapien
cctcagtcatgtagctgcaagaaaa

SEQ ID NO: 664786 - DNA, 25 bp, Homo sapien
aaatctgccaatgacgtgaatgatc

SEQ ID NO: 664787 - DNA, 25 bp, Homo sapien
cttccccagtcaagtttccagatga

SEQ ID NO: 664788 - DNA, 25 bp, Homo sapien
gaaaatatagcctggctgacacctt

SEQ ID NO: 664789 - DNA, 25 bp, Homo sapien
gacaccttgtgagatcctgaacaga

SEQ ID NO: 664790 - DNA, 25 bp, Homo sapien
gttaagctatgtgtgaacttttgac

SEQ ID NO: 664791 - DNA, 25 bp, Homo sapien
tccaggacactgctatgagagtctt

SEQ ID NO: 664792 - DNA, 25 bp, Homo sapien
aggacactgctatgagagtcttaat

SEQ ID NO: 664793 - DNA, 25 bp, Homo sapien
cactgctatgagagtcttaatgttt

SEQ ID NO: 664794 - DNA, 25 bp, Homo sapien
tcttaatgtttgtccttcacataga

SEQ ID NO: 664795 - DNA, 25 bp, Homo sapien
taatgtttgtccttcacatagaatt

SEQ ID NO: 664796 - DNA, 25 bp, Homo sapien
actgctacaagggtttgaaagtttg

SEQ ID NO: 664797 - DNA, 25 bp, Homo sapien
acaacactactgctggggtctgaat

SEQ ID NO: 664798 - DNA, 25 bp, Homo sapien
ggattctagaacactccagctggct

SEQ ID NO: 664799 - DNA, 25 bp, Homo sapien
agaacactccagctggcttctgagt

SEQ ID NO: 664800 - DNA, 25 bp, Homo sapien
gattcctgaagactgctgctgtcgc

SEQ ID NO: 664801 - DNA, 25 bp, Homo sapien
tcctgaagactgctgctgtcgctat

SEQ ID NO: 664802 - DNA, 25 bp, Homo sapien
aatctatgctgagggatgagcggct

SEQ ID NO: 664803 - DNA, 25 bp, Homo sapien
tatgctgagggatgagcggctgctc

SEQ ID NO: 664804 - DNA, 25 bp, Homo sapien
gctgagggatgagcggctgctcaca

SEQ ID NO: 664805 - DNA, 25 bp, Homo sapien
agggatgagcggctgctcacagaag

SEQ ID NO: 664806 - DNA, 25 bp, Homo sapien
tgctcacagaagagaagcttgcaga

SEQ ID NO: 664807 - DNA, 25 bp, Homo sapien
gctcacagaagagaagcttgcagag

SEQ ID NO: 664808 - DNA, 25 bp, Homo sapien
tcacagaagagaagcttgcagagga

SEQ ID NO: 664809 - DNA, 25 bp, Homo sapien
cacagaagagaagcttgcagaggag

SEQ ID NO: 664810 - DNA, 25 bp, Homo sapien
gaagcttgcagaggagctcgggcaa

SEQ ID NO: 664811 - DNA, 25 bp, Homo sapien
ttgcagaggagctcgggcaagctga

SEQ ID NO: 664812 - DNA, 25 bp, Homo sapien
gagccggacaactcccagggacggg

SEQ ID NO: 664813 - DNA, 25 bp, Homo sapien
tcaaccagctgcactgtcggcggaa

SEQ ID NO: 664814 - DNA, 25 bp, Homo sapien
accagctgcactgtcggcggaagcg

SEQ ID NO: 664815 - DNA, 25 bp, Homo sapien
ggaagcggcggcaccgcaccatctt

SEQ ID NO: 664816 - DNA, 25 bp, Homo sapien
gacgagcagctcgaagctctcgaga

SEQ ID NO: 664817 - DNA, 25 bp, Homo sapien
aagctctcgagaacctcttccagga

SEQ ID NO: 664818 - DNA, 25 bp, Homo sapien
gagaacctcttccaggagaccaagt

SEQ ID NO: 664819 - DNA, 25 bp, Homo sapien
caggagaccaagtacccggacgtgg

SEQ ID NO: 664820 - DNA, 25 bp, Homo sapien
ccaagtacccggacgtgggcacgcg

SEQ ID NO: 664821 - DNA, 25 bp, Homo sapien
agctggcccggaaagtgcacctccg

SEQ ID NO: 664822 - DNA, 25 bp, Homo sapien
gaaagtgcacctccgcgaggagaaa

SEQ ID NO: 664823 - DNA, 25 bp, Homo sapien
tgcacctccgcgaggagaaagtgga

SEQ ID NO: 664824 - DNA, 25 bp, Homo sapien
gatcagtgtagctcaattgtgactt

SEQ ID NO: 664825 - DNA, 25 bp, Homo sapien
gaacagaatctgtccttcactgtaa

SEQ ID NO: 664826 - DNA, 25 bp, Homo sapien
atctgtccttcactgtaagagctac

SEQ ID NO: 664827 - DNA, 25 bp, Homo sapien
ttcactgtaagagctacagctttca

SEQ ID NO: 664828 - DNA, 25 bp, Homo sapien
acagctttcaaatgagctcactgga

SEQ ID NO: 664829 - DNA, 25 bp, Homo sapien
gaaattcattctaatccccaagctg

SEQ ID NO: 664830 - DNA, 25 bp, Homo sapien
agagatcctgtttcatatgctgtat

SEQ ID NO: 664831 - DNA, 25 bp, Homo sapien
atgataacaacatagtaactgcgtt

SEQ ID NO: 664832 - DNA, 25 bp, Homo sapien
gtaactgcgttacccaatggacttt

SEQ ID NO: 664833 - DNA, 25 bp, Homo sapien
tgcgttacccaatggactttatttt

SEQ ID NO: 664834 - DNA, 25 bp, Homo sapien
catcatatgatttcaattctcttta

SEQ ID NO: 664835 - DNA, 25 bp, Homo sapien
cctgctgatactgcctgtcttcaga

SEQ ID NO: 664836 - DNA, 25 bp, Homo sapien
attctcatcaggattgctgcagtaa

SEQ ID NO: 664837 - DNA, 25 bp, Homo sapien
ggattgctgcagtaaccaccaaagt

SEQ ID NO: 664838 - DNA, 25 bp, Homo sapien
gtaaccaccaaagtcaatattctgt

SEQ ID NO: 664839 - DNA, 25 bp, Homo sapien
aatattctgtcttcagccccaacct

SEQ ID NO: 664840 - DNA, 25 bp, Homo sapien
aacctatcttaatccatcctcataa

SEQ ID NO: 664841 - DNA, 25 bp, Homo sapien
ccccagggtgattctcctaaaatat

SEQ ID NO: 664842 - DNA, 25 bp, Homo sapien
aaactgcctgagtttgactttcagc

SEQ ID NO: 664843 - DNA, 25 bp, Homo sapien
gactttcagctattctactttatat

SEQ ID NO: 664844 - DNA, 25 bp, Homo sapien
actttatatctgtatgacttggaac

SEQ ID NO: 664845 - DNA, 25 bp, Homo sapien
gtgacctgaattctctcatgctata

SEQ ID NO: 664846 - DNA, 25 bp, Homo sapien
gggctgataggctgcttacataatt

SEQ ID NO: 664847 - DNA, 25 bp, Homo sapien
ataaaggcatttttatccatgtgcc

SEQ ID NO: 664848 - DNA, 25 bp, Homo sapien
tccatgtgccacctaagattcttag

SEQ ID NO: 664849 - DNA, 25 bp, Homo sapien
atcatccaatgtgcaattgctgacg

SEQ ID NO: 664850 - DNA, 25 bp, Homo sapien
attgctgacgtgagactgtggttcc

SEQ ID NO: 664851 - DNA, 25 bp, Homo sapien
gactgtggttccatgtttgtttaca

SEQ ID NO: 664852 - DNA, 25 bp, Homo sapien
acagggacaggtttgctctacagat

SEQ ID NO: 664853 - DNA, 25 bp, Homo sapien
gatatcactcaggactcactacatg

SEQ ID NO: 664854 - DNA, 25 bp, Homo sapien
tcactacatgccagtgccgtgcttt

SEQ ID NO: 664855 - DNA, 25 bp, Homo sapien
gccgtgctttgctctggaaacacag

SEQ ID NO: 664856 - DNA, 25 bp, Homo sapien
catgtaagacatggcctttattttg

SEQ ID NO: 664857 - DNA, 25 bp, Homo sapien
cacgtgcttgcccaagtctttatat

SEQ ID NO: 664858 - DNA, 25 bp, Homo sapien
gcttgcccaagtctttatatcactg

SEQ ID NO: 664859 - DNA, 25 bp, Homo sapien
gggaataacttgactccttcttctc

SEQ ID NO: 664860 - DNA, 25 bp, Homo sapien
tctctctatctctgaaagcaagtaa

SEQ ID NO: 664861 - DNA, 25 bp, Homo sapien
gaaatactgtaggtgacctgtctga

SEQ ID NO: 664862 - DNA, 25 bp, Homo sapien
aggtgacctgtctgagaggccccag

SEQ ID NO: 664863 - DNA, 25 bp, Homo sapien
gcctgaagtttttatctatttgcac

SEQ ID NO: 664864 - DNA, 25 bp, Homo sapien
ttatctatttgcacgttccctagag

SEQ ID NO: 664865 - DNA, 25 bp, Homo sapien
ttgcacgttccctagagaaacagga

SEQ ID NO: 664866 - DNA, 25 bp, Homo sapien
ttatgccagagatgtctcacagcac

SEQ ID NO: 664867 - DNA, 25 bp, Homo sapien
ctcacagcacatatgtactttacag

SEQ ID NO: 664868 - DNA, 25 bp, Homo sapien
tccaggacactgctatgagagtctt

SEQ ID NO: 664869 - DNA, 25 bp, Homo sapien
gacactgctatgagagtcttaatgt

SEQ ID NO: 664870 - DNA, 25 bp, Homo sapien
tcttaatgtttgtccttcacataga

SEQ ID NO: 664871 - DNA, 25 bp, Homo sapien
aacactgctcccgtggtctgaatgt

SEQ ID NO: 664872 - DNA, 25 bp, Homo sapien
actgctacaagggtttgaaagtttg

SEQ ID NO: 664873 - DNA, 25 bp, Homo sapien
acaacactactgctggggtctgaat

SEQ ID NO: 664874 - DNA, 25 bp, Homo sapien
ggattctagaacactccagctggct

SEQ ID NO: 664875 - DNA, 25 bp, Homo sapien
agaacactccagctggcttctgagt

SEQ ID NO: 664876 - DNA, 25 bp, Homo sapien
ccagctggcttctgagtgtttgtcc

SEQ ID NO: 664877 - DNA, 25 bp, Homo sapien
gattcctgaagactgctgctgtcgc

SEQ ID NO: 664878 - DNA, 25 bp, Homo sapien
tcctgaagactgctgctgtcgctat

SEQ ID NO: 664879 - DNA, 25 bp, Homo sapien
gtggcggccgcagcactcattgaag

SEQ ID NO: 664880 - DNA, 25 bp, Homo sapien
gcagcactcattgaagccgccagtt

SEQ ID NO: 664881 - DNA, 25 bp, Homo sapien
gcactcattgaagccgccagttggg

SEQ ID NO: 664882 - DNA, 25 bp, Homo sapien
tgaagccgccagttgggagaggagc

SEQ ID NO: 664883 - DNA, 25 bp, Homo sapien
cccctggatacccagaagctaagaa

SEQ ID NO: 664884 - DNA, 25 bp, Homo sapien
gccggtgctcccgaaggcagcaaga

SEQ ID NO: 664885 - DNA, 25 bp, Homo sapien
ggtgctcccgaaggcagcaagatgt

SEQ ID NO: 664886 - DNA, 25 bp, Homo sapien
ggcagcaagatgttgcgagccacag

SEQ ID NO: 664887 - DNA, 25 bp, Homo sapien
aagatgttgcgagccacagctccct

SEQ ID NO: 664888 - DNA, 25 bp, Homo sapien
tggttccgccctggatacccagaag

SEQ ID NO: 664889 - DNA, 25 bp, Homo sapien
gccctggatacccagaagctaagaa

SEQ ID NO: 664890 - DNA, 25 bp, Homo sapien
tacggtgtatttagtgagctgggat

SEQ ID NO: 664891 - DNA, 25 bp, Homo sapien
agtttgcagctttagattgtggtca

SEQ ID NO: 664892 - DNA, 25 bp, Homo sapien
ggtcagaggctgttacaagatctta

SEQ ID NO: 664893 - DNA, 25 bp, Homo sapien
tcttatatattctatgatgggccat

SEQ ID NO: 664894 - DNA, 25 bp, Homo sapien
gatgggccatatgcatctaaagcat

SEQ ID NO: 664895 - DNA, 25 bp, Homo sapien
gcatctaaagcatggtggttcagtt

SEQ ID NO: 664896 - DNA, 25 bp, Homo sapien
gattaatgtcagctttgagtttaga

SEQ ID NO: 664897 - DNA, 25 bp, Homo sapien
gctttgagtttagaatgtatcccag

SEQ ID NO: 664898 - DNA, 25 bp, Homo sapien
tgtatcccagacatcttagttgccc

SEQ ID NO: 664899 - DNA, 25 bp, Homo sapien
gacatcttagttgcccttaattatt

SEQ ID NO: 664900 - DNA, 25 bp, Homo sapien
atttttctcagccattaataaagca

SEQ ID NO: 664901 - DNA, 25 bp, Homo sapien
ttaaacaacttctggcatgtggaat

SEQ ID NO: 664902 - DNA, 25 bp, Homo sapien
tcatttgactacatttttgatccaa

SEQ ID NO: 664903 - DNA, 25 bp, Homo sapien
tttgatccaatttgcacccagtgtt

SEQ ID NO: 664904 - DNA, 25 bp, Homo sapien
ttgcacccagtgtttaagttaatca

SEQ ID NO: 664905 - DNA, 25 bp, Homo sapien
acagtgcttggcagtttgtgttgct

SEQ ID NO: 664906 - DNA, 25 bp, Homo sapien
ttgtgttgctggatcaaggctttct

SEQ ID NO: 664907 - DNA, 25 bp, Homo sapien
ctttctcactgaaaaccatgtgctt

SEQ ID NO: 664908 - DNA, 25 bp, Homo sapien
accatgtgcttcagaggttcataat

SEQ ID NO: 664909 - DNA, 25 bp, Homo sapien
gaggttcataattcctctttcacct

SEQ ID NO: 664910 - DNA, 25 bp, Homo sapien
ctttcaccttccatttcacattagt

SEQ ID NO: 664911 - DNA, 25 bp, Homo sapien
attgtggatccaagttatgtttcag

SEQ ID NO: 664912 - DNA, 25 bp, Homo sapien
ctgtgcccagccgatctgatgcttt

SEQ ID NO: 664913 - DNA, 25 bp, Homo sapien
gcccagccgatctgatgcttttata

SEQ ID NO: 664914 - DNA, 25 bp, Homo sapien
tcaccaccctgtgagaaaggtgcct

SEQ ID NO: 664915 - DNA, 25 bp, Homo sapien
caccaccctgtgagaaaggtgcctt

SEQ ID NO: 664916 - DNA, 25 bp, Homo sapien
accaccctgtgagaaaggtgccttt

SEQ ID NO: 664917 - DNA, 25 bp, Homo sapien
cttcacgtgaactgcctccatgatt

SEQ ID NO: 664918 - DNA, 25 bp, Homo sapien
ttcacgtgaactgcctccatgattg

SEQ ID NO: 664919 - DNA, 25 bp, Homo sapien
cacgtgaactgcctccatgattgta

SEQ ID NO: 664920 - DNA, 25 bp, Homo sapien
acgtgaactgcctccatgattgtaa

SEQ ID NO: 664921 - DNA, 25 bp, Homo sapien
ccccagctataaggaactgtgagcc

SEQ ID NO: 664922 - DNA, 25 bp, Homo sapien
ccagctataaggaactgtgagccaa

SEQ ID NO: 664923 - DNA, 25 bp, Homo sapien
gcctcaagcaattaacgtgtctcct

SEQ ID NO: 664924 - DNA, 25 bp, Homo sapien
taacgtgtctcctaacatgagataa

SEQ ID NO: 664925 - DNA, 25 bp, Homo sapien
gaaaattctgtcaccctgaaataaa

SEQ ID NO: 664926 - DNA, 25 bp, Homo sapien
aaacctggaagcagaattcctgaat

SEQ ID NO: 664927 - DNA, 25 bp, Homo sapien
agcagaattcctgaatgtttgccaa

SEQ ID NO: 664928 - DNA, 25 bp, Homo sapien
aggtgactatcagacttaagatgct

SEQ ID NO: 664929 - DNA, 25 bp, Homo sapien
gatgctgaactttgaaatgactgtc

SEQ ID NO: 664930 - DNA, 25 bp, Homo sapien
aaggcaaggcatggttggcgcccat

SEQ ID NO: 664931 - DNA, 25 bp, Homo sapien
ggcgcccattcaacctggtcaataa

SEQ ID NO: 664932 - DNA, 25 bp, Homo sapien
cttaattacaggacatggcatcatt

SEQ ID NO: 664933 - DNA, 25 bp, Homo sapien
gcatcattttgattcacagtggaat

SEQ ID NO: 664934 - DNA, 25 bp, Homo sapien
ggccctttcacccagacttgggtga

SEQ ID NO: 664935 - DNA, 25 bp, Homo sapien
agacttgggtgaaaccaggctcaca

SEQ ID NO: 664936 - DNA, 25 bp, Homo sapien
ggtgaaaccaggctcacacttcttc

SEQ ID NO: 664937 - DNA, 25 bp, Homo sapien
cacttcttcctgattttgcaccaaa

SEQ ID NO: 664938 - DNA, 25 bp, Homo sapien
tgattttgcaccaaaccttgccctc

SEQ ID NO: 664939 - DNA, 25 bp, Homo sapien
cttgccctccatgcggtttttgtag

SEQ ID NO: 664940 - DNA, 25 bp, Homo sapien
atgcggtttttgtagcccttacaga

SEQ ID NO: 664941 - DNA, 25 bp, Homo sapien
gtagcccttacagaagcactgcaca

SEQ ID NO: 664942 - DNA, 25 bp, Homo sapien
gagggccaccatggtgatgttgacc

SEQ ID NO: 664943 - DNA, 25 bp, Homo sapien
caccatggtgatgttgaccaccttg

SEQ ID NO: 664944 - DNA, 25 bp, Homo sapien
tgggcgtcgtcctgcagcaagtagc

SEQ ID NO: 664945 - DNA, 25 bp, Homo sapien
atgtgcccctttgcagttgttatta

SEQ ID NO: 664946 - DNA, 25 bp, Homo sapien
ttgttattaccttcttcctgcctta

SEQ ID NO: 664947 - DNA, 25 bp, Homo sapien
tcctgccttacacgtagctggatgg

SEQ ID NO: 664948 - DNA, 25 bp, Homo sapien
cacgtagctggatggctagagttcc

SEQ ID NO: 664949 - DNA, 25 bp, Homo sapien
gctagagttccaccaaccatgttat

SEQ ID NO: 664950 - DNA, 25 bp, Homo sapien
gacacgaggcaatcatcccaaaggg

SEQ ID NO: 664951 - DNA, 25 bp, Homo sapien
gactgagctgagagaaggagcctaa

SEQ ID NO: 664952 - DNA, 25 bp, Homo sapien
gcctaagattttgacgacctcatga

SEQ ID NO: 664953 - DNA, 25 bp, Homo sapien
tttgacgacctcatgaagataccat

SEQ ID NO: 664954 - DNA, 25 bp, Homo sapien
tgaagataccataccagccctcagc

SEQ ID NO: 664955 - DNA, 25 bp, Homo sapien
tcagctgcctctctttagaatacca

SEQ ID NO: 664956 - DNA, 25 bp, Homo sapien
gaggaccaaacctggactcatccca

SEQ ID NO: 664957 - DNA, 25 bp, Homo sapien
tcccattctatctgaacaaggctcc

SEQ ID NO: 664958 - DNA, 25 bp, Homo sapien
aggctccttcaaacttgttcctgtt

SEQ ID NO: 664959 - DNA, 25 bp, Homo sapien
ttcctgttcctcagtgggtctacac

SEQ ID NO: 664960 - DNA, 25 bp, Homo sapien
gggtctacactcagaatcctagcag

SEQ ID NO: 664961 - DNA, 25 bp, Homo sapien
tagcagctctgtccttaacacacag

SEQ ID NO: 664962 - DNA, 25 bp, Homo sapien
ttaacacacagcaggtctatgctct

SEQ ID NO: 664963 - DNA, 25 bp, Homo sapien
taataggtctatagtgttcacagta

SEQ ID NO: 664964 - DNA, 25 bp, Homo sapien
cagtagaactagtctgaaccttcag

SEQ ID NO: 664965 - DNA, 25 bp, Homo sapien
gattctggaaaaggaacgcgttgtt

SEQ ID NO: 664966 - DNA, 25 bp, Homo sapien
acgcgttgttaaagtttgttgatca

SEQ ID NO: 664967 - DNA, 25 bp, Homo sapien
ccctagttgccttcagatcattaac

SEQ ID NO: 664968 - DNA, 25 bp, Homo sapien
gccttcagatcattaacacatcatt

SEQ ID NO: 664969 - DNA, 25 bp, Homo sapien
aatgctaaaattccctgccattttg

SEQ ID NO: 664970 - DNA, 25 bp, Homo sapien
aattccctgccattttgtgaacatg

SEQ ID NO: 664971 - DNA, 25 bp, Homo sapien
ctgccattttgtgaacatgggttgc

SEQ ID NO: 664972 - DNA, 25 bp, Homo sapien
atgggttgcatgaagacgtaagttt

SEQ ID NO: 664973 - DNA, 25 bp, Homo sapien
acgtaagtttatgaattgcctctgc

SEQ ID NO: 664974 - DNA, 25 bp, Homo sapien
agtttatgaattgcctctgcacacc

SEQ ID NO: 664975 - DNA, 25 bp, Homo sapien
tagagtcccaccctgtacaggctaa

SEQ ID NO: 664976 - DNA, 25 bp, Homo sapien
tgtacaggctaacattcctccctac

SEQ ID NO: 664977 - DNA, 25 bp, Homo sapien
aggctaacattcctccctacatgca

SEQ ID NO: 664978 - DNA, 25 bp, Homo sapien
tttggactggtcctctagcctcaga

SEQ ID NO: 664979 - DNA, 25 bp, Homo sapien
ctctagcctcagaagcatctttttc

SEQ ID NO: 664980 - DNA, 25 bp, Homo sapien
aagcatctttttctccgactgattc

SEQ ID NO: 664981 - DNA, 25 bp, Homo sapien
ttttctccgactgattccgtgttca

SEQ ID NO: 664982 - DNA, 25 bp, Homo sapien
ttccgtgttcaggtaatgtctgcct

SEQ ID NO: 664983 - DNA, 25 bp, Homo sapien
tcaggtaatgtctgcctgcctgcct

SEQ ID NO: 664984 - DNA, 25 bp, Homo sapien
tagggcatctccacaccttaggcca

SEQ ID NO: 664985 - DNA, 25 bp, Homo sapien
gctggaacctacctgcccatcagag

SEQ ID NO: 664986 - DNA, 25 bp, Homo sapien
tgcccatcagagtcgtagccccagt

SEQ ID NO: 664987 - DNA, 25 bp, Homo sapien
gtagccccagttagtggagcctgct

SEQ ID NO: 664988 - DNA, 25 bp, Homo sapien
ttagtggagcctgctagagccacgg

SEQ ID NO: 664989 - DNA, 25 bp, Homo sapien
tctacggagagaaagatgccagaca

SEQ ID NO: 664990 - DNA, 25 bp, Homo sapien
tgccagacacaaaagcccacatgct

SEQ ID NO: 664991 - DNA, 25 bp, Homo sapien
aagcccacatgctgtgtgattccag

SEQ ID NO: 664992 - DNA, 25 bp, Homo sapien
gctgtgtgattccagttctatgaaa

SEQ ID NO: 664993 - DNA, 25 bp, Homo sapien
caggcaaatccacgaagacagaaag

SEQ ID NO: 664994 - DNA, 25 bp, Homo sapien
gtagattggtggatacctagggcat

SEQ ID NO: 664995 - DNA, 25 bp, Homo sapien
gaataactgccaacagatttgtggt

SEQ ID NO: 664996 - DNA, 25 bp, Homo sapien
aatgttctggaattacaccgtggcg

SEQ ID NO: 664997 - DNA, 25 bp, Homo sapien
gaattacaccgtggcgatgcatgta

SEQ ID NO: 664998 - DNA, 25 bp, Homo sapien
ggcgatgcatgtacagcatagtgaa

SEQ ID NO: 664999 - DNA, 25 bp, Homo sapien
actaaagccactgaagtataaactt

SEQ ID NO: 665000 - DNA, 25 bp, Homo sapien
tgaagaggaggttctctcccttgac

SEQ ID NO: 665001 - DNA, 25 bp, Homo sapien
aagttcaaaggagtgcccctcatca

SEQ ID NO: 665002 - DNA, 25 bp, Homo sapien
atcattgccatccatagtcccatct

SEQ ID NO: 665003 - DNA, 25 bp, Homo sapien
catcttccacatcacagtctgtaag

SEQ ID NO: 665004 - DNA, 25 bp, Homo sapien
agtctgtaaggcaactgtcctggag

SEQ ID NO: 665005 - DNA, 25 bp, Homo sapien
ctgtcctggaggttgtatgctgcat

SEQ ID NO: 665006 - DNA, 25 bp, Homo sapien
gaggttgtatgctgcatccactgac

SEQ ID NO: 665007 - DNA, 25 bp, Homo sapien
actgactcactgatgtcctcatggt

SEQ ID NO: 665008 - DNA, 25 bp, Homo sapien
gtcctcatggtccattcctgagaat

SEQ ID NO: 665009 - DNA, 25 bp, Homo sapien
ggctctcagatgaacttgtctggtc

SEQ ID NO: 665010 - DNA, 25 bp, Homo sapien
aatccctactgaaaaagacctgctt

SEQ ID NO: 665011 - DNA, 25 bp, Homo sapien
agatattttggccacaagaggttta

SEQ ID NO: 665012 - DNA, 25 bp, Homo sapien
tttggccacaagaggtttattagga

SEQ ID NO: 665013 - DNA, 25 bp, Homo sapien
gccacaagaggtttattaggaatat

SEQ ID NO: 665014 - DNA, 25 bp, Homo sapien
ggaatatactaaaaaacttgactga

SEQ ID NO: 665015 - DNA, 25 bp, Homo sapien
aacttgactgagaagacttttctgc

SEQ ID NO: 665016 - DNA, 25 bp, Homo sapien
tgagaagacttttctgcatgtgatc

SEQ ID NO: 665017 - DNA, 25 bp, Homo sapien
tttctgcatgtgatcatacttttta

SEQ ID NO: 665018 - DNA, 25 bp, Homo sapien
gcatgtgatcatactttttattaca

SEQ ID NO: 665019 - DNA, 25 bp, Homo sapien
gtgatcatactttttattacaaatt

SEQ ID NO: 665020 - DNA, 25 bp, Homo sapien
aacattttgtctgtattctaggaat

SEQ ID NO: 665021 - DNA, 25 bp, Homo sapien
tctgtattctaggaatagtcctgca

SEQ ID NO: 665022 - DNA, 25 bp, Homo sapien
aaccttgccacgactgacctgggtc

SEQ ID NO: 665023 - DNA, 25 bp, Homo sapien
actgacctgggtcatcaccatgtgc

SEQ ID NO: 665024 - DNA, 25 bp, Homo sapien
aagagccttggaatactgtatagac

SEQ ID NO: 665025 - DNA, 25 bp, Homo sapien
gtatagacccgtacagagttgttca

SEQ ID NO: 665026 - DNA, 25 bp, Homo sapien
gaggacgactataatagtttctcat

SEQ ID NO: 665027 - DNA, 25 bp, Homo sapien
taaacatcatgtctttggtattaag

SEQ ID NO: 665028 - DNA, 25 bp, Homo sapien
gtggcaattagatgaaacaacctga

SEQ ID NO: 665029 - DNA, 25 bp, Homo sapien
aacctgaaattctgtctgataccaa

SEQ ID NO: 665030 - DNA, 25 bp, Homo sapien
gataccaagattgaactttgctgag

SEQ ID NO: 665031 - DNA, 25 bp, Homo sapien
gagattactgtttcactcaccgaaa

SEQ ID NO: 665032 - DNA, 25 bp, Homo sapien
gtttcactcaccgaaaatatcagaa

SEQ ID NO: 665033 - DNA, 25 bp, Homo sapien
aactcctcaataaactacgagtgtt

SEQ ID NO: 665034 - DNA, 25 bp, Homo sapien
actacgagtgttaatacccgatgca

SEQ ID NO: 665035 - DNA, 25 bp, Homo sapien
acgagtgttaatacccgatgcaata

SEQ ID NO: 665036 - DNA, 25 bp, Homo sapien
atacccgatgcaataagatgtgatt

SEQ ID NO: 665037 - DNA, 25 bp, Homo sapien
gggtgcaggtacttcagaatcataa

SEQ ID NO: 665038 - DNA, 25 bp, Homo sapien
ttccacaaaactgtcagcattagac

SEQ ID NO: 665039 - DNA, 25 bp, Homo sapien
gggcgctcgggcttactcacattgc

SEQ ID NO: 665040 - DNA, 25 bp, Homo sapien
cgggcttactcacattgctcagttt

SEQ ID NO: 665041 - DNA, 25 bp, Homo sapien
aatcagtcttctccattgtgcacag

SEQ ID NO: 665042 - DNA, 25 bp, Homo sapien
agtcttctccattgtgcacaggaaa

SEQ ID NO: 665043 - DNA, 25 bp, Homo sapien
gtgcacaggaaagttatagtttgga

SEQ ID NO: 665044 - DNA, 25 bp, Homo sapien
ggagactcggagatatttactttct

SEQ ID NO: 665045 - DNA, 25 bp, Homo sapien
gagactcggagatatttactttctt

SEQ ID NO: 665046 - DNA, 25 bp, Homo sapien
gactcggagatatttactttcttgg

SEQ ID NO: 665047 - DNA, 25 bp, Homo sapien
ctcggagatatttactttcttggaa

SEQ ID NO: 665048 - DNA, 25 bp, Homo sapien
ggagatatttactttcttggaaaca

SEQ ID NO: 665049 - DNA, 25 bp, Homo sapien
gatatttactttcttggaaacacaa

SEQ ID NO: 665050 - DNA, 25 bp, Homo sapien
atttactttcttggaaacacaacag

SEQ ID NO: 665051 - DNA, 25 bp, Homo sapien
actttcttggaaacacaacagtcta

SEQ ID NO: 665052 - DNA, 25 bp, Homo sapien
tttcttggaaacacaacagtctatt

SEQ ID NO: 665053 - DNA, 25 bp, Homo sapien
tcttggaaacacaacagtctattaa

SEQ ID NO: 665054 - DNA, 25 bp, Homo sapien
tgggcacctataacctcagcctccc

SEQ ID NO: 665055 - DNA, 25 bp, Homo sapien
aaatctgtgggcattgtgaccacca

SEQ ID NO: 665056 - DNA, 25 bp, Homo sapien
atctgtgggcattgtgaccaccacg

SEQ ID NO: 665057 - DNA, 25 bp, Homo sapien
tgtgggcattgtgaccaccacgaga

SEQ ID NO: 665058 - DNA, 25 bp, Homo sapien
tgggcattgtgaccaccacgagagt

SEQ ID NO: 665059 - DNA, 25 bp, Homo sapien
ggcattgtgaccaccacgagagtga

SEQ ID NO: 665060 - DNA, 25 bp, Homo sapien
gcattgtgaccaccacgagagtgaa

SEQ ID NO: 665061 - DNA, 25 bp, Homo sapien
attgtgaccaccacgagagtgaacc

SEQ ID NO: 665062 - DNA, 25 bp, Homo sapien
tgtgaccaccacgagagtgaaccat

SEQ ID NO: 665063 - DNA, 25 bp, Homo sapien
gtgaccaccacgagagtgaaccatg

SEQ ID NO: 665064 - DNA, 25 bp, Homo sapien
gaccaccacgagagtgaaccatgcc

SEQ ID NO: 665065 - DNA, 25 bp, Homo sapien
accacgagagtgaaccatgccaccc

SEQ ID NO: 665066 - DNA, 25 bp, Homo sapien
agactctccccagttcattttcttg

SEQ ID NO: 665067 - DNA, 25 bp, Homo sapien
tctccccagttcattttcttgtcat

SEQ ID NO: 665068 - DNA, 25 bp, Homo sapien
attccatcccaataggctcccaaat

SEQ ID NO: 665069 - DNA, 25 bp, Homo sapien
atcccaataggctcccaaatcttaa

SEQ ID NO: 665070 - DNA, 25 bp, Homo sapien
gctcccaaatcttaacttgttccag

SEQ ID NO: 665071 - DNA, 25 bp, Homo sapien
aacttgttccagcatcagttcaaaa

SEQ ID NO: 665072 - DNA, 25 bp, Homo sapien
gttccagcatcagttcaaaagtttc

SEQ ID NO: 665073 - DNA, 25 bp, Homo sapien
aagtttcaagtccagagcctcatct

SEQ ID NO: 665074 - DNA, 25 bp, Homo sapien
gagcctcatctaatctcacctaggc

SEQ ID NO: 665075 - DNA, 25 bp, Homo sapien
catctaatctcacctaggccaggca

SEQ ID NO: 665076 - DNA, 25 bp, Homo sapien
ggcacagtggtcatgtctgtgatcc

SEQ ID NO: 665077 - DNA, 25 bp, Homo sapien
aaatttttagcagctctgaactgca

SEQ ID NO: 665078 - DNA, 25 bp, Homo sapien
tgaactgcaaactgtccagcttcca

SEQ ID NO: 665079 - DNA, 25 bp, Homo sapien
tggtgggtctggtcatgataacaaa

SEQ ID NO: 665080 - DNA, 25 bp, Homo sapien
gggttgatttatccattatctcata

SEQ ID NO: 665081 - DNA, 25 bp, Homo sapien
aaacatctgaacactctggtatgat

SEQ ID NO: 665082 - DNA, 25 bp, Homo sapien
ggtatgatgtttcccaaaggctaat

SEQ ID NO: 665083 - DNA, 25 bp, Homo sapien
ctgcttctccgggtatggaggttat

SEQ ID NO: 665084 - DNA, 25 bp, Homo sapien
tggaggttatttccctgtaaatcct

SEQ ID NO: 665085 - DNA, 25 bp, Homo sapien
tgtaaatcctcaccagaacccatgt

SEQ ID NO: 665086 - DNA, 25 bp, Homo sapien
gaacccatgtgctgattccctgtaa

SEQ ID NO: 665087 - DNA, 25 bp, Homo sapien
ttccctgtaatcttcccacaataaa

SEQ ID NO: 665088 - DNA, 25 bp, Homo sapien
atacccctttgctaaaggctctgcc

SEQ ID NO: 665089 - DNA, 25 bp, Homo sapien
ttgctgtcctctggactgtttagta

SEQ ID NO: 665090 - DNA, 25 bp, Homo sapien
gtttagtatgcagaaggaccagccc

SEQ ID NO: 665091 - DNA, 25 bp, Homo sapien
agatcaattgccaatcggctccaaa

SEQ ID NO: 665092 - DNA, 25 bp, Homo sapien
aatcggctccaaatcccctagatgt

SEQ ID NO: 665093 - DNA, 25 bp, Homo sapien
atcccctagatgtctcagcagcttg

SEQ ID NO: 665094 - DNA, 25 bp, Homo sapien
ttggcccagctgtaggagccacggc

SEQ ID NO: 665095 - DNA, 25 bp, Homo sapien
gccatggttggctctagatgctgct

SEQ ID NO: 665096 - DNA, 25 bp, Homo sapien
gatgctgctggctatatatattgaa

SEQ ID NO: 665097 - DNA, 25 bp, Homo sapien
ttgaacttgaagcatcggattacat

SEQ ID NO: 665098 - DNA, 25 bp, Homo sapien
gcatcggattacatgtttgttcaat

SEQ ID NO: 665099 - DNA, 25 bp, Homo sapien
gggcccattttgaggtggctgtgag

SEQ ID NO: 665100 - DNA, 25 bp, Homo sapien
gtgagtgtacttggggttccttcaa

SEQ ID NO: 665101 - DNA, 25 bp, Homo sapien
tgtacttggggttccttcaaggcca

SEQ ID NO: 665102 - DNA, 25 bp, Homo sapien
aggcccagcaggtcacctgcagaag

SEQ ID NO: 665103 - DNA, 25 bp, Homo sapien
caccccgtcctggaacaccattctt

SEQ ID NO: 665104 - DNA, 25 bp, Homo sapien
agaggaccaggcccaggcaaggctg

SEQ ID NO: 665105 - DNA, 25 bp, Homo sapien
aaggctgggaatgcttagccgacct

SEQ ID NO: 665106 - DNA, 25 bp, Homo sapien
gctgggaatgcttagccgacctgct

SEQ ID NO: 665107 - DNA, 25 bp, Homo sapien
tgggaatgcttagccgacctgctca

SEQ ID NO: 665108 - DNA, 25 bp, Homo sapien
agaggctgaggtgcccagggtgtca

SEQ ID NO: 665109 - DNA, 25 bp, Homo sapien
tgtcaggacggccaccctgaaggcc

SEQ ID NO: 665110 - DNA, 25 bp, Homo sapien
agtactttatggtttatctgttggc

SEQ ID NO: 665111 - DNA, 25 bp, Homo sapien
ctttatggtttatctgttggccatt

SEQ ID NO: 665112 - DNA, 25 bp, Homo sapien
caaatatcagtttagttttgtgcct

SEQ ID NO: 665113 - DNA, 25 bp, Homo sapien
ttgtgcctattttgaactgggttac

SEQ ID NO: 665114 - DNA, 25 bp, Homo sapien
gaactgggttactgttgtttttgct

SEQ ID NO: 665115 - DNA, 25 bp, Homo sapien
gtatatcaatctttcatcagatgta

SEQ ID NO: 665116 - DNA, 25 bp, Homo sapien
attgttcccttttctgtgcagaagg

SEQ ID NO: 665117 - DNA, 25 bp, Homo sapien
gttcccttttctgtgcagaaggttt

SEQ ID NO: 665118 - DNA, 25 bp, Homo sapien
gtttttagtttgatgcagtccagct

SEQ ID NO: 665119 - DNA, 25 bp, Homo sapien
gcagtccagcttgtttatgtttgct

SEQ ID NO: 665120 - DNA, 25 bp, Homo sapien
gtccagcttgtttatgtttgctttt

SEQ ID NO: 665121 - DNA, 25 bp, Homo sapien
gaaatttctcagtcatgatggaatg

SEQ ID NO: 665122 - DNA, 25 bp, Homo sapien
gggaggtattcattaagccaactgt

SEQ ID NO: 665123 - DNA, 25 bp, Homo sapien
aggtattcattaagccaactgtttc

SEQ ID NO: 665124 - DNA, 25 bp, Homo sapien
gttttgttaaactcactggcaccca

SEQ ID NO: 665125 - DNA, 25 bp, Homo sapien
ttgttaaactcactggcacccaaac

SEQ ID NO: 665126 - DNA, 25 bp, Homo sapien
ctggtggctcagtattagcatggca

SEQ ID NO: 665127 - DNA, 25 bp, Homo sapien
gctcagtattagcatggcaactcat

SEQ ID NO: 665128 - DNA, 25 bp, Homo sapien
tttcctttgagggtcctacactagg

SEQ ID NO: 665129 - DNA, 25 bp, Homo sapien
gagggtcctacactaggcaaactga

SEQ ID NO: 665130 - DNA, 25 bp, Homo sapien
ggcaaactgagggtgtgatcgtcaa

SEQ ID NO: 665131 - DNA, 25 bp, Homo sapien
gtgtgatcgtcaaagagaaatttct

SEQ ID NO: 665132 - DNA, 25 bp, Homo sapien
aattggctttacgttcatccccaca

SEQ ID NO: 665133 - DNA, 25 bp, Homo sapien
aatgaaaagatccaccccagttgat

SEQ ID NO: 665134 - DNA, 25 bp, Homo sapien
accccagttgatccaggcttcaggc

SEQ ID NO: 665135 - DNA, 25 bp, Homo sapien
aggcccaactctacagacccaggaa

SEQ ID NO: 665136 - DNA, 25 bp, Homo sapien
aggaaacaggcctaccatctgctaa

SEQ ID NO: 665137 - DNA, 25 bp, Homo sapien
atctgctaacacaggcaccaggcca

SEQ ID NO: 665138 - DNA, 25 bp, Homo sapien
agcctgcctgaggactttggcaaca

SEQ ID NO: 665139 - DNA, 25 bp, Homo sapien
aagttcacctgcagaccacactaga

SEQ ID NO: 665140 - DNA, 25 bp, Homo sapien
gacaccctacaaagagttgctggat

SEQ ID NO: 665141 - DNA, 25 bp, Homo sapien
tttccagataaagccggtatgcaag

SEQ ID NO: 665142 - DNA, 25 bp, Homo sapien
gtgcagacactaatgcactgcctaa

SEQ ID NO: 665143 - DNA, 25 bp, Homo sapien
ttctccctcctctaggaattcagca

SEQ ID NO: 665144 - DNA, 25 bp, Homo sapien
aggaattcagcattgccactctgat

SEQ ID NO: 665145 - DNA, 25 bp, Homo sapien
cactctgattggctggattttggga

SEQ ID NO: 665146 - DNA, 25 bp, Homo sapien
gacattgattgagccttgttttcta

SEQ ID NO: 665147 - DNA, 25 bp, Homo sapien
ttgttttctagtgggcaggaggctc

SEQ ID NO: 665148 - DNA, 25 bp, Homo sapien
gaggctctgtgtcttaaaggccact

SEQ ID NO: 665149 - DNA, 25 bp, Homo sapien
gcccagctgccaatgaatcagtact

SEQ ID NO: 665150 - DNA, 25 bp, Homo sapien
gaatcagtactttgtttccccaggt

SEQ ID NO: 665151 - DNA, 25 bp, Homo sapien
gtccctctagccaaacgttatcaaa

SEQ ID NO: 665152 - DNA, 25 bp, Homo sapien
atcaaatctcatccaacatgctcct

SEQ ID NO: 665153 - DNA, 25 bp, Homo sapien
ggctctccatttcagatgtctgtaa

SEQ ID NO: 665154 - DNA, 25 bp, Homo sapien
cagaggaattatcaagtttatgctt

SEQ ID NO: 665155 - DNA, 25 bp, Homo sapien
aagtttatgcttatattgtttgtta

SEQ ID NO: 665156 - DNA, 25 bp, Homo sapien
agaatgatgtttggcgtttaattat

SEQ ID NO: 665157 - DNA, 25 bp, Homo sapien
tggcgtttaattatgtgtggcaaca

SEQ ID NO: 665158 - DNA, 25 bp, Homo sapien
gaattctacttaaatcttgctttgt

SEQ ID NO: 665159 - DNA, 25 bp, Homo sapien
tctacttaaatcttgctttgttcta

SEQ ID NO: 665160 - DNA, 25 bp, Homo sapien
tatggtaagaaaataagccaccttc

SEQ ID NO: 665161 - DNA, 25 bp, Homo sapien
taagccaccttctacacatctttct

SEQ ID NO: 665162 - DNA, 25 bp, Homo sapien
ccttctacacatctttctcttataa

SEQ ID NO: 665163 - DNA, 25 bp, Homo sapien
tctacacatctttctcttataacat

SEQ ID NO: 665164 - DNA, 25 bp, Homo sapien
cacatctttctcttataacatctat

SEQ ID NO: 665165 - DNA, 25 bp, Homo sapien
ggagtttattcttagcacatggctt

SEQ ID NO: 665166 - DNA, 25 bp, Homo sapien
ttattcttagcacatggctttctat

SEQ ID NO: 665167 - DNA, 25 bp, Homo sapien
gccacatcacaatttgtacagttcc

SEQ ID NO: 665168 - DNA, 25 bp, Homo sapien
atttgtacagttccacataagtcta

SEQ ID NO: 665169 - DNA, 25 bp, Homo sapien
acataagtctaaatgcactcccctc

SEQ ID NO: 665170 - DNA, 25 bp, Homo sapien
aagaccgtgccccagaaggtgacaa

SEQ ID NO: 665171 - DNA, 25 bp, Homo sapien
cgtgccccagaaggtgacaacagta

SEQ ID NO: 665172 - DNA, 25 bp, Homo sapien
gacaacagtatctctgtaacagtgt

SEQ ID NO: 665173 - DNA, 25 bp, Homo sapien
aaaactaacatgtcacacctaccat

SEQ ID NO: 665174 - DNA, 25 bp, Homo sapien
acacctaccatcaaggtctacacat

SEQ ID NO: 665175 - DNA, 25 bp, Homo sapien
caaggtctacacatcttaagaatta

SEQ ID NO: 665176 - DNA, 25 bp, Homo sapien
taagttgaaacttcacttccaagat

SEQ ID NO: 665177 - DNA, 25 bp, Homo sapien
ggtgggcactttaagggatgattat

SEQ ID NO: 665178 - DNA, 25 bp, Homo sapien
tgattatgtcataggccagagccct

SEQ ID NO: 665179 - DNA, 25 bp, Homo sapien
atgtcataggccagagccctcatga

SEQ ID NO: 665180 - DNA, 25 bp, Homo sapien
atgaacgagatcagtgcccttctaa

SEQ ID NO: 665181 - DNA, 25 bp, Homo sapien
agaggcattgggagagacccctcac

SEQ ID NO: 665182 - DNA, 25 bp, Homo sapien
tcaccttttccatcatatgaggaca

SEQ ID NO: 665183 - DNA, 25 bp, Homo sapien
gacacagccaggaagcatcatccac

SEQ ID NO: 665184 - DNA, 25 bp, Homo sapien
gaagcatcatccacgaaccagaaaa

SEQ ID NO: 665185 - DNA, 25 bp, Homo sapien
acactgaatctgctgatgtcctgac

SEQ ID NO: 665186 - DNA, 25 bp, Homo sapien
gatgtcctgaccatggacttctgag

SEQ ID NO: 665187 - DNA, 25 bp, Homo sapien
ggagtcacaaaatagtatggctact

SEQ ID NO: 665188 - DNA, 25 bp, Homo sapien
catacagacactcatattatatata

SEQ ID NO: 665189 - DNA, 25 bp, Homo sapien
tattttgtcattatagggtggtttt

SEQ ID NO: 665190 - DNA, 25 bp, Homo sapien
ttctttgtgctcatttgcgttttct

SEQ ID NO: 665191 - DNA, 25 bp, Homo sapien
gtgctcatttgcgttttctaattgt

SEQ ID NO: 665192 - DNA, 25 bp, Homo sapien
catttgcgttttctaattgttctac

SEQ ID NO: 665193 - DNA, 25 bp, Homo sapien
tgcgttttctaattgttctacagta

SEQ ID NO: 665194 - DNA, 25 bp, Homo sapien
tctaattgttctacagtaagcatat

SEQ ID NO: 665195 - DNA, 25 bp, Homo sapien
gtaagcatatattactcctatgact

SEQ ID NO: 665196 - DNA, 25 bp, Homo sapien
gcatatattactcctatgacttttt

SEQ ID NO: 665197 - DNA, 25 bp, Homo sapien
aggaataaaggttgctctgaatctc

SEQ ID NO: 665198 - DNA, 25 bp, Homo sapien
gaagcataagttgcggcagaaactg

SEQ ID NO: 665199 - DNA, 25 bp, Homo sapien
ataagttgcggcagaaactggaaca

SEQ ID NO: 665200 - DNA, 25 bp, Homo sapien
aactggaacagatcatcagcctcgt

SEQ ID NO: 665201 - DNA, 25 bp, Homo sapien
tggaacagatcatcagcctcgtgtc

SEQ ID NO: 665202 - DNA, 25 bp, Homo sapien
gaacagatcatcagcctcgtgtcca

SEQ ID NO: 665203 - DNA, 25 bp, Homo sapien
cagcgacagctaaggtggtggaatc

SEQ ID NO: 665204 - DNA, 25 bp, Homo sapien
gggcttctcagtcctgtgccgtcct

SEQ ID NO: 665205 - DNA, 25 bp, Homo sapien
agtggctggctcaagcctgggtccc

SEQ ID NO: 665206 - DNA, 25 bp, Homo sapien
ccccttcattagtgccttgctttgg

SEQ ID NO: 665207 - DNA, 25 bp, Homo sapien
ttcattagtgccttgctttgggccc

SEQ ID NO: 665208 - DNA, 25 bp, Homo sapien
ttagtgccttgctttgggccctgca

SEQ ID NO: 665209 - DNA, 25 bp, Homo sapien
agggtctgcccactcaaaaggagaa

SEQ ID NO: 665210 - DNA, 25 bp, Homo sapien
gtctgcccactcaaaaggagaaagt

SEQ ID NO: 665211 - DNA, 25 bp, Homo sapien
aagatgctcagcaagggtagcaaac

SEQ ID NO: 665212 - DNA, 25 bp, Homo sapien
gcaagggtagcaaacgcagtcagat

SEQ ID NO: 665213 - DNA, 25 bp, Homo sapien
aacgcagtcagatgatacttcctga

SEQ ID NO: 665214 - DNA, 25 bp, Homo sapien
cctgacagcatccaagagcaagtct

SEQ ID NO: 665215 - DNA, 25 bp, Homo sapien
agcatccaagagcaagtctcaccac

SEQ ID NO: 665216 - DNA, 25 bp, Homo sapien
tctcaccaccacatctgtcaataaa

SEQ ID NO: 665217 - DNA, 25 bp, Homo sapien
aaacgaggagctgccaatttgtcta

SEQ ID NO: 665218 - DNA, 25 bp, Homo sapien
ggagctgccaatttgtctatttata

SEQ ID NO: 665219 - DNA, 25 bp, Homo sapien
gccaatttgtctatttataggtgcc

SEQ ID NO: 665220 - DNA, 25 bp, Homo sapien
tttcctcagctgtgatatgtgctat

SEQ ID NO: 665221 - DNA, 25 bp, Homo sapien
gatatgtgctatgtgtggaccttca

SEQ ID NO: 665222 - DNA, 25 bp, Homo sapien
gtgctatgtgtggaccttcagaaat

SEQ ID NO: 665223 - DNA, 25 bp, Homo sapien
ggaccttcagaaatggtgcagggct

SEQ ID NO: 665224 - DNA, 25 bp, Homo sapien
agggagctcagtaagcctctccgag

SEQ ID NO: 665225 - DNA, 25 bp, Homo sapien
tctccgaggctcaggattttgccag

SEQ ID NO: 665226 - DNA, 25 bp, Homo sapien
gattttgccagtttggaagagcact

SEQ ID NO: 665227 - DNA, 25 bp, Homo sapien
gagcactggatgatttggaagagca

SEQ ID NO: 665228 - DNA, 25 bp, Homo sapien
taaggcaggcttcttactctgtcac

SEQ ID NO: 665229 - DNA, 25 bp, Homo sapien
ttcttactctgtcacttcggacaag

SEQ ID NO: 665230 - DNA, 25 bp, Homo sapien
tgtcacttcggacaagtcccttcct

SEQ ID NO: 665231 - DNA, 25 bp, Homo sapien
aaaggtgagatgaagcagtgcttcc

SEQ ID NO: 665232 - DNA, 25 bp, Homo sapien
ttcctctcttaaaaggtacttctct

SEQ ID NO: 665233 - DNA, 25 bp, Homo sapien
cttctcttttcaaatcctcaactga

SEQ ID NO: 665234 - DNA, 25 bp, Homo sapien
atcctcaactgaaggcctattgctc

SEQ ID NO: 665235 - DNA, 25 bp, Homo sapien
aactgaaggcctattgctctccagc

SEQ ID NO: 665236 - DNA, 25 bp, Homo sapien
agccagatctttcttgaccactgtg

SEQ ID NO: 665237 - DNA, 25 bp, Homo sapien
gaccactgtggctttgaagtcctta

SEQ ID NO: 665238 - DNA, 25 bp, Homo sapien
tgtggctttgaagtccttatcgctt

SEQ ID NO: 665239 - DNA, 25 bp, Homo sapien
ttatcgcttccgtttcttggctggc

SEQ ID NO: 665240 - DNA, 25 bp, Homo sapien
cgtttcttggctggccatgcttttc

SEQ ID NO: 665241 - DNA, 25 bp, Homo sapien
ccctccccatggttgaaaatctgca

SEQ ID NO: 665242 - DNA, 25 bp, Homo sapien
accctcggaaactagctggaatgtg

SEQ ID NO: 665243 - DNA, 25 bp, Homo sapien
cagaccacagccttcaaccaaagaa

SEQ ID NO: 665244 - DNA, 25 bp, Homo sapien
ggtgaataaaggaccagccccatgt

SEQ ID NO: 665245 - DNA, 25 bp, Homo sapien
agccccatgtcctctagtgggatga

SEQ ID NO: 665246 - DNA, 25 bp, Homo sapien
gattctgaggttctacattgtcccc

SEQ ID NO: 665247 - DNA, 25 bp, Homo sapien
ggcccacagtggtaaccagctcata

SEQ ID NO: 665248 - DNA, 25 bp, Homo sapien
aaccagctcatagatgaattttctt

SEQ ID NO: 665249 - DNA, 25 bp, Homo sapien
ttttgacttttctcccttctatctc

SEQ ID NO: 665250 - DNA, 25 bp, Homo sapien
tttcctgacttcctcattggcgctt

SEQ ID NO: 665251 - DNA, 25 bp, Homo sapien
tcattggcgcttccacggatcatct

SEQ ID NO: 665252 - DNA, 25 bp, Homo sapien
cgcttccacggatcatctccaaaaa

SEQ ID NO: 665253 - DNA, 25 bp, Homo sapien
tccttcacgttctcttgtggaatca

SEQ ID NO: 665254 - DNA, 25 bp, Homo sapien
atcatgtgagacttcctttaggact

SEQ ID NO: 665255 - DNA, 25 bp, Homo sapien
tttaggacttatacacaggtggcat

SEQ ID NO: 665256 - DNA, 25 bp, Homo sapien
gcatcagctgggttgtgggatctca

SEQ ID NO: 665257 - DNA, 25 bp, Homo sapien
ggttgtgggatctcagacatctaat

SEQ ID NO: 665258 - DNA, 25 bp, Homo sapien
gacatctaattaatactgccagctt

SEQ ID NO: 665259 - DNA, 25 bp, Homo sapien
atactgccagcttgtgttgcctgaa

SEQ ID NO: 665260 - DNA, 25 bp, Homo sapien
tgtgttgcctgaaccaagaatctag

SEQ ID NO: 665261 - DNA, 25 bp, Homo sapien
gacactagcgattatgtgttttctc

SEQ ID NO: 665262 - DNA, 25 bp, Homo sapien
gttttctctgagtctatgtgaagta

SEQ ID NO: 665263 - DNA, 25 bp, Homo sapien
gaagtacacagcacaacctatggaa

SEQ ID NO: 665264 - DNA, 25 bp, Homo sapien
catgctgcaaatacgggaagcgggc

SEQ ID NO: 665265 - DNA, 25 bp, Homo sapien
atcagcttgacagcaaggccatgca

SEQ ID NO: 665266 - DNA, 25 bp, Homo sapien
agcaaggccatgcagccgcttccag

SEQ ID NO: 665267 - DNA, 25 bp, Homo sapien
aggctagaaagccaggccacttttg

SEQ ID NO: 665268 - DNA, 25 bp, Homo sapien
gctgcttttccctctgcgtcctgaa

SEQ ID NO: 665269 - DNA, 25 bp, Homo sapien
tgcgtcctgaagtctccaggacctc

SEQ ID NO: 665270 - DNA, 25 bp, Homo sapien
tccaggacctcgtcagggagtgtgt

SEQ ID NO: 665271 - DNA, 25 bp, Homo sapien
tcgtcagggagtgtgtgcccagcct

SEQ ID NO: 665272 - DNA, 25 bp, Homo sapien
ggcggccaacgcctcaggcacaaat

SEQ ID NO: 665273 - DNA, 25 bp, Homo sapien
ctcaggcacaaatccccagagggtc

SEQ ID NO: 665274 - DNA, 25 bp, Homo sapien
ccagagggtcctgccgcataggctg

SEQ ID NO: 665275 - DNA, 25 bp, Homo sapien
gctgccttctattaaggtacccttt

SEQ ID NO: 665276 - DNA, 25 bp, Homo sapien
gtaccctttctgtggataccttcaa

SEQ ID NO: 665277 - DNA, 25 bp, Homo sapien
cttcaagttccagcaccaaatatga

SEQ ID NO: 665278 - DNA, 25 bp, Homo sapien
atatgaaggcgactgccatcaccag

SEQ ID NO: 665279 - DNA, 25 bp, Homo sapien
ccctacatgaggtcaaatccctgga

SEQ ID NO: 665280 - DNA, 25 bp, Homo sapien
aaatccctggatggcatataacaca

SEQ ID NO: 665281 - DNA, 25 bp, Homo sapien
tggcatataacacactagagcaatt

SEQ ID NO: 665282 - DNA, 25 bp, Homo sapien
gaggctacatgatgagtgacgtcac

SEQ ID NO: 665283 - DNA, 25 bp, Homo sapien
gtgacgtcacgacagattgagtaca

SEQ ID NO: 665284 - DNA, 25 bp, Homo sapien
gtacagagccaactatgagaatcca

SEQ ID NO: 665285 - DNA, 25 bp, Homo sapien
gaatccagctgccttctattaaggt

SEQ ID NO: 665286 - DNA, 25 bp, Homo sapien
gcctatttccatcacacacttgagg

SEQ ID NO: 665287 - DNA, 25 bp, Homo sapien
gactctatagctgtacaactccttg

SEQ ID NO: 665288 - DNA, 25 bp, Homo sapien
atagctgtacaactccttggctctg

SEQ ID NO: 665289 - DNA, 25 bp, Homo sapien
acaactccttggctctgcttttgtt

SEQ ID NO: 665290 - DNA, 25 bp, Homo sapien
tgcttttgttcctgagggcccctta

SEQ ID NO: 665291 - DNA, 25 bp, Homo sapien
aagactcagatgctctcaacccctt

SEQ ID NO: 665292 - DNA, 25 bp, Homo sapien
agatgctctcaaccccttcctggag

SEQ ID NO: 665293 - DNA, 25 bp, Homo sapien
caggcagggtgcctctcttgctcaa

SEQ ID NO: 665294 - DNA, 25 bp, Homo sapien
tcttgctcaactcctggagctatat

SEQ ID NO: 665295 - DNA, 25 bp, Homo sapien
caactcctggagctatatgtttttt

SEQ ID NO: 665296 - DNA, 25 bp, Homo sapien
gatcatgagcattgactattctaaa

SEQ ID NO: 665297 - DNA, 25 bp, Homo sapien
gttgccactcacctgaggatgtggg

SEQ ID NO: 665298 - DNA, 25 bp, Homo sapien
gatgtggggtcttgccatttgccca

SEQ ID NO: 665299 - DNA, 25 bp, Homo sapien
tgagccactacacacagcccggagt

SEQ ID NO: 665300 - DNA, 25 bp, Homo sapien
gccactacacacagcccggagtttt

SEQ ID NO: 665301 - DNA, 25 bp, Homo sapien
aaatactcaattaaaatgcttcatt

SEQ ID NO: 665302 - DNA, 25 bp, Homo sapien
atgcttcatttaagtgtatgtctct

SEQ ID NO: 665303 - DNA, 25 bp, Homo sapien
ttcatttaagtgtatgtctctaaga

SEQ ID NO: 665304 - DNA, 25 bp, Homo sapien
aaaacgagtggcagtagccctgaaa

SEQ ID NO: 665305 - DNA, 25 bp, Homo sapien
aacgagtggcagtagccctgaaaca

SEQ ID NO: 665306 - DNA, 25 bp, Homo sapien
cgagtggcagtagccctgaaacagc

SEQ ID NO: 665307 - DNA, 25 bp, Homo sapien
tagccctgaaacagccacttctggt

SEQ ID NO: 665308 - DNA, 25 bp, Homo sapien
cctttttatagtcttctacacagtt

SEQ ID NO: 665309 - DNA, 25 bp, Homo sapien
atagtcttctacacagttctcttaa

SEQ ID NO: 665310 - DNA, 25 bp, Homo sapien
agtcttctacacagttctcttaaaa

SEQ ID NO: 665311 - DNA, 25 bp, Homo sapien
ttctacacagttctcttaaaaggct

SEQ ID NO: 665312 - DNA, 25 bp, Homo sapien
acacagttctcttaaaaggctacta

SEQ ID NO: 665313 - DNA, 25 bp, Homo sapien
taaaaggctactaataccccgcgtg

SEQ ID NO: 665314 - DNA, 25 bp, Homo sapien
aaaggctactaataccccgcgtgct

SEQ ID NO: 665315 - DNA, 25 bp, Homo sapien
ataccccgcgtgctctgcgttgtta

SEQ ID NO: 665316 - DNA, 25 bp, Homo sapien
tcaaagtgagtatgtcaaaagatca

SEQ ID NO: 665317 - DNA, 25 bp, Homo sapien
gtcaaaagatcagttataaagccct

SEQ ID NO: 665318 - DNA, 25 bp, Homo sapien
agatcagttataaagccctttttat

SEQ ID NO: 665319 - DNA, 25 bp, Homo sapien
tttcgctcagcaccacaagagcaga

SEQ ID NO: 665320 - DNA, 25 bp, Homo sapien
gagcagatctctgccagcaagctta

SEQ ID NO: 665321 - DNA, 25 bp, Homo sapien
agcaagcttatctggccatcagcca

SEQ ID NO: 665322 - DNA, 25 bp, Homo sapien
cagggacagagctgcattgtggcaa

SEQ ID NO: 665323 - DNA, 25 bp, Homo sapien
gagcacatggtttctgcctccagca

SEQ ID NO: 665324 - DNA, 25 bp, Homo sapien
ctgcctccagcatgctagatttgta

SEQ ID NO: 665325 - DNA, 25 bp, Homo sapien
ttttcccttgggtagattccagatg

SEQ ID NO: 665326 - DNA, 25 bp, Homo sapien
atgttgtataacttgtgcctttcta

SEQ ID NO: 665327 - DNA, 25 bp, Homo sapien
gggacttgtctttgttatgagcatg

SEQ ID NO: 665328 - DNA, 25 bp, Homo sapien
gtacaatgtgggtcgcagttaagca

SEQ ID NO: 665329 - DNA, 25 bp, Homo sapien
gttaagcactgtcaaatagcctcct

SEQ ID NO: 665330 - DNA, 25 bp, Homo sapien
gcagagacctgggtaattgtggcct

SEQ ID NO: 665331 - DNA, 25 bp, Homo sapien
agagacctgggtaattgtggccttg

SEQ ID NO: 665332 - DNA, 25 bp, Homo sapien
ctgggtaattgtggccttggaggaa

SEQ ID NO: 665333 - DNA, 25 bp, Homo sapien
caggaggtgaagacgggcaaggcaa

SEQ ID NO: 665334 - DNA, 25 bp, Homo sapien
gcaaggcaagccagttctttgggct

SEQ ID NO: 665335 - DNA, 25 bp, Homo sapien
tgtgcactgtggcaggtgatggtgg

SEQ ID NO: 665336 - DNA, 25 bp, Homo sapien
aggaacagacactcagcactgaagc

SEQ ID NO: 665337 - DNA, 25 bp, Homo sapien
aacagacactcagcactgaagcaga

SEQ ID NO: 665338 - DNA, 25 bp, Homo sapien
gacactcagcactgaagcagagacc

SEQ ID NO: 665339 - DNA, 25 bp, Homo sapien
tcagcactgaagcagagacctgggt

SEQ ID NO: 665340 - DNA, 25 bp, Homo sapien
gcactgaagcagagacctgggtaat

SEQ ID NO: 665341 - DNA, 25 bp, Homo sapien
aaacttgacccttaccttatgccat

SEQ ID NO: 665342 - DNA, 25 bp, Homo sapien
atgaatcaggaggtattcctttttc

SEQ ID NO: 665343 - DNA, 25 bp, Homo sapien
tttcctgactgcctttgaactggga

SEQ ID NO: 665344 - DNA, 25 bp, Homo sapien
ctgactgcctttgaactgggacatc

SEQ ID NO: 665345 - DNA, 25 bp, Homo sapien
aaacatcagcttttcttgagtctca

SEQ ID NO: 665346 - DNA, 25 bp, Homo sapien
ttgagtctcaacctgctgttctttg

SEQ ID NO: 665347 - DNA, 25 bp, Homo sapien
tcaacctgctgttctttggactaga

SEQ ID NO: 665348 - DNA, 25 bp, Homo sapien
accattggctctcttgggtttccag

SEQ ID NO: 665349 - DNA, 25 bp, Homo sapien
gggtttccagcttaacaactgtaga

SEQ ID NO: 665350 - DNA, 25 bp, Homo sapien
gtagatcttggaacttggcagcttt

SEQ ID NO: 665351 - DNA, 25 bp, Homo sapien
acttggcagctttcataaatacatg

SEQ ID NO: 665352 - DNA, 25 bp, Homo sapien
ttgtggtcctggcatctgctgtaca

SEQ ID NO: 665353 - DNA, 25 bp, Homo sapien
tggcatctgctgtacatgtctgtag

SEQ ID NO: 665354 - DNA, 25 bp, Homo sapien
acatgtctgtaggtggttttgtgag

SEQ ID NO: 665355 - DNA, 25 bp, Homo sapien
tgaattagctccagcttgtagtaac

SEQ ID NO: 665356 - DNA, 25 bp, Homo sapien
tgtttgtaccgttataggcctgata

SEQ ID NO: 665357 - DNA, 25 bp, Homo sapien
gtggttttaaacaatgccagtcaaa

SEQ ID NO: 665358 - DNA, 25 bp, Homo sapien
aatctgtttgtttacattgctcacg

SEQ ID NO: 665359 - DNA, 25 bp, Homo sapien
gctcacgattttctaaaggcacatg

SEQ ID NO: 665360 - DNA, 25 bp, Homo sapien
taaaggcacatgatctatctgaaga

SEQ ID NO: 665361 - DNA, 25 bp, Homo sapien
gaggcttatcggtgagtttactgac

SEQ ID NO: 665362 - DNA, 25 bp, Homo sapien
gtttactgacagcattgtgtattgt

SEQ ID NO: 665363 - DNA, 25 bp, Homo sapien
gagaaatgaaggatcaagccttcct

SEQ ID NO: 665364 - DNA, 25 bp, Homo sapien
gggctgcccaagaatgggatacaat

SEQ ID NO: 665365 - DNA, 25 bp, Homo sapien
ggttttagatttttccacggctcag

SEQ ID NO: 665366 - DNA, 25 bp, Homo sapien
tagatttttccacggctcagtattc

SEQ ID NO: 665367 - DNA, 25 bp, Homo sapien
tttccacggctcagtattctaatgt

SEQ ID NO: 665368 - DNA, 25 bp, Homo sapien
acggctcagtattctaatgtgtgta

SEQ ID NO: 665369 - DNA, 25 bp, Homo sapien
aatgtgtgtattgggctgtgtttgt

SEQ ID NO: 665370 - DNA, 25 bp, Homo sapien
tattgggctgtgtttgtgacttaaa

SEQ ID NO: 665371 - DNA, 25 bp, Homo sapien
gggtgaactgtattcatccaaggca

SEQ ID NO: 665372 - DNA, 25 bp, Homo sapien
gaactgtattcatccaaggcaggaa

SEQ ID NO: 665373 - DNA, 25 bp, Homo sapien
aaggcaggaaaagattaccatacaa

SEQ ID NO: 665374 - DNA, 25 bp, Homo sapien
cttgtgattgctttgaccaacagaa

SEQ ID NO: 665375 - DNA, 25 bp, Homo sapien
ataccttttctgagcctgggaacaa

SEQ ID NO: 665376 - DNA, 25 bp, Homo sapien
gagaccctgaatgattttggcctgt

SEQ ID NO: 665377 - DNA, 25 bp, Homo sapien
gattttggcctgtctcttggagttc

SEQ ID NO: 665378 - DNA, 25 bp, Homo sapien
ctgctgtcctgtgaataaacctgtg

SEQ ID NO: 665379 - DNA, 25 bp, Homo sapien
gcagaatcagctcagttgtcccaga

SEQ ID NO: 665380 - DNA, 25 bp, Homo sapien
ttgtcccagatgtgtgagaaagccc

SEQ ID NO: 665381 - DNA, 25 bp, Homo sapien
gagaaagccccaccaagattggcag

SEQ ID NO: 665382 - DNA, 25 bp, Homo sapien
aagattggcagagccacctagcctc

SEQ ID NO: 665383 - DNA, 25 bp, Homo sapien
gaaatatatgcaaaccccaccaacc

SEQ ID NO: 665384 - DNA, 25 bp, Homo sapien
agctcaggtgatcagaactgcccag

SEQ ID NO: 665385 - DNA, 25 bp, Homo sapien
gtcctggatgatgtgtatgcgaaac

SEQ ID NO: 665386 - DNA, 25 bp, Homo sapien
tatgcgaaacactggcactcggaca

SEQ ID NO: 665387 - DNA, 25 bp, Homo sapien
gaagggtgacatctgccactatgct

SEQ ID NO: 665388 - DNA, 25 bp, Homo sapien
ggtgtcctgcatgtctcttctctaa

SEQ ID NO: 665389 - DNA, 25 bp, Homo sapien
gagtgcagatattttatatgcctca

SEQ ID NO: 665390 - DNA, 25 bp, Homo sapien
tatgcctcatcagggtcttcaagag

SEQ ID NO: 665391 - DNA, 25 bp, Homo sapien
ggtcttcaagagattgggcccgaga

SEQ ID NO: 665392 - DNA, 25 bp, Homo sapien
ttgggcccgagacattgggattccc

SEQ ID NO: 665393 - DNA, 25 bp, Homo sapien
ggattcccttctcatatacgtttga

SEQ ID NO: 665394 - DNA, 25 bp, Homo sapien
gaacatatgggtttgttctgccaga

SEQ ID NO: 665395 - DNA, 25 bp, Homo sapien
gttctgccagaagctcagatccagc

SEQ ID NO: 665396 - DNA, 25 bp, Homo sapien
tctctgaagctagaagatctggtgt

SEQ ID NO: 665397 - DNA, 25 bp, Homo sapien
aagatctggtgtttcgactttgccc

SEQ ID NO: 665398 - DNA, 25 bp, Homo sapien
ccagccaactgaccacattgagtga

SEQ ID NO: 665399 - DNA, 25 bp, Homo sapien
gtgcttagtttacactgaataccaa

SEQ ID NO: 665400 - DNA, 25 bp, Homo sapien
tattagcaggattttggctggaggc

SEQ ID NO: 665401 - DNA, 25 bp, Homo sapien
ggccacttgtgacctctattgaatg

SEQ ID NO: 665402 - DNA, 25 bp, Homo sapien
attgaatgtaacttcctcactcagg

SEQ ID NO: 665403 - DNA, 25 bp, Homo sapien
ctcactcaggagttgatatggaacc

SEQ ID NO: 665404 - DNA, 25 bp, Homo sapien
tatggaaccactcactcctattggc

SEQ ID NO: 665405 - DNA, 25 bp, Homo sapien
actcctattggctcagtgcccagaa

SEQ ID NO: 665406 - DNA, 25 bp, Homo sapien
cagtgcccagaaggcctcagagaga

SEQ ID NO: 665407 - DNA, 25 bp, Homo sapien
attttgtctgtgttatgtagaatgc

SEQ ID NO: 665408 - DNA, 25 bp, Homo sapien
agaatgcagattccctacgtttttc

SEQ ID NO: 665409 - DNA, 25 bp, Homo sapien
tgccccgtttatgtcatcttatgta

SEQ ID NO: 665410 - DNA, 25 bp, Homo sapien
gtcatcttatgtaaaaacatgcaga

SEQ ID NO: 665411 - DNA, 25 bp, Homo sapien
gtaaaaacatgcagattcatggagc

SEQ ID NO: 665412 - DNA, 25 bp, Homo sapien
aaaggcatgactatcttttcccacc

SEQ ID NO: 665413 - DNA, 25 bp, Homo sapien
aggcatgactatcttttcccaccca

SEQ ID NO: 665414 - DNA, 25 bp, Homo sapien
gaaagatgtctgtctcctgggtgcg

SEQ ID NO: 665415 - DNA, 25 bp, Homo sapien
aaagatgtctgtctcctgggtgcgt

SEQ ID NO: 665416 - DNA, 25 bp, Homo sapien
aagatgtctgtctcctgggtgcgtg

SEQ ID NO: 665417 - DNA, 25 bp, Homo sapien
ctgggtgcgtgtccttaactttggc

SEQ ID NO: 665418 - DNA, 25 bp, Homo sapien
acaccagagtttatagtatagtaga

SEQ ID NO: 665419 - DNA, 25 bp, Homo sapien
ttttacagatacagtgaatacaaac

SEQ ID NO: 665420 - DNA, 25 bp, Homo sapien
gtgaatacaaacaaatgtccaaaat

SEQ ID NO: 665421 - DNA, 25 bp, Homo sapien
actgtagaaagtactaaggcactaa

SEQ ID NO: 665422 - DNA, 25 bp, Homo sapien
agtactaaggcactaacagtttcag

SEQ ID NO: 665423 - DNA, 25 bp, Homo sapien
actaaggcactaacagtttcagatg

SEQ ID NO: 665424 - DNA, 25 bp, Homo sapien
taaagcagtgttgattgtcgagaat

SEQ ID NO: 665425 - DNA, 25 bp, Homo sapien
cagtgttgattgtcgagaataattc

SEQ ID NO: 665426 - DNA, 25 bp, Homo sapien
gaatcaagagatgatgtctttttga

SEQ ID NO: 665427 - DNA, 25 bp, Homo sapien
gtctttttgaagcacagttacattc

SEQ ID NO: 665428 - DNA, 25 bp, Homo sapien
tgaagcacagttacattcatgttat

SEQ ID NO: 665429 - DNA, 25 bp, Homo sapien
ttgttataattagtgcctccctaat

SEQ ID NO: 665430 - DNA, 25 bp, Homo sapien
tagtgcctccctaatattttcccga

SEQ ID NO: 665431 - DNA, 25 bp, Homo sapien
gcctccctaatattttcccgagtat

SEQ ID NO: 665432 - DNA, 25 bp, Homo sapien
ttttcccgagtatagctattctccc

SEQ ID NO: 665433 - DNA, 25 bp, Homo sapien
gagtatagctattctccccttccca

SEQ ID NO: 665434 - DNA, 25 bp, Homo sapien
gctattctccccttcccagtttggt

SEQ ID NO: 665435 - DNA, 25 bp, Homo sapien
cagaattatattccacaatcttagt

SEQ ID NO: 665436 - DNA, 25 bp, Homo sapien
tattccacaatcttagtaactttca

SEQ ID NO: 665437 - DNA, 25 bp, Homo sapien
aagtaagtaacttttgctttcagtg

SEQ ID NO: 665438 - DNA, 25 bp, Homo sapien
aagtaacttttgctttcagtgaaat

SEQ ID NO: 665439 - DNA, 25 bp, Homo sapien
tattctcatattgcatagtactgtt

SEQ ID NO: 665440 - DNA, 25 bp, Homo sapien
tacaaagttgaattatgggcagctc

SEQ ID NO: 665441 - DNA, 25 bp, Homo sapien
attatgggcagctcaattcatcccc

SEQ ID NO: 665442 - DNA, 25 bp, Homo sapien
ggcagacaagagatggcaggtccaa

SEQ ID NO: 665443 - DNA, 25 bp, Homo sapien
aagagatggcaggtccaagttatgc

SEQ ID NO: 665444 - DNA, 25 bp, Homo sapien
caagttatgcctatattacacagta

SEQ ID NO: 665445 - DNA, 25 bp, Homo sapien
gtgttttgttattgcttccaagttc

SEQ ID NO: 665446 - DNA, 25 bp, Homo sapien
caagttcacacaaatgcttcttact

SEQ ID NO: 665447 - DNA, 25 bp, Homo sapien
atattggtcacattcactattctta

SEQ ID NO: 665448 - DNA, 25 bp, Homo sapien
attcactattcttatttggtactca

SEQ ID NO: 665449 - DNA, 25 bp, Homo sapien
attcttatttggtactcattagtga

SEQ ID NO: 665450 - DNA, 25 bp, Homo sapien
tcattagtgactttgtactctctta

SEQ ID NO: 665451 - DNA, 25 bp, Homo sapien
aaggagattgactgttagtttctta

SEQ ID NO: 665452 - DNA, 25 bp, Homo sapien
tagtttcttaggattggactaacaa

SEQ ID NO: 665453 - DNA, 25 bp, Homo sapien
aaagtggaggttgttacttacactg

SEQ ID NO: 665454 - DNA, 25 bp, Homo sapien
aacaaccagagctgtgtcactcaga

SEQ ID NO: 665455 - DNA, 25 bp, Homo sapien
gagctgtgtcactcagaaggctgaa

SEQ ID NO: 665456 - DNA, 25 bp, Homo sapien
aaggctgaaaagaatcaggctgaca

SEQ ID NO: 665457 - DNA, 25 bp, Homo sapien
caggctgacagcataatgcagtgaa

SEQ ID NO: 665458 - DNA, 25 bp, Homo sapien
gtttcatctgaaatttgaagggctt

SEQ ID NO: 665459 - DNA, 25 bp, Homo sapien
tgaagggctttacaactcttctcct

SEQ ID NO: 665460 - DNA, 25 bp, Homo sapien
tacaactcttctcctttaactaact

SEQ ID NO: 665461 - DNA, 25 bp, Homo sapien
tctcctttaactaacttaccatcct

SEQ ID NO: 665462 - DNA, 25 bp, Homo sapien
agcacattgataggagcgatctctc

SEQ ID NO: 665463 - DNA, 25 bp, Homo sapien
agagcctccccagagaacagagcta

SEQ ID NO: 665464 - DNA, 25 bp, Homo sapien
aacagagctacgcagagcatcctca

SEQ ID NO: 665465 - DNA, 25 bp, Homo sapien
ctggtgagcacctttgtgtcttctt

SEQ ID NO: 665466 - DNA, 25 bp, Homo sapien
ttgtgtcttcttacactctctcctg

SEQ ID NO: 665467 - DNA, 25 bp, Homo sapien
cttttccaagtttgtatggctcttt

SEQ ID NO: 665468 - DNA, 25 bp, Homo sapien
ttgtatggctcttttggataatccc

SEQ ID NO: 665469 - DNA, 25 bp, Homo sapien
ggataatcccaatagtttactggtg

SEQ ID NO: 665470 - DNA, 25 bp, Homo sapien
gtttactggtgaacacttcagcctt

SEQ ID NO: 665471 - DNA, 25 bp, Homo sapien
agccttaatgagtgtatgtttccca

SEQ ID NO: 665472 - DNA, 25 bp, Homo sapien
tgtgaccccagtgtatacaggtttt

SEQ ID NO: 665473 - DNA, 25 bp, Homo sapien
aggcatcaaacatcgttttgtccca

SEQ ID NO: 665474 - DNA, 25 bp, Homo sapien
tcaaacatcgttttgtcccaagctc

SEQ ID NO: 665475 - DNA, 25 bp, Homo sapien
gacagtgttggagcactctttcaag

SEQ ID NO: 665476 - DNA, 25 bp, Homo sapien
actctttcaagaagtgctgcataac

SEQ ID NO: 665477 - DNA, 25 bp, Homo sapien
tcaagaagtgctgcataaccagtac

SEQ ID NO: 665478 - DNA, 25 bp, Homo sapien
ataaccagtactcttgacaacaccg

SEQ ID NO: 665479 - DNA, 25 bp, Homo sapien
gacaacaccgggagagacgttctgt

SEQ ID NO: 665480 - DNA, 25 bp, Homo sapien
cgggagagacgttctgtggaaaaat

SEQ ID NO: 665481 - DNA, 25 bp, Homo sapien
gaaaaatgcagacatcaatgactgt

SEQ ID NO: 665482 - DNA, 25 bp, Homo sapien
taaccaatttatttcacacattttc

SEQ ID NO: 665483 - DNA, 25 bp, Homo sapien
cacattttctttacatatgcacaag

SEQ ID NO: 665484 - DNA, 25 bp, Homo sapien
tgtccgggccacactgctttgtaaa

SEQ ID NO: 665485 - DNA, 25 bp, Homo sapien
cgggccacactgctttgtaaatatc

SEQ ID NO: 665486 - DNA, 25 bp, Homo sapien
taaatatcttgactgtttctcccgg

SEQ ID NO: 665487 - DNA, 25 bp, Homo sapien
ttgactgtttctcccggccagtgaa

SEQ ID NO: 665488 - DNA, 25 bp, Homo sapien
tcccggccagtgaacgtcttggtgt

SEQ ID NO: 665489 - DNA, 25 bp, Homo sapien
gtcatgtatgtgacgtgtgtttgca

SEQ ID NO: 665490 - DNA, 25 bp, Homo sapien
gtgtcttcgtgtgtgtatttgcctc

SEQ ID NO: 665491 - DNA, 25 bp, Homo sapien
gtgtgtgtatttgcctctcttctca

SEQ ID NO: 665492 - DNA, 25 bp, Homo sapien
tgcctctcttctcatcggaaggagt

SEQ ID NO: 665493 - DNA, 25 bp, Homo sapien
aaccagtaggagaccctgtgtttgt

SEQ ID NO: 665494 - DNA, 25 bp, Homo sapien
taggagaccctgtgtttgtttggtt

SEQ ID NO: 665495 - DNA, 25 bp, Homo sapien
attcagaacgtcctaaaagctccac

SEQ ID NO: 665496 - DNA, 25 bp, Homo sapien
aaagctccacaaaatcttcatcatg

SEQ ID NO: 665497 - DNA, 25 bp, Homo sapien
atcatgagtgattaccagaagctgg

SEQ ID NO: 665498 - DNA, 25 bp, Homo sapien
gaagctggaagttacgctgctttac

SEQ ID NO: 665499 - DNA, 25 bp, Homo sapien
ttacgctgctttacttgggtgagtt

SEQ ID NO: 665500 - DNA, 25 bp, Homo sapien
agcatcaccactcggtagttataat

SEQ ID NO: 665501 - DNA, 25 bp, Homo sapien
gtagttataattccgccttttatca

SEQ ID NO: 665502 - DNA, 25 bp, Homo sapien
aattccgccttttatcagaagctga

SEQ ID NO: 665503 - DNA, 25 bp, Homo sapien
gaagctgatacattttcatcggcat

SEQ ID NO: 665504 - DNA, 25 bp, Homo sapien
atcggcatcagaccgtatttctatg

SEQ ID NO: 665505 - DNA, 25 bp, Homo sapien
atgtattcaatatctgacacaggaa

SEQ ID NO: 665506 - DNA, 25 bp, Homo sapien
taaatatacataaattcgcaaggat

SEQ ID NO: 665507 - DNA, 25 bp, Homo sapien
gacaacagcaggtagaaatgacaac

SEQ ID NO: 665508 - DNA, 25 bp, Homo sapien
gaaatgacaacacattgtgcctaga

SEQ ID NO: 665509 - DNA, 25 bp, Homo sapien
gacaacacattgtgcctagaaacac

SEQ ID NO: 665510 - DNA, 25 bp, Homo sapien
aaaccctactagaaatctactcaat

SEQ ID NO: 665511 - DNA, 25 bp, Homo sapien
ctactcaatcataagaaaatctggc

SEQ ID NO: 665512 - DNA, 25 bp, Homo sapien
gaaaatctggcaaactggttgaata

SEQ ID NO: 665513 - DNA, 25 bp, Homo sapien
agatcagtagcttttctctagtcag

SEQ ID NO: 665514 - DNA, 25 bp, Homo sapien
cagtagcttttctctagtcagatga

SEQ ID NO: 665515 - DNA, 25 bp, Homo sapien
gcttttctctagtcagatgagagcc

SEQ ID NO: 665516 - DNA, 25 bp, Homo sapien
ctagtcagatgagagccaagaaaaa

SEQ ID NO: 665517 - DNA, 25 bp, Homo sapien
taccttacttgtcaccagctccaag

SEQ ID NO: 665518 - DNA, 25 bp, Homo sapien
acagcagttcagaagtctcattaca

SEQ ID NO: 665519 - DNA, 25 bp, Homo sapien
agaagtctcattacacaatctggga

SEQ ID NO: 665520 - DNA, 25 bp, Homo sapien
ctcattacacaatctgggacaagcc

SEQ ID NO: 665521 - DNA, 25 bp, Homo sapien
tgcaatgccagtactcacccaagag

SEQ ID NO: 665522 - DNA, 25 bp, Homo sapien
atgccagtactcacccaagagaggg

SEQ ID NO: 665523 - DNA, 25 bp, Homo sapien
atcctggtgtcagcagacatctcca

SEQ ID NO: 665524 - DNA, 25 bp, Homo sapien
gtgtcagcagacatctccaagtcgg

SEQ ID NO: 665525 - DNA, 25 bp, Homo sapien
agcagacatctccaagtcggtgtac

SEQ ID NO: 665526 - DNA, 25 bp, Homo sapien
gacatctccaagtcggtgtacctta

SEQ ID NO: 665527 - DNA, 25 bp, Homo sapien
agtcggtgtaccttacttgtcacca

SEQ ID NO: 665528 - DNA, 25 bp, Homo sapien
gtgactttgtcacctggtaaaggaa

SEQ ID NO: 665529 - DNA, 25 bp, Homo sapien
ggaaccagtgctttgctggatcaca

SEQ ID NO: 665530 - DNA, 25 bp, Homo sapien
tgctggatcacagcagaatcccttg

SEQ ID NO: 665531 - DNA, 25 bp, Homo sapien
ggtgccagcattggttccagggaca

SEQ ID NO: 665532 - DNA, 25 bp, Homo sapien
ttaaatggcccgcataggctgccgt

SEQ ID NO: 665533 - DNA, 25 bp, Homo sapien
cctccactctgtcggctctttggga

SEQ ID NO: 665534 - DNA, 25 bp, Homo sapien
gctctttgggagctggacaacacat

SEQ ID NO: 665535 - DNA, 25 bp, Homo sapien
gctggacaacacatctcttattttt

SEQ ID NO: 665536 - DNA, 25 bp, Homo sapien
tgtctctctcaaaactcttagccgg

SEQ ID NO: 665537 - DNA, 25 bp, Homo sapien
tcaaaactcttagccgggtaattat

SEQ ID NO: 665538 - DNA, 25 bp, Homo sapien
tacttgcttaaaccctcaaataatg

SEQ ID NO: 665539 - DNA, 25 bp, Homo sapien
caacctgcccaacattttctgctgg

SEQ ID NO: 665540 - DNA, 25 bp, Homo sapien
gcccaacattttctgctggccctgt

SEQ ID NO: 665541 - DNA, 25 bp, Homo sapien
tggccctgtcttacctcatgactaa

SEQ ID NO: 665542 - DNA, 25 bp, Homo sapien
tcatgactaagagagccttcctagg

SEQ ID NO: 665543 - DNA, 25 bp, Homo sapien
taagagagccttcctaggtctggaa

SEQ ID NO: 665544 - DNA, 25 bp, Homo sapien
tcctaggtctggaaggtagcagtca

SEQ ID NO: 665545 - DNA, 25 bp, Homo sapien
aaggtagcagtcagtctgttctgga

SEQ ID NO: 665546 - DNA, 25 bp, Homo sapien
gagagagacaccagtgttttcccat

SEQ ID NO: 665547 - DNA, 25 bp, Homo sapien
gagacaccagtgttttcccatggtt

SEQ ID NO: 665548 - DNA, 25 bp, Homo sapien
catggtttctgggtagtagataaaa

SEQ ID NO: 665549 - DNA, 25 bp, Homo sapien
attggtctattctaaggttaatttg

SEQ ID NO: 665550 - DNA, 25 bp, Homo sapien
taacaataacaagtcctgaaggagg

SEQ ID NO: 665551 - DNA, 25 bp, Homo sapien
gggaaagaccaatatccagagtcag

SEQ ID NO: 665552 - DNA, 25 bp, Homo sapien
accaatatccagagtcagtagaata

SEQ ID NO: 665553 - DNA, 25 bp, Homo sapien
atgtccagtttctcacaaaaaatta

SEQ ID NO: 665554 - DNA, 25 bp, Homo sapien
gtataatatgatccatacacctgaa

SEQ ID NO: 665555 - DNA, 25 bp, Homo sapien
aatatgatccatacacctgaaaaaa

SEQ ID NO: 665556 - DNA, 25 bp, Homo sapien
atgataagacataggctgagtgtgc

SEQ ID NO: 665557 - DNA, 25 bp, Homo sapien
cataggctgagtgtgcctgtaatct

SEQ ID NO: 665558 - DNA, 25 bp, Homo sapien
ggagagtgaggctaggcatctatca

SEQ ID NO: 665559 - DNA, 25 bp, Homo sapien
tgaggctaggcatctatcacaccac

SEQ ID NO: 665560 - DNA, 25 bp, Homo sapien
gctaggcatctatcacaccactgtg

SEQ ID NO: 665561 - DNA, 25 bp, Homo sapien
gacctttagcaagaaagcaaatctt

SEQ ID NO: 665562 - DNA, 25 bp, Homo sapien
tttctttggtcagtctccacaacag

SEQ ID NO: 665563 - DNA, 25 bp, Homo sapien
tggtcagtctccacaacaggacgaa

SEQ ID NO: 665564 - DNA, 25 bp, Homo sapien
cacaacaggacgaagctggctgagc

SEQ ID NO: 665565 - DNA, 25 bp, Homo sapien
ctgagcccttgcctttggccctgtg

SEQ ID NO: 665566 - DNA, 25 bp, Homo sapien
tgtgagatgctgacccgagtatcca

SEQ ID NO: 665567 - DNA, 25 bp, Homo sapien
tgacccgagtatccagcgaacacgt

SEQ ID NO: 665568 - DNA, 25 bp, Homo sapien
gtatccagcgaacacgtgccagagt

SEQ ID NO: 665569 - DNA, 25 bp, Homo sapien
atgatgagtctgtgttgctttaagc

SEQ ID NO: 665570 - DNA, 25 bp, Homo sapien
gccactgtgtctacagtaattggtt

SEQ ID NO: 665571 - DNA, 25 bp, Homo sapien
ctacagtaattggttagacagcaat

SEQ ID NO: 665572 - DNA, 25 bp, Homo sapien
aatttacctatatttcctcttgtca

SEQ ID NO: 665573 - DNA, 25 bp, Homo sapien
tacctatatttcctcttgtcacttg

SEQ ID NO: 665574 - DNA, 25 bp, Homo sapien
gagttggtttttgcatactgtgtaa

SEQ ID NO: 665575 - DNA, 25 bp, Homo sapien
tttttgcatactgtgtaaggctcca

SEQ ID NO: 665576 - DNA, 25 bp, Homo sapien
gtaaggctccagtattctcttgtat

SEQ ID NO: 665577 - DNA, 25 bp, Homo sapien
aggctccagtattctcttgtatgtg

SEQ ID NO: 665578 - DNA, 25 bp, Homo sapien
agtattctcttgtatgtggatagtc

SEQ ID NO: 665579 - DNA, 25 bp, Homo sapien
gatagtcatttgttccatttgttga

SEQ ID NO: 665580 - DNA, 25 bp, Homo sapien
attccttccttgtaatactgttttg

SEQ ID NO: 665581 - DNA, 25 bp, Homo sapien
aatactgttttgccacccttgctga

SEQ ID NO: 665582 - DNA, 25 bp, Homo sapien
gccacccttgctgaaaatcaattga

SEQ ID NO: 665583 - DNA, 25 bp, Homo sapien
tctctctttttgccagcacagatta

SEQ ID NO: 665584 - DNA, 25 bp, Homo sapien
ctctctttttgccagcacagattaa

SEQ ID NO: 665585 - DNA, 25 bp, Homo sapien
tctctttttgccagcacagattaaa

SEQ ID NO: 665586 - DNA, 25 bp, Homo sapien
ctctttttgccagcacagattaaat

SEQ ID NO: 665587 - DNA, 25 bp, Homo sapien
tctttttgccagcacagattaaatg

SEQ ID NO: 665588 - DNA, 25 bp, Homo sapien
ctttttgccagcacagattaaatgg

SEQ ID NO: 665589 - DNA, 25 bp, Homo sapien
tttttgccagcacagattaaatggt

SEQ ID NO: 665590 - DNA, 25 bp, Homo sapien
ttttgccagcacagattaaatggtt

SEQ ID NO: 665591 - DNA, 25 bp, Homo sapien
tttgccagcacagattaaatggttc

SEQ ID NO: 665592 - DNA, 25 bp, Homo sapien
acctggcatacagtagacattcagt

SEQ ID NO: 665593 - DNA, 25 bp, Homo sapien
tttgctaagtagtccacagaatcac

SEQ ID NO: 665594 - DNA, 25 bp, Homo sapien
tagtccacagaatcacctacttatg

SEQ ID NO: 665595 - DNA, 25 bp, Homo sapien
acctacttatgtgtttctctgccag

SEQ ID NO: 665596 - DNA, 25 bp, Homo sapien
gtgtttctctgccagctctataaag

SEQ ID NO: 665597 - DNA, 25 bp, Homo sapien
tgccagctctataaagacagaccag

SEQ ID NO: 665598 - DNA, 25 bp, Homo sapien
aagacagaccagactaccttgcggt

SEQ ID NO: 665599 - DNA, 25 bp, Homo sapien
agaccagactaccttgcggtaattt

SEQ ID NO: 665600 - DNA, 25 bp, Homo sapien
ctaccttgcggtaatttgttcagta

SEQ ID NO: 665601 - DNA, 25 bp, Homo sapien
atttgttcagtattttatccccagg

SEQ ID NO: 665602 - DNA, 25 bp, Homo sapien
tcagtattttatccccaggttgagc

SEQ ID NO: 665603 - DNA, 25 bp, Homo sapien
gatcatctggatgatagcacaactg

SEQ ID NO: 665604 - DNA, 25 bp, Homo sapien
tcatctggatgatagcacaactgtt

SEQ ID NO: 665605 - DNA, 25 bp, Homo sapien
catctggatgatagcacaactgtta

SEQ ID NO: 665606 - DNA, 25 bp, Homo sapien
atctggatgatagcacaactgttag

SEQ ID NO: 665607 - DNA, 25 bp, Homo sapien
ctggatgatagcacaactgttagaa

SEQ ID NO: 665608 - DNA, 25 bp, Homo sapien
ggatgatagcacaactgttagaaga

SEQ ID NO: 665609 - DNA, 25 bp, Homo sapien
tgatagcacaactgttagaagacct

SEQ ID NO: 665610 - DNA, 25 bp, Homo sapien
atagcacaactgttagaagacctag

SEQ ID NO: 665611 - DNA, 25 bp, Homo sapien
agcacaactgttagaagacctagaa

SEQ ID NO: 665612 - DNA, 25 bp, Homo sapien
tgctatgactcagtggtgttgaatg

SEQ ID NO: 665613 - DNA, 25 bp, Homo sapien
ctatgactcagtggtgttgaatgca

SEQ ID NO: 665614 - DNA, 25 bp, Homo sapien
ccactttaagtttacagctcattga

SEQ ID NO: 665615 - DNA, 25 bp, Homo sapien
gtttacagctcattgatgttactca

SEQ ID NO: 665616 - DNA, 25 bp, Homo sapien
ctgtttgaataccaccccaatcaag

SEQ ID NO: 665617 - DNA, 25 bp, Homo sapien
ttatattgttaagctcatacctcca

SEQ ID NO: 665618 - DNA, 25 bp, Homo sapien
aagctcatacctccaaattaaactg

SEQ ID NO: 665619 - DNA, 25 bp, Homo sapien
aaacatccaggcaaccacattttaa

SEQ ID NO: 665620 - DNA, 25 bp, Homo sapien
aaccacattttaacactgcccttag

SEQ ID NO: 665621 - DNA, 25 bp, Homo sapien
aacactgcccttagtgtatattgtt

SEQ ID NO: 665622 - DNA, 25 bp, Homo sapien
tttacattttggagcatttctggat

SEQ ID NO: 665623 - DNA, 25 bp, Homo sapien
tttctggatatattgttgatttcta

SEQ ID NO: 665624 - DNA, 25 bp, Homo sapien
tgaatttcccactttaagtttacag

SEQ ID NO: 665625 - DNA, 25 bp, Homo sapien
tgcgtggatcactggagccaaggaa

SEQ ID NO: 665626 - DNA, 25 bp, Homo sapien
tgagccatgatagcatcagctgcac

SEQ ID NO: 665627 - DNA, 25 bp, Homo sapien
agccatgatagcatcagctgcactc

SEQ ID NO: 665628 - DNA, 25 bp, Homo sapien
gaagacactgtctctaagtaaataa

SEQ ID NO: 665629 - DNA, 25 bp, Homo sapien
aagtcaatttacaattaatgtggta

SEQ ID NO: 665630 - DNA, 25 bp, Homo sapien
gtaaagattacttgtatgtaccaat

SEQ ID NO: 665631 - DNA, 25 bp, Homo sapien
gtatgtaccaatgtaacttgacttt

SEQ ID NO: 665632 - DNA, 25 bp, Homo sapien
gtaccaatgtaacttgacttttgat

SEQ ID NO: 665633 - DNA, 25 bp, Homo sapien
gtaacttgacttttgatattgaaat

SEQ ID NO: 665634 - DNA, 25 bp, Homo sapien
gtgtaataatgtatagaccccctct

SEQ ID NO: 665635 - DNA, 25 bp, Homo sapien
gtatagaccccctctgaaagacgag

SEQ ID NO: 665636 - DNA, 25 bp, Homo sapien
gcatcctgtcctgagaccctcatct

SEQ ID NO: 665637 - DNA, 25 bp, Homo sapien
aaacaccaaaacaaccaggatgtct

SEQ ID NO: 665638 - DNA, 25 bp, Homo sapien
accaaaacaaccaggatgtctccca

SEQ ID NO: 665639 - DNA, 25 bp, Homo sapien
gcactccacttaagtgtggagactt

SEQ ID NO: 665640 - DNA, 25 bp, Homo sapien
aagtgtggagacttaggctgatcac

SEQ ID NO: 665641 - DNA, 25 bp, Homo sapien
gtgtggagacttaggctgatcacat

SEQ ID NO: 665642 - DNA, 25 bp, Homo sapien
tgtggagacttaggctgatcacatc

SEQ ID NO: 665643 - DNA, 25 bp, Homo sapien
tggagacttaggctgatcacatcac

SEQ ID NO: 665644 - DNA, 25 bp, Homo sapien
ggagacttaggctgatcacatcact

SEQ ID NO: 665645 - DNA, 25 bp, Homo sapien
gagacttaggctgatcacatcactg

SEQ ID NO: 665646 - DNA, 25 bp, Homo sapien
agacttaggctgatcacatcactgc

SEQ ID NO: 665647 - DNA, 25 bp, Homo sapien
aaaagtgtcagaaatgaggcatgaa

SEQ ID NO: 665648 - DNA, 25 bp, Homo sapien
gaaatgaggcatgaaaagctattaa

SEQ ID NO: 665649 - DNA, 25 bp, Homo sapien
aatgaatcattcacacgttgaatag

SEQ ID NO: 665650 - DNA, 25 bp, Homo sapien
acacgttgaatagatgttgtcgtca

SEQ ID NO: 665651 - DNA, 25 bp, Homo sapien
atgttgtcgtcagtttgttctctca

SEQ ID NO: 665652 - DNA, 25 bp, Homo sapien
gtcgtcagtttgttctctcaatgga

SEQ ID NO: 665653 - DNA, 25 bp, Homo sapien
gtcagtttgttctctcaatggaaat

SEQ ID NO: 665654 - DNA, 25 bp, Homo sapien
ctggtcattatgataatacaccttc

SEQ ID NO: 665655 - DNA, 25 bp, Homo sapien
ggatatgttataactgtcttatttt

SEQ ID NO: 665656 - DNA, 25 bp, Homo sapien
gatctaaaatcatatgcttccatta

SEQ ID NO: 665657 - DNA, 25 bp, Homo sapien
atgcttccattaaaatttcttcttt

SEQ ID NO: 665658 - DNA, 25 bp, Homo sapien
gtgaacccaggagatcacaccattg

SEQ ID NO: 665659 - DNA, 25 bp, Homo sapien
tgaacccaggagatcacaccattga

SEQ ID NO: 665660 - DNA, 25 bp, Homo sapien
gaacccaggagatcacaccattgaa

SEQ ID NO: 665661 - DNA, 25 bp, Homo sapien
aacccaggagatcacaccattgaac

SEQ ID NO: 665662 - DNA, 25 bp, Homo sapien
acccaggagatcacaccattgaact

SEQ ID NO: 665663 - DNA, 25 bp, Homo sapien
cccaggagatcacaccattgaactc

SEQ ID NO: 665664 - DNA, 25 bp, Homo sapien
ccaggagatcacaccattgaactcc

SEQ ID NO: 665665 - DNA, 25 bp, Homo sapien
caggagatcacaccattgaactcca

SEQ ID NO: 665666 - DNA, 25 bp, Homo sapien
gggaacctcttcattccctgacata

SEQ ID NO: 665667 - DNA, 25 bp, Homo sapien
ctcttcattccctgacatactaaat

SEQ ID NO: 665668 - DNA, 25 bp, Homo sapien
gtcaattttgtagtactcacctcca

SEQ ID NO: 665669 - DNA, 25 bp, Homo sapien
aattttgtagtactcacctccatcc

SEQ ID NO: 665670 - DNA, 25 bp, Homo sapien
tttgtagtactcacctccatccaca

SEQ ID NO: 665671 - DNA, 25 bp, Homo sapien
gaagaagtccaaaaatatatagcct

SEQ ID NO: 665672 - DNA, 25 bp, Homo sapien
cctcccacatatctgatccaaatat

SEQ ID NO: 665673 - DNA, 25 bp, Homo sapien
attgctaacaagcatcagttatatt

SEQ ID NO: 665674 - DNA, 25 bp, Homo sapien
gcatcagttatatttgagcttcatt

SEQ ID NO: 665675 - DNA, 25 bp, Homo sapien
tttcttttatcctgtctgtcctaat

SEQ ID NO: 665676 - DNA, 25 bp, Homo sapien
ttatcctgtctgtcctaataaaaac

SEQ ID NO: 665677 - DNA, 25 bp, Homo sapien
gcttttccacagtgtcagtatgtct

SEQ ID NO: 665678 - DNA, 25 bp, Homo sapien
gagtatcacagaggtgggcacttac

SEQ ID NO: 665679 - DNA, 25 bp, Homo sapien
agaggtgggcacttacttcacttac

SEQ ID NO: 665680 - DNA, 25 bp, Homo sapien
aggtgggcacttacttcacttactt

SEQ ID NO: 665681 - DNA, 25 bp, Homo sapien
tgggcacttacttcacttacttccc

SEQ ID NO: 665682 - DNA, 25 bp, Homo sapien
cttccccaagtttcttcatcaagat

SEQ ID NO: 665683 - DNA, 25 bp, Homo sapien
aagtttcttcatcaagatatggtca

SEQ ID NO: 665684 - DNA, 25 bp, Homo sapien
agatatggtcaatctggccaggcat

SEQ ID NO: 665685 - DNA, 25 bp, Homo sapien
tatggtcaatctggccaggcataga

SEQ ID NO: 665686 - DNA, 25 bp, Homo sapien
aatctggccaggcatagaggcttac

SEQ ID NO: 665687 - DNA, 25 bp, Homo sapien
ctggccaggcatagaggcttacacc

SEQ ID NO: 665688 - DNA, 25 bp, Homo sapien
gattctttcctaataatgtgaatag

SEQ ID NO: 665689 - DNA, 25 bp, Homo sapien
gtgaatagatgtgcagtgactgaca

SEQ ID NO: 665690 - DNA, 25 bp, Homo sapien
cagaggtggtacagcgggtttattc

SEQ ID NO: 665691 - DNA, 25 bp, Homo sapien
acagcgggtttattcttcttatggc

SEQ ID NO: 665692 - DNA, 25 bp, Homo sapien
gatcttctgactgtaacccaagggt

SEQ ID NO: 665693 - DNA, 25 bp, Homo sapien
taacccaagggtgaaagctcatgca

SEQ ID NO: 665694 - DNA, 25 bp, Homo sapien
gtgaaagctcatgcactcttagcaa

SEQ ID NO: 665695 - DNA, 25 bp, Homo sapien
gctcatgcactcttagcaacaagta

SEQ ID NO: 665696 - DNA, 25 bp, Homo sapien
gtaaattgtacgaacatgccccaga

SEQ ID NO: 665697 - DNA, 25 bp, Homo sapien
cgaacatgccccagatatttcttca

SEQ ID NO: 665698 - DNA, 25 bp, Homo sapien
atacagtttagtctattctgaaaat

SEQ ID NO: 665699 - DNA, 25 bp, Homo sapien
tttcagaattctatagctacttgtc

SEQ ID NO: 665700 - DNA, 25 bp, Homo sapien
gaattctatagctacttgtctttaa

SEQ ID NO: 665701 - DNA, 25 bp, Homo sapien
acagttataagaggcatgtattttt

SEQ ID NO: 665702 - DNA, 25 bp, Homo sapien
cttcatggtctggaagttagttttc

SEQ ID NO: 665703 - DNA, 25 bp, Homo sapien
tagttttctctttgtttgggtagat

SEQ ID NO: 665704 - DNA, 25 bp, Homo sapien
ctttgtttgggtagatcggaatgag

SEQ ID NO: 665705 - DNA, 25 bp, Homo sapien
aatgtgatgttttcatgtttcggga

SEQ ID NO: 665706 - DNA, 25 bp, Homo sapien
tcatgtttcgggaatttgaccggaa

SEQ ID NO: 665707 - DNA, 25 bp, Homo sapien
gaatttgaccggaaagctttatgta

SEQ ID NO: 665708 - DNA, 25 bp, Homo sapien
gaccggaaagctttatgtatgggtt

SEQ ID NO: 665709 - DNA, 25 bp, Homo sapien
ttaacaaagcagtaagggcttactt

SEQ ID NO: 665710 - DNA, 25 bp, Homo sapien
atgagctgctgacttactgtgattc

SEQ ID NO: 665711 - DNA, 25 bp, Homo sapien
gattcagattctagtcccatggctt

SEQ ID NO: 665712 - DNA, 25 bp, Homo sapien
gtcccatggctttgttcctgaaaat

SEQ ID NO: 665713 - DNA, 25 bp, Homo sapien
ctgaaaatgataggcccaacccatg

SEQ ID NO: 665714 - DNA, 25 bp, Homo sapien
aacccatggccagatgacagtcaca

SEQ ID NO: 665715 - DNA, 25 bp, Homo sapien
gaaggaaaacgcctgccgtgcccac

SEQ ID NO: 665716 - DNA, 25 bp, Homo sapien
gtgcccacctaactgtccagatgag

SEQ ID NO: 665717 - DNA, 25 bp, Homo sapien
ctaactgtccagatgaggtttatca

SEQ ID NO: 665718 - DNA, 25 bp, Homo sapien
aatgctgggaattccaaccatccaa

SEQ ID NO: 665719 - DNA, 25 bp, Homo sapien
gaattccaaccatccaatcggacaa

SEQ ID NO: 665720 - DNA, 25 bp, Homo sapien
ccaatcggacaagctttcagaacct

SEQ ID NO: 665721 - DNA, 25 bp, Homo sapien
ttctctgtgttcattgcttattaat

SEQ ID NO: 665722 - DNA, 25 bp, Homo sapien
attcagcaaagattaattgagctcc

SEQ ID NO: 665723 - DNA, 25 bp, Homo sapien
ttcagcaaagattaattgagctcct

SEQ ID NO: 665724 - DNA, 25 bp, Homo sapien
gaaagaatactaacaaaacctgcaa

SEQ ID NO: 665725 - DNA, 25 bp, Homo sapien
aagaatactaacaaaacctgcaaag

SEQ ID NO: 665726 - DNA, 25 bp, Homo sapien
gaatactaacaaaacctgcaaagtg

SEQ ID NO: 665727 - DNA, 25 bp, Homo sapien
aatactaacaaaacctgcaaagtgg

SEQ ID NO: 665728 - DNA, 25 bp, Homo sapien
atactaacaaaacctgcaaagtggt

SEQ ID NO: 665729 - DNA, 25 bp, Homo sapien
tactaacaaaacctgcaaagtggta

SEQ ID NO: 665730 - DNA, 25 bp, Homo sapien
ctaacaaaacctgcaaagtggtatt

SEQ ID NO: 665731 - DNA, 25 bp, Homo sapien
taacaaaacctgcaaagtggtattt

SEQ ID NO: 665732 - DNA, 25 bp, Homo sapien
atcatcattgttctcgtggccactg

SEQ ID NO: 665733 - DNA, 25 bp, Homo sapien
ttctcgtggccactggcatcatctt

SEQ ID NO: 665734 - DNA, 25 bp, Homo sapien
catcatcttcaagttctgctgggac

SEQ ID NO: 665735 - DNA, 25 bp, Homo sapien
ggaccgcagccagaagcgacgcaga

SEQ ID NO: 665736 - DNA, 25 bp, Homo sapien
gaagcgacgcagaccctcagggcag

SEQ ID NO: 665737 - DNA, 25 bp, Homo sapien
agagccagcagccactgacagacct

SEQ ID NO: 665738 - DNA, 25 bp, Homo sapien
tgacagacctgtccccggctggagt

SEQ ID NO: 665739 - DNA, 25 bp, Homo sapien
tgtccccggctggagtcactgtgct

SEQ ID NO: 665740 - DNA, 25 bp, Homo sapien
tccagccttccagttgaaccggatt

SEQ ID NO: 665741 - DNA, 25 bp, Homo sapien
ccagttgaaccggattcccctggtg

SEQ ID NO: 665742 - DNA, 25 bp, Homo sapien
ccggattcccctggtgaatctgtga

SEQ ID NO: 665743 - DNA, 25 bp, Homo sapien
gaaaatactctaacaagtacttttg

SEQ ID NO: 665744 - DNA, 25 bp, Homo sapien
aagtacttttgaatacagtttctga

SEQ ID NO: 665745 - DNA, 25 bp, Homo sapien
ttttgaatacagtttctgataactt

SEQ ID NO: 665746 - DNA, 25 bp, Homo sapien
aatgcatgaagtaaaaatgtccaaa

SEQ ID NO: 665747 - DNA, 25 bp, Homo sapien
aattgaggagttcttgaaactgcta

SEQ ID NO: 665748 - DNA, 25 bp, Homo sapien
gaggagttcttgaaactgctaacca

SEQ ID NO: 665749 - DNA, 25 bp, Homo sapien
ggagttcttgaaactgctaaccaag

SEQ ID NO: 665750 - DNA, 25 bp, Homo sapien
aactgctaaccaagatcagacaaag

SEQ ID NO: 665751 - DNA, 25 bp, Homo sapien
aaccaagatcagacaaagcaagaat

SEQ ID NO: 665752 - DNA, 25 bp, Homo sapien
agaattaattatatggactaaactg

SEQ ID NO: 665753 - DNA, 25 bp, Homo sapien
tgaattgtggttctttatttttcag

SEQ ID NO: 665754 - DNA, 25 bp, Homo sapien
aaagaacaccgtttgcctctaggag

SEQ ID NO: 665755 - DNA, 25 bp, Homo sapien
gcctctaggaggtatggtgtctata

SEQ ID NO: 665756 - DNA, 25 bp, Homo sapien
ggtgtctatacaaatgctggtgcaa

SEQ ID NO: 665757 - DNA, 25 bp, Homo sapien
taaaggcacttgatcccatggagga

SEQ ID NO: 665758 - DNA, 25 bp, Homo sapien
atggaggactaccttcatcatctgt

SEQ ID NO: 665759 - DNA, 25 bp, Homo sapien
ttcatcatctgttctctcaaacctt

SEQ ID NO: 665760 - DNA, 25 bp, Homo sapien
tctctcaaaccttgctccagaaaaa

SEQ ID NO: 665761 - DNA, 25 bp, Homo sapien
gggacttttacttgcctaagtgatg

SEQ ID NO: 665762 - DNA, 25 bp, Homo sapien
ttatttcattccttatccacaacac

SEQ ID NO: 665763 - DNA, 25 bp, Homo sapien
ttcagagtacaggttgtcccagtct

SEQ ID NO: 665764 - DNA, 25 bp, Homo sapien
gttgtcccagtctcagagttcagag

SEQ ID NO: 665765 - DNA, 25 bp, Homo sapien
gatgctctcggacaggaggctggca

SEQ ID NO: 665766 - DNA, 25 bp, Homo sapien
aggctggcagacgtgttagtcattc

SEQ ID NO: 665767 - DNA, 25 bp, Homo sapien
gcagacgtgttagtcattcagacat

SEQ ID NO: 665768 - DNA, 25 bp, Homo sapien
aacggatttgttgagcccacactga

SEQ ID NO: 665769 - DNA, 25 bp, Homo sapien
ccacactgagcagctgctgtgtagt

SEQ ID NO: 665770 - DNA, 25 bp, Homo sapien
gcagctgctgtgtagtcagtggtaa

SEQ ID NO: 665771 - DNA, 25 bp, Homo sapien
cattcatccaacagtgttttcctcg

SEQ ID NO: 665772 - DNA, 25 bp, Homo sapien
agtgttttcctcgttctgtgaattc

SEQ ID NO: 665773 - DNA, 25 bp, Homo sapien
tgtgaattcaaataccactttgttg

SEQ ID NO: 665774 - DNA, 25 bp, Homo sapien
ttgtaaagcagatgagcggtggtct

SEQ ID NO: 665775 - DNA, 25 bp, Homo sapien
aggcgcccggcggttttctgtgctc

SEQ ID NO: 665776 - DNA, 25 bp, Homo sapien
aacttctagcttcattataatccaa

SEQ ID NO: 665777 - DNA, 25 bp, Homo sapien
ctcccaccagtatcatgacagttgg

SEQ ID NO: 665778 - DNA, 25 bp, Homo sapien
gacagttggcagtcaccatgacaat

SEQ ID NO: 665779 - DNA, 25 bp, Homo sapien
atgacaatgactggagcagaccaag

SEQ ID NO: 665780 - DNA, 25 bp, Homo sapien
tagaaaagaggcagctccttgattc

SEQ ID NO: 665781 - DNA, 25 bp, Homo sapien
tgattccaggaaagtctcactccct

SEQ ID NO: 665782 - DNA, 25 bp, Homo sapien
cccctatgttaaagataccctgtat

SEQ ID NO: 665783 - DNA, 25 bp, Homo sapien
gataccctgtatttgtaactgcctg

SEQ ID NO: 665784 - DNA, 25 bp, Homo sapien
gtatttgtaactgcctggttctcag

SEQ ID NO: 665785 - DNA, 25 bp, Homo sapien
atttatgagctatgttcccacttct

SEQ ID NO: 665786 - DNA, 25 bp, Homo sapien
tcccacttctccaattccatgatga

SEQ ID NO: 665787 - DNA, 25 bp, Homo sapien
aaaagactttctgtactgtactaga

SEQ ID NO: 665788 - DNA, 25 bp, Homo sapien
aaagactttctgtactgtactagaa

SEQ ID NO: 665789 - DNA, 25 bp, Homo sapien
agactttctgtactgtactagaaaa

SEQ ID NO: 665790 - DNA, 25 bp, Homo sapien
gtactgtactagaaaattagtgtct

SEQ ID NO: 665791 - DNA, 25 bp, Homo sapien
tagaaaattagtgtctgggtgtggt

SEQ ID NO: 665792 - DNA, 25 bp, Homo sapien
ccccatctctatgggcatggtggtg

SEQ ID NO: 665793 - DNA, 25 bp, Homo sapien
atggtggtgcgggtgtagtggtgcg

SEQ ID NO: 665794 - DNA, 25 bp, Homo sapien
gtagtggtgcgcactgctactacta

SEQ ID NO: 665795 - DNA, 25 bp, Homo sapien
tagtggtgcgcactgctactactag

SEQ ID NO: 665796 - DNA, 25 bp, Homo sapien
agtggtgcgcactgctactactagc

SEQ ID NO: 665797 - DNA, 25 bp, Homo sapien
gtggtgcgcactgctactactagct

SEQ ID NO: 665798 - DNA, 25 bp, Homo sapien
ttatatctggaatgatgtttttgtt

SEQ ID NO: 665799 - DNA, 25 bp, Homo sapien
tatatctggaatgatgtttttgttt

SEQ ID NO: 665800 - DNA, 25 bp, Homo sapien
atatctggaatgatgtttttgtttc

SEQ ID NO: 665801 - DNA, 25 bp, Homo sapien
tgtttttgtttcccattatatataa

SEQ ID NO: 665802 - DNA, 25 bp, Homo sapien
ttttgtttcccattatatataaact

SEQ ID NO: 665803 - DNA, 25 bp, Homo sapien
tttgtttcccattatatataaacta

SEQ ID NO: 665804 - DNA, 25 bp, Homo sapien
ttgtttcccattatatataaactat

SEQ ID NO: 665805 - DNA, 25 bp, Homo sapien
tgtttcccattatatataaactata

SEQ ID NO: 665806 - DNA, 25 bp, Homo sapien
atctggatgatagcacaactgttag

SEQ ID NO: 665807 - DNA, 25 bp, Homo sapien
gcacaactgttagaagacctagaag

SEQ ID NO: 665808 - DNA, 25 bp, Homo sapien
tgctatgactcagtggtgttgaatg

SEQ ID NO: 665809 - DNA, 25 bp, Homo sapien
gtgttgaatgcagaccatctaccag

SEQ ID NO: 665810 - DNA, 25 bp, Homo sapien
gttgaatgcagaccatctaccagct

SEQ ID NO: 665811 - DNA, 25 bp, Homo sapien
tgaatgcagaccatctaccagctgg

SEQ ID NO: 665812 - DNA, 25 bp, Homo sapien
caggaataaagggattcattcctca

SEQ ID NO: 665813 - DNA, 25 bp, Homo sapien
ctgatgttacagtgaagatgggttc

SEQ ID NO: 665814 - DNA, 25 bp, Homo sapien
ttcttgaactcttggaagcctggat

SEQ ID NO: 665815 - DNA, 25 bp, Homo sapien
aagcctggatgagccacctaatctg

SEQ ID NO: 665816 - DNA, 25 bp, Homo sapien
gatgagccacctaatctgcaagata

SEQ ID NO: 665817 - DNA, 25 bp, Homo sapien
tggtgttgaatgcagaccatctacc

SEQ ID NO: 665818 - DNA, 25 bp, Homo sapien
ggtgttgaatgcagaccatctacca

SEQ ID NO: 665819 - DNA, 25 bp, Homo sapien
gtgttgaatgcagaccatctaccag

SEQ ID NO: 665820 - DNA, 25 bp, Homo sapien
tgttgaatgcagaccatctaccagc

SEQ ID NO: 665821 - DNA, 25 bp, Homo sapien
gttgaatgcagaccatctaccagct

SEQ ID NO: 665822 - DNA, 25 bp, Homo sapien
ttgaatgcagaccatctaccagctg

SEQ ID NO: 665823 - DNA, 25 bp, Homo sapien
tgaatgcagaccatctaccagctgg

SEQ ID NO: 665824 - DNA, 25 bp, Homo sapien
ctaccagctggggaaagaatcaatt

SEQ ID NO: 665825 - DNA, 25 bp, Homo sapien
taccagctggggaaagaatcaatta

SEQ ID NO: 665826 - DNA, 25 bp, Homo sapien
accagctggggaaagaatcaattat

SEQ ID NO: 665827 - DNA, 25 bp, Homo sapien
ccagctggggaaagaatcaattata

SEQ ID NO: 665828 - DNA, 25 bp, Homo sapien
gttgaagagtcacctcttcccattt

SEQ ID NO: 665829 - DNA, 25 bp, Homo sapien
acctcttcccattttagtacatcat

SEQ ID NO: 665830 - DNA, 25 bp, Homo sapien
atcattaattgtcaaagcctgtgtg

SEQ ID NO: 665831 - DNA, 25 bp, Homo sapien
agcctgtgtgacacaactcagaata

SEQ ID NO: 665832 - DNA, 25 bp, Homo sapien
gacacaactcagaatactaacctag

SEQ ID NO: 665833 - DNA, 25 bp, Homo sapien
gaatactaacctagactaatcccag

SEQ ID NO: 665834 - DNA, 25 bp, Homo sapien
gactaatcccaggatgcttctgctg

SEQ ID NO: 665835 - DNA, 25 bp, Homo sapien
atgcttctgctggagcaaagatatt

SEQ ID NO: 665836 - DNA, 25 bp, Homo sapien
gacaagagaggccttcgcctttatt

SEQ ID NO: 665837 - DNA, 25 bp, Homo sapien
aatgaagaattctcccagaagtgac

SEQ ID NO: 665838 - DNA, 25 bp, Homo sapien
attctcccagaagtgacttgtcaag

SEQ ID NO: 665839 - DNA, 25 bp, Homo sapien
ggctatgacatgagcacacccaacg

SEQ ID NO: 665840 - DNA, 25 bp, Homo sapien
acccctgcactactatgagaccgtt

SEQ ID NO: 665841 - DNA, 25 bp, Homo sapien
tgagaccgttcgcatggcagccatc

SEQ ID NO: 665842 - DNA, 25 bp, Homo sapien
ggcagccatcaaagagtcctggacg

SEQ ID NO: 665843 - DNA, 25 bp, Homo sapien
tgcccttcaacaatggcctcatggg

SEQ ID NO: 665844 - DNA, 25 bp, Homo sapien
ttcaacaatggcctcatgggccggg

SEQ ID NO: 665845 - DNA, 25 bp, Homo sapien
ggaacatccctacccttggcagtgt

SEQ ID NO: 665846 - DNA, 25 bp, Homo sapien
tacccttggcagtgtggcagtgacc

SEQ ID NO: 665847 - DNA, 25 bp, Homo sapien
agtgtggcagtgaccatggcactac

SEQ ID NO: 665848 - DNA, 25 bp, Homo sapien
agtgaccatggcactacacggctgt

SEQ ID NO: 665849 - DNA, 25 bp, Homo sapien
tggcagtcgcaggatttggctatga

SEQ ID NO: 665850 - DNA, 25 bp, Homo sapien
gtcagagacctttgagacattacac

SEQ ID NO: 665851 - DNA, 25 bp, Homo sapien
gacctttgagacattacacaacctg

SEQ ID NO: 665852 - DNA, 25 bp, Homo sapien
gagacattacacaacctggtacaca

SEQ ID NO: 665853 - DNA, 25 bp, Homo sapien
attacacaacctggtacacaaaggg

SEQ ID NO: 665854 - DNA, 25 bp, Homo sapien
cccctatgagctgtggaacgagact

SEQ ID NO: 665855 - DNA, 25 bp, Homo sapien
tgagctgtggaacgagacttctgca

SEQ ID NO: 665856 - DNA, 25 bp, Homo sapien
gctgtggaacgagacttctgcagag

SEQ ID NO: 665857 - DNA, 25 bp, Homo sapien
ctgcagaggtggctgacctcaagaa

SEQ ID NO: 665858 - DNA, 25 bp, Homo sapien
gtgatcgaggactggtacaggaacc

SEQ ID NO: 665859 - DNA, 25 bp, Homo sapien
tacaggaaccaccaggaggaagacc

SEQ ID NO: 665860 - DNA, 25 bp, Homo sapien
ccaggaggaagacctgactgaattc

SEQ ID NO: 665861 - DNA, 25 bp, Homo sapien
tgtggtggtgggggtgggcgcctgt

SEQ ID NO: 665862 - DNA, 25 bp, Homo sapien
gtggtggtgggggtgggcgcctgta

SEQ ID NO: 665863 - DNA, 25 bp, Homo sapien
tggtggtgggggtgggcgcctgtag

SEQ ID NO: 665864 - DNA, 25 bp, Homo sapien
gaggcagcagactggtgtgaacccg

SEQ ID NO: 665865 - DNA, 25 bp, Homo sapien
aggcagcagactggtgtgaacccgg

SEQ ID NO: 665866 - DNA, 25 bp, Homo sapien
ggcagcagactggtgtgaacccggg

SEQ ID NO: 665867 - DNA, 25 bp, Homo sapien
gcagcagactggtgtgaacccggga

SEQ ID NO: 665868 - DNA, 25 bp, Homo sapien
cagcagactggtgtgaacccgggag

SEQ ID NO: 665869 - DNA, 25 bp, Homo sapien
agcagactggtgtgaacccgggagg

SEQ ID NO: 665870 - DNA, 25 bp, Homo sapien
gcagactggtgtgaacccgggaggt

SEQ ID NO: 665871 - DNA, 25 bp, Homo sapien
cagactggtgtgaacccgggaggtg

SEQ ID NO: 665872 - DNA, 25 bp, Homo sapien
aaactgtcctcttgtgctgagtcgg

SEQ ID NO: 665873 - DNA, 25 bp, Homo sapien
ctcttgtgctgagtcggttcctggg

SEQ ID NO: 665874 - DNA, 25 bp, Homo sapien
caagatatgagccagtttatcaatc

SEQ ID NO: 665875 - DNA, 25 bp, Homo sapien
tgccagctgatccatggagtgcaga

SEQ ID NO: 665876 - DNA, 25 bp, Homo sapien
atccatggagtgcagagtctgcaaa

SEQ ID NO: 665877 - DNA, 25 bp, Homo sapien
caaaatatctcaagcgctgatctgt

SEQ ID NO: 665878 - DNA, 25 bp, Homo sapien
atatctcaagcgctgatctgttttt

SEQ ID NO: 665879 - DNA, 25 bp, Homo sapien
tctcaagcgctgatctgttttttaa

SEQ ID NO: 665880 - DNA, 25 bp, Homo sapien
aatagtgatgttatcctgagaagca

SEQ ID NO: 665881 - DNA, 25 bp, Homo sapien
gatgttatcctgagaagcaatttgg

SEQ ID NO: 665882 - DNA, 25 bp, Homo sapien
agcaatttgggaggtttagaatctt

SEQ ID NO: 665883 - DNA, 25 bp, Homo sapien
gaagttgtgaggacagctgccgccc

SEQ ID NO: 665884 - DNA, 25 bp, Homo sapien
ggtgccacctcgtggtagactatga

SEQ ID NO: 665885 - DNA, 25 bp, Homo sapien
gccacctcgtggtagactatgacgg

SEQ ID NO: 665886 - DNA, 25 bp, Homo sapien
gtggtagactatgacggtgactctt

SEQ ID NO: 665887 - DNA, 25 bp, Homo sapien
acggtgactcttggcagcagaccag

SEQ ID NO: 665888 - DNA, 25 bp, Homo sapien
gtgactcttggcagcagaccagtgg

SEQ ID NO: 665889 - DNA, 25 bp, Homo sapien
tgggaaggccgtgtttcagccctga

SEQ ID NO: 665890 - DNA, 25 bp, Homo sapien
gaaggccgtgtttcagccctgatgg

SEQ ID NO: 665891 - DNA, 25 bp, Homo sapien
cccctactcaagtgtctacctggag

SEQ ID NO: 665892 - DNA, 25 bp, Homo sapien
gcggtgctggccaatgctggaaaca

SEQ ID NO: 665893 - DNA, 25 bp, Homo sapien
tgctggccaatgctggaaacattca

SEQ ID NO: 665894 - DNA, 25 bp, Homo sapien
gtcatttaaaccctgtgatttctga

SEQ ID NO: 665895 - DNA, 25 bp, Homo sapien
ttaaaccctgtgatttctgaccgtg

SEQ ID NO: 665896 - DNA, 25 bp, Homo sapien
aaccctgtgatttctgaccgtgcgt

SEQ ID NO: 665897 - DNA, 25 bp, Homo sapien
cctgtgatttctgaccgtgcgtggt

SEQ ID NO: 665898 - DNA, 25 bp, Homo sapien
atttctgaccgtgcgtggtggctca

SEQ ID NO: 665899 - DNA, 25 bp, Homo sapien
gaagaaaaacttagctgagcatagt

SEQ ID NO: 665900 - DNA, 25 bp, Homo sapien
gctgagcatagtagcatgtctgtaa

SEQ ID NO: 665901 - DNA, 25 bp, Homo sapien
gagcatagtagcatgtctgtaatcc

SEQ ID NO: 665902 - DNA, 25 bp, Homo sapien
atcctaactgcttgggaggttaaca

SEQ ID NO: 665903 - DNA, 25 bp, Homo sapien
ctgcttgggaggttaacataggagt

SEQ ID NO: 665904 - DNA, 25 bp, Homo sapien
cataggagtgtcctttgagcccagg

SEQ ID NO: 665905 - DNA, 25 bp, Homo sapien
gactgtgtacaaagcacctgtcttt

SEQ ID NO: 665906 - DNA, 25 bp, Homo sapien
ctgtctttccgcttttgtaatcttc

SEQ ID NO: 665907 - DNA, 25 bp, Homo sapien
tccgcttttgtaatcttccgttgga

SEQ ID NO: 665908 - DNA, 25 bp, Homo sapien
gtaaccatctgttttcttcaagaaa

SEQ ID NO: 665909 - DNA, 25 bp, Homo sapien
tcatcttgaaaacagctgtcagcca

SEQ ID NO: 665910 - DNA, 25 bp, Homo sapien
cagagctgaaatttattgccacatc

SEQ ID NO: 665911 - DNA, 25 bp, Homo sapien
tattgccacatcacatgaagcatag

SEQ ID NO: 665912 - DNA, 25 bp, Homo sapien
gaagcatagaacagactccactact

SEQ ID NO: 665913 - DNA, 25 bp, Homo sapien
actccactactccttgagattcaaa

SEQ ID NO: 665914 - DNA, 25 bp, Homo sapien
tttgcctctcacaaagttacctttt

SEQ ID NO: 665915 - DNA, 25 bp, Homo sapien
atctccctagtgtgctctttttatt

SEQ ID NO: 665916 - DNA, 25 bp, Homo sapien
acaacagtgtggttctcagtacctc

SEQ ID NO: 665917 - DNA, 25 bp, Homo sapien
agtgtggttctcagtacctctctcc

SEQ ID NO: 665918 - DNA, 25 bp, Homo sapien
ggttagacatttacatttcctcaat

SEQ ID NO: 665919 - DNA, 25 bp, Homo sapien
cctcaatgtttctcatctgacatgg

SEQ ID NO: 665920 - DNA, 25 bp, Homo sapien
gtttctcatctgacatggctttaag

SEQ ID NO: 665921 - DNA, 25 bp, Homo sapien
tctgacatggctttaagatcttaca

SEQ ID NO: 665922 - DNA, 25 bp, Homo sapien
taagatcttacaacctctgattccc

SEQ ID NO: 665923 - DNA, 25 bp, Homo sapien
acaacctctgattcccttctttgga

SEQ ID NO: 665924 - DNA, 25 bp, Homo sapien
cccttctttggacattacactttgt

SEQ ID NO: 665925 - DNA, 25 bp, Homo sapien
ttggacattacactttgttaataag

SEQ ID NO: 665926 - DNA, 25 bp, Homo sapien
aataagaattggtcggctgggctca

SEQ ID NO: 665927 - DNA, 25 bp, Homo sapien
cacgcccaacctcattgtagtttta

SEQ ID NO: 665928 - DNA, 25 bp, Homo sapien
ttgtagttttaattcacattccctg

SEQ ID NO: 665929 - DNA, 25 bp, Homo sapien
attcacattccctgatgatgagtgg

SEQ ID NO: 665930 - DNA, 25 bp, Homo sapien
cctgatgatgagtgggttgactatt

SEQ ID NO: 665931 - DNA, 25 bp, Homo sapien
gtctatttaggttctttgctcattt

SEQ ID NO: 665932 - DNA, 25 bp, Homo sapien
ggttgtcttcttgctattgacttgt

SEQ ID NO: 665933 - DNA, 25 bp, Homo sapien
gataatgatcccttatcagaagtgt

SEQ ID NO: 665934 - DNA, 25 bp, Homo sapien
gatcccttatcagaagtgttgtttg

SEQ ID NO: 665935 - DNA, 25 bp, Homo sapien
agaagtgttgtttgcacatattttc

SEQ ID NO: 665936 - DNA, 25 bp, Homo sapien
tttctccctctctgtaggtcatctt

SEQ ID NO: 665937 - DNA, 25 bp, Homo sapien
ctctctgtaggtcatctttttactc

SEQ ID NO: 665938 - DNA, 25 bp, Homo sapien
aaaaggtgaggtgggttccctgcat

SEQ ID NO: 665939 - DNA, 25 bp, Homo sapien
tgggttccctgcatccgagcagcag

SEQ ID NO: 665940 - DNA, 25 bp, Homo sapien
attgagccgggtatgtctttctcca

SEQ ID NO: 665941 - DNA, 25 bp, Homo sapien
aaatccctgggaatagaggctgtcc

SEQ ID NO: 665942 - DNA, 25 bp, Homo sapien
gaatagaggctgtccctcatccctg

SEQ ID NO: 665943 - DNA, 25 bp, Homo sapien
gccccttgaggagtggtgaatgtca

SEQ ID NO: 665944 - DNA, 25 bp, Homo sapien
tgaacatctgttactttggtgcaaa

SEQ ID NO: 665945 - DNA, 25 bp, Homo sapien
tactttggtgcaaaccctgtttcag

SEQ ID NO: 665946 - DNA, 25 bp, Homo sapien
gtgcaaaccctgtttcagcagaagg

SEQ ID NO: 665947 - DNA, 25 bp, Homo sapien
aaggagtatttgcaccagatttcta

SEQ ID NO: 665948 - DNA, 25 bp, Homo sapien
gcaccagatttctaaactgcttggg

SEQ ID NO: 665949 - DNA, 25 bp, Homo sapien
aaacacataggtttggatatccaac

SEQ ID NO: 665950 - DNA, 25 bp, Homo sapien
tttggatatccaacgcctatgttcc

SEQ ID NO: 665951 - DNA, 25 bp, Homo sapien
gatatccaacgcctatgttccagtt

SEQ ID NO: 665952 - DNA, 25 bp, Homo sapien
aacgcctatgttccagttctggctc

SEQ ID NO: 665953 - DNA, 25 bp, Homo sapien
actagctatgtgaccatggatgaat

SEQ ID NO: 665954 - DNA, 25 bp, Homo sapien
tgtgaccatggatgaatcaaccctg

SEQ ID NO: 665955 - DNA, 25 bp, Homo sapien
tttctaagagaacatcaggagattt

SEQ ID NO: 665956 - DNA, 25 bp, Homo sapien
aatatacaagatgtccgtggcacaa

SEQ ID NO: 665957 - DNA, 25 bp, Homo sapien
gatgtccgtggcacaatgtctagca

SEQ ID NO: 665958 - DNA, 25 bp, Homo sapien
gtccgtggcacaatgtctagcacac

SEQ ID NO: 665959 - DNA, 25 bp, Homo sapien
ggcacaatgtctagcacacagcaag

SEQ ID NO: 665960 - DNA, 25 bp, Homo sapien
atttccaagtgataaaagtcacagt

SEQ ID NO: 665961 - DNA, 25 bp, Homo sapien
aagtcacagttcacaaaatactact

SEQ ID NO: 665962 - DNA, 25 bp, Homo sapien
actactgtgcccaactgggaaaaat

SEQ ID NO: 665963 - DNA, 25 bp, Homo sapien
attcaaaacaaccgcctaaccacat

SEQ ID NO: 665964 - DNA, 25 bp, Homo sapien
aaggaataatcatcagtctgacagt

SEQ ID NO: 665965 - DNA, 25 bp, Homo sapien
tcagtctgacagttaatttcacaat

SEQ ID NO: 665966 - DNA, 25 bp, Homo sapien
gtctgacagttaatttcacaattga

SEQ ID NO: 665967 - DNA, 25 bp, Homo sapien
tcacaattgaaatattggaagccag

SEQ ID NO: 665968 - DNA, 25 bp, Homo sapien
ttggaagccagatgacaacaagcat

SEQ ID NO: 665969 - DNA, 25 bp, Homo sapien
tgacaacaagcatcttcaaaacatt

SEQ ID NO: 665970 - DNA, 25 bp, Homo sapien
ctgcagcctagaattttgtatctaa

SEQ ID NO: 665971 - DNA, 25 bp, Homo sapien
gactgtattcaaacttatgagagta

SEQ ID NO: 665972 - DNA, 25 bp, Homo sapien
gaaaggctgtggccacctgatgacc

SEQ ID NO: 665973 - DNA, 25 bp, Homo sapien
ccccaggcagctataagaatatttt

SEQ ID NO: 665974 - DNA, 25 bp, Homo sapien
aggaggtgctgagttttgtatcttt

SEQ ID NO: 665975 - DNA, 25 bp, Homo sapien
gaggtgctgagttttgtatcttttt

SEQ ID NO: 665976 - DNA, 25 bp, Homo sapien
tttaatcataatcaacatcagtttt

SEQ ID NO: 665977 - DNA, 25 bp, Homo sapien
tcaacatcagtttttgacccaacta

SEQ ID NO: 665978 - DNA, 25 bp, Homo sapien
tttttgacccaactaaccttgactg

SEQ ID NO: 665979 - DNA, 25 bp, Homo sapien
ttgacccaactaaccttgactgtat

SEQ ID NO: 665980 - DNA, 25 bp, Homo sapien
gacccaactaaccttgactgtattc

SEQ ID NO: 665981 - DNA, 25 bp, Homo sapien
aaccttgactgtattcaaacttatg

SEQ ID NO: 665982 - DNA, 25 bp, Homo sapien
gaggatggcatgagcccgggaggcg

SEQ ID NO: 665983 - DNA, 25 bp, Homo sapien
tttaaacattatacttcgggctggg

SEQ ID NO: 665984 - DNA, 25 bp, Homo sapien
ttaaacattatacttcgggctgggc

SEQ ID NO: 665985 - DNA, 25 bp, Homo sapien
taaacattatacttcgggctgggcg

SEQ ID NO: 665986 - DNA, 25 bp, Homo sapien
aaacattatacttcgggctgggcgc

SEQ ID NO: 665987 - DNA, 25 bp, Homo sapien
ccaggagattgagaccgtcttggct

SEQ ID NO: 665988 - DNA, 25 bp, Homo sapien
caggagattgagaccgtcttggcta

SEQ ID NO: 665989 - DNA, 25 bp, Homo sapien
aggagattgagaccgtcttggctaa

SEQ ID NO: 665990 - DNA, 25 bp, Homo sapien
ggagattgagaccgtcttggctaac

SEQ ID NO: 665991 - DNA, 25 bp, Homo sapien
gagattgagaccgtcttggctaaca

SEQ ID NO: 665992 - DNA, 25 bp, Homo sapien
agattgagaccgtcttggctaacac

SEQ ID NO: 665993 - DNA, 25 bp, Homo sapien
agattatgagctgagtaaggcacaa

SEQ ID NO: 665994 - DNA, 25 bp, Homo sapien
agctgagtaaggcacaaatgtgaca

SEQ ID NO: 665995 - DNA, 25 bp, Homo sapien
gtgacataatcattttgggtgggaa

SEQ ID NO: 665996 - DNA, 25 bp, Homo sapien
ggaaataatggcttttatgcctttg

SEQ ID NO: 665997 - DNA, 25 bp, Homo sapien
tttgtgtacacctgccaccattgcc

SEQ ID NO: 665998 - DNA, 25 bp, Homo sapien
gccaccattgcctcattatcatata

SEQ ID NO: 665999 - DNA, 25 bp, Homo sapien
gcctcattatcatatacttggctaa

SEQ ID NO: 666000 - DNA, 25 bp, Homo sapien
atatacttggctaatgtcattttta

SEQ ID NO: 666001 - DNA, 25 bp, Homo sapien
ttatgtccatatcattttctagttt

SEQ ID NO: 666002 - DNA, 25 bp, Homo sapien
gtttattaacaatttcatgaactag

SEQ ID NO: 666003 - DNA, 25 bp, Homo sapien
acaattgttaacatcattctaaatg

SEQ ID NO: 666004 - DNA, 25 bp, Homo sapien
actgtgcgatttgggtttggcctcc

SEQ ID NO: 666005 - DNA, 25 bp, Homo sapien
ctcccctgaagctgcagtaacatgt

SEQ ID NO: 666006 - DNA, 25 bp, Homo sapien
gtatttttgccacaatcccagagga

SEQ ID NO: 666007 - DNA, 25 bp, Homo sapien
ctgggcaggaattaacggcttgtgt

SEQ ID NO: 666008 - DNA, 25 bp, Homo sapien
aaagatttctgtctgcattgtggct

SEQ ID NO: 666009 - DNA, 25 bp, Homo sapien
tgcattgtggctttacctcgtgaag

SEQ ID NO: 666010 - DNA, 25 bp, Homo sapien
tacctcgtgaagcagttgtctagaa

SEQ ID NO: 666011 - DNA, 25 bp, Homo sapien
tagaaaagtcctggtactccacact

SEQ ID NO: 666012 - DNA, 25 bp, Homo sapien
acactgctgcggttgagtaacttct

SEQ ID NO: 666013 - DNA, 25 bp, Homo sapien
agtaacttctccgtcaggttgtggt

SEQ ID NO: 666014 - DNA, 25 bp, Homo sapien
aatacctgggcatctgagacagaca

SEQ ID NO: 666015 - DNA, 25 bp, Homo sapien
ctcagtccactcactaagggtgctg

SEQ ID NO: 666016 - DNA, 25 bp, Homo sapien
gtccactcactaagggtgctgagga

SEQ ID NO: 666017 - DNA, 25 bp, Homo sapien
gaggcataagaagtcctttcttcca

SEQ ID NO: 666018 - DNA, 25 bp, Homo sapien
taagaagtcctttcttccaggcact

SEQ ID NO: 666019 - DNA, 25 bp, Homo sapien
tttcttccaggcactgtccagtgat

SEQ ID NO: 666020 - DNA, 25 bp, Homo sapien
ggcactgtccagtgatcctaatgat

SEQ ID NO: 666021 - DNA, 25 bp, Homo sapien
gatcctaatgattctcaattctctg

SEQ ID NO: 666022 - DNA, 25 bp, Homo sapien
tgattctcaattctctgagactcag

SEQ ID NO: 666023 - DNA, 25 bp, Homo sapien
ctgagactcagtgactcctttttat

SEQ ID NO: 666024 - DNA, 25 bp, Homo sapien
gactcagtgactcctttttataaca

SEQ ID NO: 666025 - DNA, 25 bp, Homo sapien
ggtaaatccacatatgatttctaca

SEQ ID NO: 666026 - DNA, 25 bp, Homo sapien
aaaagtgcctcacttcatgcttcag

SEQ ID NO: 666027 - DNA, 25 bp, Homo sapien
gcctcacttcatgcttcagttgttt

SEQ ID NO: 666028 - DNA, 25 bp, Homo sapien
aatgtccccagacaatctttaccag

SEQ ID NO: 666029 - DNA, 25 bp, Homo sapien
aaaggcccaagaaaccaagcttcag

SEQ ID NO: 666030 - DNA, 25 bp, Homo sapien
ccaagcttcagctatgaaccagaaa

SEQ ID NO: 666031 - DNA, 25 bp, Homo sapien
gaaatcattggctgggatgctcata

SEQ ID NO: 666032 - DNA, 25 bp, Homo sapien
tgggatgctcataccacttacacat

SEQ ID NO: 666033 - DNA, 25 bp, Homo sapien
cataccacttacacattcattccag

SEQ ID NO: 666034 - DNA, 25 bp, Homo sapien
ttcattccagagaacgtatgctttt

SEQ ID NO: 666035 - DNA, 25 bp, Homo sapien
agatctacttgtcttgtgaccactc

SEQ ID NO: 666036 - DNA, 25 bp, Homo sapien
tgaccactcaagaccacgattctgt

SEQ ID NO: 666037 - DNA, 25 bp, Homo sapien
agagcatgcaagaacttctacaaaa

SEQ ID NO: 666038 - DNA, 25 bp, Homo sapien
tctacaaaacttctataccacacag

SEQ ID NO: 666039 - DNA, 25 bp, Homo sapien
gggcactaaattcagatcctttctc

SEQ ID NO: 666040 - DNA, 25 bp, Homo sapien
ctttctccacacagcaatgacattt

SEQ ID NO: 666041 - DNA, 25 bp, Homo sapien
gacatttatcaatctgactcaggtg

SEQ ID NO: 666042 - DNA, 25 bp, Homo sapien
tatcaatctgactcaggtgtggctg

SEQ ID NO: 666043 - DNA, 25 bp, Homo sapien
aggtgtggctgttgcccctttttga

SEQ ID NO: 666044 - DNA, 25 bp, Homo sapien
tgcccctttttgatatggagggaac

SEQ ID NO: 666045 - DNA, 25 bp, Homo sapien
gggaacactgaaagacagtttcctt

SEQ ID NO: 666046 - DNA, 25 bp, Homo sapien
gacagtttccttctggagttccaaa

SEQ ID NO: 666047 - DNA, 25 bp, Homo sapien
cctaccttgagatcttagtctaggt

SEQ ID NO: 666048 - DNA, 25 bp, Homo sapien
gttaggcacctgtcaatctttcata

SEQ ID NO: 666049 - DNA, 25 bp, Homo sapien
aatctttcatatcagcccacgtgag

SEQ ID NO: 666050 - DNA, 25 bp, Homo sapien
agcccacgtgagatagccagggttt

SEQ ID NO: 666051 - DNA, 25 bp, Homo sapien
aataaaatgctgtttctcctcaaaa

SEQ ID NO: 666052 - DNA, 25 bp, Homo sapien
ctcaaaacacttctctcttcctgat

SEQ ID NO: 666053 - DNA, 25 bp, Homo sapien
gaaattctttctcatgacagggcca

SEQ ID NO: 666054 - DNA, 25 bp, Homo sapien
tttctcatgacagggccaacatgtc

SEQ ID NO: 666055 - DNA, 25 bp, Homo sapien
aaagacagcaataggacttcccaat

SEQ ID NO: 666056 - DNA, 25 bp, Homo sapien
ggacttcccaatcattctatatatt

SEQ ID NO: 666057 - DNA, 25 bp, Homo sapien
atacggttgaactcatgtgattttt

SEQ ID NO: 666058 - DNA, 25 bp, Homo sapien
tttgccatgaagtttcttgttaagc

SEQ ID NO: 666059 - DNA, 25 bp, Homo sapien
tttgcatccatattttcccttccca

SEQ ID NO: 666060 - DNA, 25 bp, Homo sapien
tttttccttgccaacttcttcttct

SEQ ID NO: 666061 - DNA, 25 bp, Homo sapien
attcctttatttgtataatgtctga

SEQ ID NO: 666062 - DNA, 25 bp, Homo sapien
atgtctgaactcaaattggattata

SEQ ID NO: 666063 - DNA, 25 bp, Homo sapien
atagcaaatgcctagattttaatgc

SEQ ID NO: 666064 - DNA, 25 bp, Homo sapien
attttaatgcatgcccttccatcct

SEQ ID NO: 666065 - DNA, 25 bp, Homo sapien
tccatcctttttctagtctgtgcct

SEQ ID NO: 666066 - DNA, 25 bp, Homo sapien
tttctagtctgtgccttcttaattg

SEQ ID NO: 666067 - DNA, 25 bp, Homo sapien
gtccataatagtatgctgcagtgca

SEQ ID NO: 666068 - DNA, 25 bp, Homo sapien
gctgcagtgcaagtattattattgt

SEQ ID NO: 666069 - DNA, 25 bp, Homo sapien
atgttccctgttgtatataatgatg

SEQ ID NO: 666070 - DNA, 25 bp, Homo sapien
gacattgtggtgaggtgagctcccc

SEQ ID NO: 666071 - DNA, 25 bp, Homo sapien
acattgtggtgaggtgagctcccca

SEQ ID NO: 666072 - DNA, 25 bp, Homo sapien
cattgtggtgaggtgagctccccaa

SEQ ID NO: 666073 - DNA, 25 bp, Homo sapien
cccaaaatggcacctcggtcctgga

SEQ ID NO: 666074 - DNA, 25 bp, Homo sapien
ccaaaatggcacctcggtcctggac

SEQ ID NO: 666075 - DNA, 25 bp, Homo sapien
caaaatggcacctcggtcctggacg

SEQ ID NO: 666076 - DNA, 25 bp, Homo sapien
aaaatggcacctcggtcctggacgc

SEQ ID NO: 666077 - DNA, 25 bp, Homo sapien
aaatggcacctcggtcctggacgca

SEQ ID NO: 666078 - DNA, 25 bp, Homo sapien
aatggcacctcggtcctggacgcac

SEQ ID NO: 666079 - DNA, 25 bp, Homo sapien
atggcacctcggtcctggacgcaca

SEQ ID NO: 666080 - DNA, 25 bp, Homo sapien
tggcacctcggtcctggacgcacaa

SEQ ID NO: 666081 - DNA, 25 bp, Homo sapien
attgaagttttaacagattcctggt

SEQ ID NO: 666082 - DNA, 25 bp, Homo sapien
cagattcctggttaggaactgcatt

SEQ ID NO: 666083 - DNA, 25 bp, Homo sapien
ggaactgcattaaagtccttacttc

SEQ ID NO: 666084 - DNA, 25 bp, Homo sapien
taaagtccttacttctcatccagtc

SEQ ID NO: 666085 - DNA, 25 bp, Homo sapien
cttacttctcatccagtccagaaag

SEQ ID NO: 666086 - DNA, 25 bp, Homo sapien
tggccaaggttctcctatatggact

SEQ ID NO: 666087 - DNA, 25 bp, Homo sapien
gccaaggttctcctatatggactag

SEQ ID NO: 666088 - DNA, 25 bp, Homo sapien
caaggttctcctatatggactagga

SEQ ID NO: 666089 - DNA, 25 bp, Homo sapien
aggagaaatatttcctattgagaac

SEQ ID NO: 666090 - DNA, 25 bp, Homo sapien
tgagaacatctatagtgctaccaaa

SEQ ID NO: 666091 - DNA, 25 bp, Homo sapien
catctatagtgctaccaaaattggt

SEQ ID NO: 666092 - DNA, 25 bp, Homo sapien
gccaccacggccaatttattttgta

SEQ ID NO: 666093 - DNA, 25 bp, Homo sapien
caccacggccaatttattttgtatt

SEQ ID NO: 666094 - DNA, 25 bp, Homo sapien
ttctttcttaaatgtcctctttact

SEQ ID NO: 666095 - DNA, 25 bp, Homo sapien
tctttcttaaatgtcctctttactt

SEQ ID NO: 666096 - DNA, 25 bp, Homo sapien
actttctctatcatttttcagacta

SEQ ID NO: 666097 - DNA, 25 bp, Homo sapien
ctttctctatcatttttcagactat

SEQ ID NO: 666098 - DNA, 25 bp, Homo sapien
ttctctatcatttttcagactattc

SEQ ID NO: 666099 - DNA, 25 bp, Homo sapien
ctctatcatttttcagactattctt

SEQ ID NO: 666100 - DNA, 25 bp, Homo sapien
atcatttttcagactattcttatct

SEQ ID NO: 666101 - DNA, 25 bp, Homo sapien
catttttcagactattcttatcttt

SEQ ID NO: 666102 - DNA, 25 bp, Homo sapien
ttcagactattcttatcttttttaa

SEQ ID NO: 666103 - DNA, 25 bp, Homo sapien
gcaactatctgccactccagtgcta

SEQ ID NO: 666104 - DNA, 25 bp, Homo sapien
ctgccactccagtgctatgggagca

SEQ ID NO: 666105 - DNA, 25 bp, Homo sapien
tactgctggtgtgtcttccccaacg

SEQ ID NO: 666106 - DNA, 25 bp, Homo sapien
tgctggtgtgtcttccccaacggca

SEQ ID NO: 666107 - DNA, 25 bp, Homo sapien
accgaaagtactgaccaagtgccag

SEQ ID NO: 666108 - DNA, 25 bp, Homo sapien
gtgccaggaagaggtcagccacatc

SEQ ID NO: 666109 - DNA, 25 bp, Homo sapien
acccgggttcattcaggcccaagtg

SEQ ID NO: 666110 - DNA, 25 bp, Homo sapien
ttcattcaggcccaagtgcgacgag

SEQ ID NO: 666111 - DNA, 25 bp, Homo sapien
ttcaggcccaagtgcgacgagaacg

SEQ ID NO: 666112 - DNA, 25 bp, Homo sapien
agtgcgacgagaacggcaactatct

SEQ ID NO: 666113 - DNA, 25 bp, Homo sapien
acgagaacggcaactatctgccact

SEQ ID NO: 666114 - DNA, 25 bp, Homo sapien
taagagggtttcatgtcgcctggga

SEQ ID NO: 666115 - DNA, 25 bp, Homo sapien
agggtttcatgtcgcctgggaatat

SEQ ID NO: 666116 - DNA, 25 bp, Homo sapien
atgtcgcctgggaatatagttcaag

SEQ ID NO: 666117 - DNA, 25 bp, Homo sapien
caaagggtactatcgaatgtgaaag

SEQ ID NO: 666118 - DNA, 25 bp, Homo sapien
aaaagttttgaatgactgctcacta

SEQ ID NO: 666119 - DNA, 25 bp, Homo sapien
ttgaatgactgctcactaaaatttt

SEQ ID NO: 666120 - DNA, 25 bp, Homo sapien
aatgtatttgtagccttatgtcttt

SEQ ID NO: 666121 - DNA, 25 bp, Homo sapien
atttgtagccttatgtctttttgga

SEQ ID NO: 666122 - DNA, 25 bp, Homo sapien
aatcatttctcaatactttccagat

SEQ ID NO: 666123 - DNA, 25 bp, Homo sapien
tactttccagatagaatttttgtag

SEQ ID NO: 666124 - DNA, 25 bp, Homo sapien
tgtagaacttttagcttaagtttct

SEQ ID NO: 666125 - DNA, 25 bp, Homo sapien
aaaaattgttaatagcagttgggca

SEQ ID NO: 666126 - DNA, 25 bp, Homo sapien
aaaattgttaatagcagttgggcac

SEQ ID NO: 666127 - DNA, 25 bp, Homo sapien
aaattgttaatagcagttgggcacg

SEQ ID NO: 666128 - DNA, 25 bp, Homo sapien
aattgttaatagcagttgggcacgc

SEQ ID NO: 666129 - DNA, 25 bp, Homo sapien
attgttaatagcagttgggcacgct

SEQ ID NO: 666130 - DNA, 25 bp, Homo sapien
ttgttaatagcagttgggcacgctg

SEQ ID NO: 666131 - DNA, 25 bp, Homo sapien
tgttaatagcagttgggcacgctgg

SEQ ID NO: 666132 - DNA, 25 bp, Homo sapien
gttaatagcagttgggcacgctggc

SEQ ID NO: 666133 - DNA, 25 bp, Homo sapien
ttaatagcagttgggcacgctggct

SEQ ID NO: 666134 - DNA, 25 bp, Homo sapien
taatagcagttgggcacgctggctc

SEQ ID NO: 666135 - DNA, 25 bp, Homo sapien
tagcagttgggcacgctggctcacg

SEQ ID NO: 666136 - DNA, 25 bp, Homo sapien
gaaaactaagctccatgagaagagg

SEQ ID NO: 666137 - DNA, 25 bp, Homo sapien
ggacttgcccatgtggctcagggct

SEQ ID NO: 666138 - DNA, 25 bp, Homo sapien
cccatgtggctcagggctctatgcc

SEQ ID NO: 666139 - DNA, 25 bp, Homo sapien
tctatgcccagtgccctagacagtg

SEQ ID NO: 666140 - DNA, 25 bp, Homo sapien
agtgccctagacagtgcctgactgt

SEQ ID NO: 666141 - DNA, 25 bp, Homo sapien
cagtgcctgactgtgtgtgcggaat

SEQ ID NO: 666142 - DNA, 25 bp, Homo sapien
gcctgactgtgtgtgcggaatgaat

SEQ ID NO: 666143 - DNA, 25 bp, Homo sapien
tgcggaatgaatgaataaccttggt

SEQ ID NO: 666144 - DNA, 25 bp, Homo sapien
tgaatgaataaccttggtgatccac

SEQ ID NO: 666145 - DNA, 25 bp, Homo sapien
tggtgatccacccaatggcactggc

SEQ ID NO: 666146 - DNA, 25 bp, Homo sapien
acccaatggcactggcgctcagtga

SEQ ID NO: 666147 - DNA, 25 bp, Homo sapien
ttgataccctcacccttactacact

SEQ ID NO: 666148 - DNA, 25 bp, Homo sapien
ttactacactgtatcctccatttga

SEQ ID NO: 666149 - DNA, 25 bp, Homo sapien
tactacactgtatcctccatttgaa

SEQ ID NO: 666150 - DNA, 25 bp, Homo sapien
actacactgtatcctccatttgaat

SEQ ID NO: 666151 - DNA, 25 bp, Homo sapien
tacactgtatcctccatttgaatgt

SEQ ID NO: 666152 - DNA, 25 bp, Homo sapien
cactgtatcctccatttgaatgttg

SEQ ID NO: 666153 - DNA, 25 bp, Homo sapien
gtatcctccatttgaatgttgtcaa

SEQ ID NO: 666154 - DNA, 25 bp, Homo sapien
gaatgttgtcaagagctcttctcac

SEQ ID NO: 666155 - DNA, 25 bp, Homo sapien
ttttcctactttaggttgctccttg

SEQ ID NO: 666156 - DNA, 25 bp, Homo sapien
ttcctactttaggttgctccttgag

SEQ ID NO: 666157 - DNA, 25 bp, Homo sapien
tcctactttaggttgctccttgagg

SEQ ID NO: 666158 - DNA, 25 bp, Homo sapien
tgatcttggtcaacagtgcagtctt

SEQ ID NO: 666159 - DNA, 25 bp, Homo sapien
agtgcagtcttggtggtcatgatct

SEQ ID NO: 666160 - DNA, 25 bp, Homo sapien
gtcatgatctgttccacctatgttg

SEQ ID NO: 666161 - DNA, 25 bp, Homo sapien
gttccacctatgttgaacactgtgt

SEQ ID NO: 666162 - DNA, 25 bp, Homo sapien
gctagaattattgatgcctgctgaa

SEQ ID NO: 666163 - DNA, 25 bp, Homo sapien
atgcctgctgaatccaaggtttggt

SEQ ID NO: 666164 - DNA, 25 bp, Homo sapien
tggttaatcccgcttcctcaactga

SEQ ID NO: 666165 - DNA, 25 bp, Homo sapien
ttcctcaactgaaggtctggaccct

SEQ ID NO: 666166 - DNA, 25 bp, Homo sapien
aaggtctggaccctggcattgatgc

SEQ ID NO: 666167 - DNA, 25 bp, Homo sapien
ggcattgatgcccatgtcctatctc

SEQ ID NO: 666168 - DNA, 25 bp, Homo sapien
ctcccactgtgtggttttagaatta

SEQ ID NO: 666169 - DNA, 25 bp, Homo sapien
cagctccttcctcagggtgtcgtag

SEQ ID NO: 666170 - DNA, 25 bp, Homo sapien
ttcctcagggtgtcgtagcacaggg

SEQ ID NO: 666171 - DNA, 25 bp, Homo sapien
gtgtcgtagcacagggatgcttttg

SEQ ID NO: 666172 - DNA, 25 bp, Homo sapien
gggatgcttttggtctaattcagga

SEQ ID NO: 666173 - DNA, 25 bp, Homo sapien
ggtctaattcaggagagcatcatgt

SEQ ID NO: 666174 - DNA, 25 bp, Homo sapien
ttttaggtggtatgctatgtgacat

SEQ ID NO: 666175 - DNA, 25 bp, Homo sapien
gtgacataggatgcgatgtgatatt

SEQ ID NO: 666176 - DNA, 25 bp, Homo sapien
gtgatattacatcccatgacactat

SEQ ID NO: 666177 - DNA, 25 bp, Homo sapien
tacatcccatgacactatgttacac

SEQ ID NO: 666178 - DNA, 25 bp, Homo sapien
gttggattaaatgcctgtgtctctg

SEQ ID NO: 666179 - DNA, 25 bp, Homo sapien
ggattaaatgcctgtgtctctggct

SEQ ID NO: 666180 - DNA, 25 bp, Homo sapien
ggtccttcaaccaacagcatcatca

SEQ ID NO: 666181 - DNA, 25 bp, Homo sapien
atcatcaccacccaggaacttatta

SEQ ID NO: 666182 - DNA, 25 bp, Homo sapien
tcaccacccaggaacttattagaaa

SEQ ID NO: 666183 - DNA, 25 bp, Homo sapien
gaaatggaagttcttgcaccctgcc

SEQ ID NO: 666184 - DNA, 25 bp, Homo sapien
aatggaagttcttgcaccctgccaa

SEQ ID NO: 666185 - DNA, 25 bp, Homo sapien
tgcaccctgccaaaaccagaaactg

SEQ ID NO: 666186 - DNA, 25 bp, Homo sapien
agaaactgcggatgggtcccagcaa

SEQ ID NO: 666187 - DNA, 25 bp, Homo sapien
atgggtcccagcaatctttatttta

SEQ ID NO: 666188 - DNA, 25 bp, Homo sapien
ttaacgactgttaaaatcagaatca

SEQ ID NO: 666189 - DNA, 25 bp, Homo sapien
gttcaatatggtagcttctaactat

SEQ ID NO: 666190 - DNA, 25 bp, Homo sapien
gaattttttaatgctattatctcct

SEQ ID NO: 666191 - DNA, 25 bp, Homo sapien
gcaatcattccttttaaatacaaca

SEQ ID NO: 666192 - DNA, 25 bp, Homo sapien
caatcattccttttaaatacaacag

SEQ ID NO: 666193 - DNA, 25 bp, Homo sapien
aatcattccttttaaatacaacaga

SEQ ID NO: 666194 - DNA, 25 bp, Homo sapien
atcattccttttaaatacaacagag

SEQ ID NO: 666195 - DNA, 25 bp, Homo sapien
tcattccttttaaatacaacagagt

SEQ ID NO: 666196 - DNA, 25 bp, Homo sapien
cattccttttaaatacaacagagtt

SEQ ID NO: 666197 - DNA, 25 bp, Homo sapien
agtaaacaaatgtaggctggacgcc

SEQ ID NO: 666198 - DNA, 25 bp, Homo sapien
gtaaacaaatgtaggctggacgccg

SEQ ID NO: 666199 - DNA, 25 bp, Homo sapien
taaacaaatgtaggctggacgccgt

SEQ ID NO: 666200 - DNA, 25 bp, Homo sapien
aaacaaatgtaggctggacgccgtg

SEQ ID NO: 666201 - DNA, 25 bp, Homo sapien
aacaaatgtaggctggacgccgtgg

SEQ ID NO: 666202 - DNA, 25 bp, Homo sapien
agatcttttgcctgatcgactactc

SEQ ID NO: 666203 - DNA, 25 bp, Homo sapien
gatcgactactctctgatatagacc

SEQ ID NO: 666204 - DNA, 25 bp, Homo sapien
gatatagacctctttctgtcggacc

SEQ ID NO: 666205 - DNA, 25 bp, Homo sapien
tgtcggaccgggaattcttatcctt

SEQ ID NO: 666206 - DNA, 25 bp, Homo sapien
atcctttgatccttttgtatctcta

SEQ ID NO: 666207 - DNA, 25 bp, Homo sapien
tctctactactaccaccttttgaag

SEQ ID NO: 666208 - DNA, 25 bp, Homo sapien
ttgtgacttctttctagtcctgaag

SEQ ID NO: 666209 - DNA, 25 bp, Homo sapien
tttctatctctattatgtccccggc

SEQ ID NO: 666210 - DNA, 25 bp, Homo sapien
tggcttcttccattaacgccttttg

SEQ ID NO: 666211 - DNA, 25 bp, Homo sapien
aacgccttttgtctttcctgtatga

SEQ ID NO: 666212 - DNA, 25 bp, Homo sapien
gtatgattttcggtctctttcactt

SEQ ID NO: 666213 - DNA, 25 bp, Homo sapien
gtctgtatgtcctagcactgttcaa

SEQ ID NO: 666214 - DNA, 25 bp, Homo sapien
atgtcctagcactgttcaacaacaa

SEQ ID NO: 666215 - DNA, 25 bp, Homo sapien
gttatacaatggaagcacaatgtta

SEQ ID NO: 666216 - DNA, 25 bp, Homo sapien
gtaattttaagctaacaaccagtgc

SEQ ID NO: 666217 - DNA, 25 bp, Homo sapien
taacaaccagtgcacagcctcaggt

SEQ ID NO: 666218 - DNA, 25 bp, Homo sapien
ccagtgcacagcctcaggttttaaa

SEQ ID NO: 666219 - DNA, 25 bp, Homo sapien
cacagcctcaggttttaaattacaa

SEQ ID NO: 666220 - DNA, 25 bp, Homo sapien
aaattttcattttgcagttccagag

SEQ ID NO: 666221 - DNA, 25 bp, Homo sapien
ttcattttgcagttccagagctgct

SEQ ID NO: 666222 - DNA, 25 bp, Homo sapien
tccagagctgcttacctatgttggt

SEQ ID NO: 666223 - DNA, 25 bp, Homo sapien
tgcttacctatgttggtttgccaaa

SEQ ID NO: 666224 - DNA, 25 bp, Homo sapien
gagtgcctgcagaaactcccaaggc

SEQ ID NO: 666225 - DNA, 25 bp, Homo sapien
ccttttgggtccagaagacctgcat

SEQ ID NO: 666226 - DNA, 25 bp, Homo sapien
agacctgcatatgggctgttgactc

SEQ ID NO: 666227 - DNA, 25 bp, Homo sapien
catatgggctgttgactcatgcaaa

SEQ ID NO: 666228 - DNA, 25 bp, Homo sapien
tatgggctgttgactcatgcaaatg

SEQ ID NO: 666229 - DNA, 25 bp, Homo sapien
caaatgaggtatctgaactgcagct

SEQ ID NO: 666230 - DNA, 25 bp, Homo sapien
gaactgcagcttcagtattagcaga

SEQ ID NO: 666231 - DNA, 25 bp, Homo sapien
cagtattagcagagccacaggccgc

SEQ ID NO: 666232 - DNA, 25 bp, Homo sapien
catcaccagggtttctctgaagaag

SEQ ID NO: 666233 - DNA, 25 bp, Homo sapien
ttttcctaaacccagtgctgctctc

SEQ ID NO: 666234 - DNA, 25 bp, Homo sapien
atcttcctctcgcagcttgatgagc

SEQ ID NO: 666235 - DNA, 25 bp, Homo sapien
gtttacctcgctaatacttcttaat

SEQ ID NO: 666236 - DNA, 25 bp, Homo sapien
tttacctcgctaatacttcttaata

SEQ ID NO: 666237 - DNA, 25 bp, Homo sapien
tacctcgctaatacttcttaataac

SEQ ID NO: 666238 - DNA, 25 bp, Homo sapien
cctcgctaatacttcttaataacat

SEQ ID NO: 666239 - DNA, 25 bp, Homo sapien
tggcatttggtgcttatggacttag

SEQ ID NO: 666240 - DNA, 25 bp, Homo sapien
ggcatttggtgcttatggacttagt

SEQ ID NO: 666241 - DNA, 25 bp, Homo sapien
gcatttggtgcttatggacttagta

SEQ ID NO: 666242 - DNA, 25 bp, Homo sapien
catttggtgcttatggacttagtac

SEQ ID NO: 666243 - DNA, 25 bp, Homo sapien
tttggtgcttatggacttagtaccc

SEQ ID NO: 666244 - DNA, 25 bp, Homo sapien
gtacccaggcaacaaagatctatta

SEQ ID NO: 666245 - DNA, 25 bp, Homo sapien
tacccaggcaacaaagatctattat

SEQ ID NO: 666246 - DNA, 25 bp, Homo sapien
ggacgccctcagtagcttacacgga

SEQ ID NO: 666247 - DNA, 25 bp, Homo sapien
tcagtagcttacacggactgcccat

SEQ ID NO: 666248 - DNA, 25 bp, Homo sapien
gagcccggagggaacggcaggcgga

SEQ ID NO: 666249 - DNA, 25 bp, Homo sapien
aacggcaggcggacccgggcgcaca

SEQ ID NO: 666250 - DNA, 25 bp, Homo sapien
ccggcaatcggcacgggcaggatcg

SEQ ID NO: 666251 - DNA, 25 bp, Homo sapien
gcacgggcaggatcggaggactcgc

SEQ ID NO: 666252 - DNA, 25 bp, Homo sapien
gatcggaggactcgcggaggaggaa

SEQ ID NO: 666253 - DNA, 25 bp, Homo sapien
accacacttcctttattggtctggg

SEQ ID NO: 666254 - DNA, 25 bp, Homo sapien
cacacttcctttattggtctgggtt

SEQ ID NO: 666255 - DNA, 25 bp, Homo sapien
tattggtctgggtttttaggcttct

SEQ ID NO: 666256 - DNA, 25 bp, Homo sapien
tctgggtttttaggcttctctgaac

SEQ ID NO: 666257 - DNA, 25 bp, Homo sapien
atgaatggaaagagagcatgcaaga

SEQ ID NO: 666258 - DNA, 25 bp, Homo sapien
ttttaagttctctaacaagactcct

SEQ ID NO: 666259 - DNA, 25 bp, Homo sapien
tttaagttctctaacaagactccta

SEQ ID NO: 666260 - DNA, 25 bp, Homo sapien
ttaagttctctaacaagactcctac

SEQ ID NO: 666261 - DNA, 25 bp, Homo sapien
taagttctctaacaagactcctacc

SEQ ID NO: 666262 - DNA, 25 bp, Homo sapien
aagttctctaacaagactcctacct

SEQ ID NO: 666263 - DNA, 25 bp, Homo sapien
agttctctaacaagactcctacctt

SEQ ID NO: 666264 - DNA, 25 bp, Homo sapien
gttctctaacaagactcctaccttg

SEQ ID NO: 666265 - DNA, 25 bp, Homo sapien
ttctctaacaagactcctaccttga

SEQ ID NO: 666266 - DNA, 25 bp, Homo sapien
tctctaacaagactcctaccttgag

SEQ ID NO: 666267 - DNA, 25 bp, Homo sapien
ctctaacaagactcctaccttgaga

SEQ ID NO: 666268 - DNA, 25 bp, Homo sapien
aagaaagggcagccaggtgtggtgg

SEQ ID NO: 666269 - DNA, 25 bp, Homo sapien
tcctggccaatgtggtgaaatggtg

SEQ ID NO: 666270 - DNA, 25 bp, Homo sapien
cctggccaatgtggtgaaatggtga

SEQ ID NO: 666271 - DNA, 25 bp, Homo sapien
ctggccaatgtggtgaaatggtgaa

SEQ ID NO: 666272 - DNA, 25 bp, Homo sapien
tggccaatgtggtgaaatggtgaaa

SEQ ID NO: 666273 - DNA, 25 bp, Homo sapien
ggccaatgtggtgaaatggtgaaac

SEQ ID NO: 666274 - DNA, 25 bp, Homo sapien
gccaatgtggtgaaatggtgaaacc

SEQ ID NO: 666275 - DNA, 25 bp, Homo sapien
ccaatgtggtgaaatggtgaaaccc

SEQ ID NO: 666276 - DNA, 25 bp, Homo sapien
caatgtggtgaaatggtgaaaccct

SEQ ID NO: 666277 - DNA, 25 bp, Homo sapien
aatgtggtgaaatggtgaaaccctg

SEQ ID NO: 666278 - DNA, 25 bp, Homo sapien
atgtggtgaaatggtgaaaccctgt

SEQ ID NO: 666279 - DNA, 25 bp, Homo sapien
taaatggcctgctctgtctgctcca

SEQ ID NO: 666280 - DNA, 25 bp, Homo sapien
tgctctgtctgctccatagagttca

SEQ ID NO: 666281 - DNA, 25 bp, Homo sapien
ctgtctgctccatagagttcagtga

SEQ ID NO: 666282 - DNA, 25 bp, Homo sapien
tgctccatagagttcagtgatacag

SEQ ID NO: 666283 - DNA, 25 bp, Homo sapien
cagtgcgtatgtgttgtggaatgta

SEQ ID NO: 666284 - DNA, 25 bp, Homo sapien
ggttttattagcctttgtgatccaa

SEQ ID NO: 666285 - DNA, 25 bp, Homo sapien
ttagcctttgtgatccaaaaattat

SEQ ID NO: 666286 - DNA, 25 bp, Homo sapien
atattttttgaccagatgtgtgtgt

SEQ ID NO: 666287 - DNA, 25 bp, Homo sapien
gaccagatgtgtgtgtatcatatca

SEQ ID NO: 666288 - DNA, 25 bp, Homo sapien
gagcactacagatagtcaactttga

SEQ ID NO: 666289 - DNA, 25 bp, Homo sapien
gtactgacaatacattagtcttctt

SEQ ID NO: 666290 - DNA, 25 bp, Homo sapien
aaggcttgccttcaggaacaggttt

SEQ ID NO: 666291 - DNA, 25 bp, Homo sapien
gaacaggtttcccatcacatagctg

SEQ ID NO: 666292 - DNA, 25 bp, Homo sapien
tttcccatcacatagctgcccaagt

SEQ ID NO: 666293 - DNA, 25 bp, Homo sapien
aagtcccagggcatccatacgttca

SEQ ID NO: 666294 - DNA, 25 bp, Homo sapien
tggagccagccgaatgcttgttact

SEQ ID NO: 666295 - DNA, 25 bp, Homo sapien
gccgaatgcttgttactgggcatgt

SEQ ID NO: 666296 - DNA, 25 bp, Homo sapien
cttgcaggacaactaagggcatcta

SEQ ID NO: 666297 - DNA, 25 bp, Homo sapien
agggcatctagcagcagtagccaga

SEQ ID NO: 666298 - DNA, 25 bp, Homo sapien
agtagccagagagcctaaagaaaga

SEQ ID NO: 666299 - DNA, 25 bp, Homo sapien
aaaccagatgttatgagagtacttt

SEQ ID NO: 666300 - DNA, 25 bp, Homo sapien
gagtactttagtaggcaaaatcgca

SEQ ID NO: 666301 - DNA, 25 bp, Homo sapien
agagctgagtcatcctagagcaaac

SEQ ID NO: 666302 - DNA, 25 bp, Homo sapien
gagtcatcctagagcaaacctctgg

SEQ ID NO: 666303 - DNA, 25 bp, Homo sapien
atcctagagcaaacctctggagtgg

SEQ ID NO: 666304 - DNA, 25 bp, Homo sapien
tctggagtggagagcgaactacttc

SEQ ID NO: 666305 - DNA, 25 bp, Homo sapien
gagtggagagcgaactacttcattc

SEQ ID NO: 666306 - DNA, 25 bp, Homo sapien
tggagagcgaactacttcattcccc

SEQ ID NO: 666307 - DNA, 25 bp, Homo sapien
gagagcgaactacttcattcccctc

SEQ ID NO: 666308 - DNA, 25 bp, Homo sapien
taacgatgaaatatctggcaccact

SEQ ID NO: 666309 - DNA, 25 bp, Homo sapien
cgatgaaatatctggcaccactgat

SEQ ID NO: 666310 - DNA, 25 bp, Homo sapien
gcaccactgatgaatattaaacttt

SEQ ID NO: 666311 - DNA, 25 bp, Homo sapien
gatgaatattaaactttctataacc

SEQ ID NO: 666312 - DNA, 25 bp, Homo sapien
cagttatgctacatgagtttagggt

SEQ ID NO: 666313 - DNA, 25 bp, Homo sapien
gttatgctacatgagtttagggtcg

SEQ ID NO: 666314 - DNA, 25 bp, Homo sapien
tatgctacatgagtttagggtcgag

SEQ ID NO: 666315 - DNA, 25 bp, Homo sapien
gctacatgagtttagggtcgaggat

SEQ ID NO: 666316 - DNA, 25 bp, Homo sapien
tacatgagtttagggtcgaggatta

SEQ ID NO: 666317 - DNA, 25 bp, Homo sapien
catgagtttagggtcgaggattatt

SEQ ID NO: 666318 - DNA, 25 bp, Homo sapien
gagtttagggtcgaggattattttg

SEQ ID NO: 666319 - DNA, 25 bp, Homo sapien
tttagggtcgaggattattttgtgg

SEQ ID NO: 666320 - DNA, 25 bp, Homo sapien
aagaagagtttgcctaaagtcgtgt

SEQ ID NO: 666321 - DNA, 25 bp, Homo sapien
caactagtactagaatttctatttt

SEQ ID NO: 666322 - DNA, 25 bp, Homo sapien
gttttcaccctatgccacatatttt

SEQ ID NO: 666323 - DNA, 25 bp, Homo sapien
agcgtgcggaggtgtctgaactaaa

SEQ ID NO: 666324 - DNA, 25 bp, Homo sapien
cgtgcggaggtgtctgaactaaaat

SEQ ID NO: 666325 - DNA, 25 bp, Homo sapien
ctgaactaaaatgtggtgacctgga

SEQ ID NO: 666326 - DNA, 25 bp, Homo sapien
gaagaactcaagaatgttactaaca

SEQ ID NO: 666327 - DNA, 25 bp, Homo sapien
gttactaacaatctgaaatctctgg

SEQ ID NO: 666328 - DNA, 25 bp, Homo sapien
aacaatctgaaatctctggaggctg

SEQ ID NO: 666329 - DNA, 25 bp, Homo sapien
ctgaaatctctggaggctgcatctg

SEQ ID NO: 666330 - DNA, 25 bp, Homo sapien
ggaggctgcatctgaaaagtattct

SEQ ID NO: 666331 - DNA, 25 bp, Homo sapien
ggctgcatctgaaaagtattctgaa

SEQ ID NO: 666332 - DNA, 25 bp, Homo sapien
gaaattaaacttctgtctgacaaac

SEQ ID NO: 666333 - DNA, 25 bp, Homo sapien
aacttctgtctgacaaactgaaaga

SEQ ID NO: 666334 - DNA, 25 bp, Homo sapien
ttcgcctttggattggcctgtggtc

SEQ ID NO: 666335 - DNA, 25 bp, Homo sapien
attggcctgtggtccgccttcctat

SEQ ID NO: 666336 - DNA, 25 bp, Homo sapien
gccttcctatgtctcattttggtag

SEQ ID NO: 666337 - DNA, 25 bp, Homo sapien
ctcattttggtagccactgatgcca

SEQ ID NO: 666338 - DNA, 25 bp, Homo sapien
atgccagcttcttggttcaatactt

SEQ ID NO: 666339 - DNA, 25 bp, Homo sapien
ggttcaatacttcacacgtttcacg

SEQ ID NO: 666340 - DNA, 25 bp, Homo sapien
aggagggcttttcctctctgattag

SEQ ID NO: 666341 - DNA, 25 bp, Homo sapien
tcaagcttgcagattactaccccat

SEQ ID NO: 666342 - DNA, 25 bp, Homo sapien
atcaactccaacttcaaagtgggct

SEQ ID NO: 666343 - DNA, 25 bp, Homo sapien
aagtgggctacaacactctcttttc

SEQ ID NO: 666344 - DNA, 25 bp, Homo sapien
caacactctcttttcctgtacctgt

SEQ ID NO: 666345 - DNA, 25 bp, Homo sapien
tggtgtttactgtaggcctctccac

SEQ ID NO: 666346 - DNA, 25 bp, Homo sapien
gtaggcctctccacagactgctatt

SEQ ID NO: 666347 - DNA, 25 bp, Homo sapien
tccacagactgctattcctcaaaac

SEQ ID NO: 666348 - DNA, 25 bp, Homo sapien
tggcaactgagttctaagagcaaac

SEQ ID NO: 666349 - DNA, 25 bp, Homo sapien
gaatgttgatgactatcctgtggaa

SEQ ID NO: 666350 - DNA, 25 bp, Homo sapien
ggaagtcacataatggtctttttca

SEQ ID NO: 666351 - DNA, 25 bp, Homo sapien
tggtctttttcagctactcattggt

SEQ ID NO: 666352 - DNA, 25 bp, Homo sapien
ggttgaggccatcataaagacctat

SEQ ID NO: 666353 - DNA, 25 bp, Homo sapien
aaagacctatagtggttcaagtaga

SEQ ID NO: 666354 - DNA, 25 bp, Homo sapien
gcaaagttctagcagaccatgtgga

SEQ ID NO: 666355 - DNA, 25 bp, Homo sapien
aacaagagatattgttgtggccatc

SEQ ID NO: 666356 - DNA, 25 bp, Homo sapien
gcgccttcgaggagagccgctacaa

SEQ ID NO: 666357 - DNA, 25 bp, Homo sapien
ccttcgaggagagccgctacaagtt

SEQ ID NO: 666358 - DNA, 25 bp, Homo sapien
tcgaggagagccgctacaagttcta

SEQ ID NO: 666359 - DNA, 25 bp, Homo sapien
tcacgctcacgctgctggtgccctg

SEQ ID NO: 666360 - DNA, 25 bp, Homo sapien
tgcgtcgtcatcctggccaaagccc

SEQ ID NO: 666361 - DNA, 25 bp, Homo sapien
cgcagactcgccaggatccggagag

SEQ ID NO: 666362 - DNA, 25 bp, Homo sapien
gagagggagagcaccatcaagttca

SEQ ID NO: 666363 - DNA, 25 bp, Homo sapien
gagggagagcaccatcaagttcacg

SEQ ID NO: 666364 - DNA, 25 bp, Homo sapien
ggagagcaccatcaagttcacgctg

SEQ ID NO: 666365 - DNA, 25 bp, Homo sapien
agagcaccatcaagttcacgctgcc

SEQ ID NO: 666366 - DNA, 25 bp, Homo sapien
tcaagttcacgctgcccacagacca

SEQ ID NO: 666367 - DNA, 25 bp, Homo sapien
tcctggtataaggtgattgaattat

SEQ ID NO: 666368 - DNA, 25 bp, Homo sapien
cccttgtaccatccttacaataatg

SEQ ID NO: 666369 - DNA, 25 bp, Homo sapien
atccttacaataatgagtgacttct

SEQ ID NO: 666370 - DNA, 25 bp, Homo sapien
gatgtggtcactgaaaactctatat

SEQ ID NO: 666371 - DNA, 25 bp, Homo sapien
gtggtcactgaaaactctatatcac

SEQ ID NO: 666372 - DNA, 25 bp, Homo sapien
gtgttttccccttgccatgtgagac

SEQ ID NO: 666373 - DNA, 25 bp, Homo sapien
ttccccttgccatgtgagacaattg

SEQ ID NO: 666374 - DNA, 25 bp, Homo sapien
cttgccatgtgagacaattgattct

SEQ ID NO: 666375 - DNA, 25 bp, Homo sapien
caattgattctttctttgccttcca

SEQ ID NO: 666376 - DNA, 25 bp, Homo sapien
gcagaagcactctgcttagaaccat

SEQ ID NO: 666377 - DNA, 25 bp, Homo sapien
agcactctgcttagaaccatgagcc

SEQ ID NO: 666378 - DNA, 25 bp, Homo sapien
gccgggtccgcatggtctcaatgga

SEQ ID NO: 666379 - DNA, 25 bp, Homo sapien
gcatggtctcaatggactcctacag

SEQ ID NO: 666380 - DNA, 25 bp, Homo sapien
caatggactcctacagggcagcggg

SEQ ID NO: 666381 - DNA, 25 bp, Homo sapien
gaggctgtattaaccctgggaggta

SEQ ID NO: 666382 - DNA, 25 bp, Homo sapien
aaccctgggaggtacagctgcaaac

SEQ ID NO: 666383 - DNA, 25 bp, Homo sapien
gcaaacacagacttgttcaggctaa

SEQ ID NO: 666384 - DNA, 25 bp, Homo sapien
gttcaggctaagttcaaatcctcac

SEQ ID NO: 666385 - DNA, 25 bp, Homo sapien
tcactggctgtgaccatgagcaact

SEQ ID NO: 666386 - DNA, 25 bp, Homo sapien
gagcaacttaattaacctatctgag

SEQ ID NO: 666387 - DNA, 25 bp, Homo sapien
ttcctcttctataagcttccaaatt

SEQ ID NO: 666388 - DNA, 25 bp, Homo sapien
aattgctgtgaacatttaatgccta

SEQ ID NO: 666389 - DNA, 25 bp, Homo sapien
gggtgtccatcacaaaagccgaggt

SEQ ID NO: 666390 - DNA, 25 bp, Homo sapien
gtgtccatcacaaaagccgaggtag

SEQ ID NO: 666391 - DNA, 25 bp, Homo sapien
atcacaaaagccgaggtagcccctg

SEQ ID NO: 666392 - DNA, 25 bp, Homo sapien
acaaaagccgaggtagcccctgaag

SEQ ID NO: 666393 - DNA, 25 bp, Homo sapien
caaaagccgaggtagcccctgaaga

SEQ ID NO: 666394 - DNA, 25 bp, Homo sapien
agccgaggtagcccctgaagaagat

SEQ ID NO: 666395 - DNA, 25 bp, Homo sapien
tgaaaggaaaaagaggcgacgagaa

SEQ ID NO: 666396 - DNA, 25 bp, Homo sapien
gaaagaaataagattgcagctgcaa

SEQ ID NO: 666397 - DNA, 25 bp, Homo sapien
gattgcagctgcaaagtgccgaaac

SEQ ID NO: 666398 - DNA, 25 bp, Homo sapien
gcagctgcaaagtgccgaaacaaga

SEQ ID NO: 666399 - DNA, 25 bp, Homo sapien
ctgcaaagtgccgaaacaagaagaa

SEQ ID NO: 666400 - DNA, 25 bp, Homo sapien
gtctcttggcttactaacatatgct

SEQ ID NO: 666401 - DNA, 25 bp, Homo sapien
cttggcttactaacatatgcttaaa

SEQ ID NO: 666402 - DNA, 25 bp, Homo sapien
caaccaagctgaataggctacattt

SEQ ID NO: 666403 - DNA, 25 bp, Homo sapien
gaataggctacatttaatgctatga

SEQ ID NO: 666404 - DNA, 25 bp, Homo sapien
aatgctatgaaagctctgtatctat

SEQ ID NO: 666405 - DNA, 25 bp, Homo sapien
gctctgtatctatgtgctttatatc

SEQ ID NO: 666406 - DNA, 25 bp, Homo sapien
gtatctatgtgctttatatcccatc

SEQ ID NO: 666407 - DNA, 25 bp, Homo sapien
ttatatcccatcttgtttctgttga

SEQ ID NO: 666408 - DNA, 25 bp, Homo sapien
atcccatcttgtttctgttgataag

SEQ ID NO: 666409 - DNA, 25 bp, Homo sapien
gaaactgctttaattcctttgtata

SEQ ID NO: 666410 - DNA, 25 bp, Homo sapien
attttagaaagtctcttggcttact

SEQ ID NO: 666411 - DNA, 25 bp, Homo sapien
gtcactgcaatctgtgacattccag

SEQ ID NO: 666412 - DNA, 25 bp, Homo sapien
cattccagatggtagagtgtgagcc

SEQ ID NO: 666413 - DNA, 25 bp, Homo sapien
agagtgtgagccagcctgtgttcct

SEQ ID NO: 666414 - DNA, 25 bp, Homo sapien
gtgttcctgaatgcagatgacatgg

SEQ ID NO: 666415 - DNA, 25 bp, Homo sapien
gacatggagcagagttccagccaat

SEQ ID NO: 666416 - DNA, 25 bp, Homo sapien
gttccagccaatctgcaatagttgt

SEQ ID NO: 666417 - DNA, 25 bp, Homo sapien
tggaattgtttattactgtggcata

SEQ ID NO: 666418 - DNA, 25 bp, Homo sapien
ctgtggcataatctagtctattttg

SEQ ID NO: 666419 - DNA, 25 bp, Homo sapien
ttccaaaatcctcatagaattcagt

SEQ ID NO: 666420 - DNA, 25 bp, Homo sapien
gaattcagttgtatggtgtgatcaa

SEQ ID NO: 666421 - DNA, 25 bp, Homo sapien
attcaatgtattgggttttgtcctt

SEQ ID NO: 666422 - DNA, 25 bp, Homo sapien
aacagtcaaactatatccggtatat

SEQ ID NO: 666423 - DNA, 25 bp, Homo sapien
tactgggtgataattctgttttacg

SEQ ID NO: 666424 - DNA, 25 bp, Homo sapien
gaattgccaaactatcttcctcagc

SEQ ID NO: 666425 - DNA, 25 bp, Homo sapien
cttcctcagcagttaaaccatttac

SEQ ID NO: 666426 - DNA, 25 bp, Homo sapien
agcagttaaaccatttacattccca

SEQ ID NO: 666427 - DNA, 25 bp, Homo sapien
ccaccagcagtatactaggtttcca

SEQ ID NO: 666428 - DNA, 25 bp, Homo sapien
gtatactaggtttccaatttctcca

SEQ ID NO: 666429 - DNA, 25 bp, Homo sapien
ccaatttctccacatgttcaacaac

SEQ ID NO: 666430 - DNA, 25 bp, Homo sapien
ttttcttctaattatagccattcta

SEQ ID NO: 666431 - DNA, 25 bp, Homo sapien
agtaggtacaaagtggtatctcatt

SEQ ID NO: 666432 - DNA, 25 bp, Homo sapien
tttagcatcttttgagttgcttatt

SEQ ID NO: 666433 - DNA, 25 bp, Homo sapien
gcaacttatgccctcctgtgtgaaa

SEQ ID NO: 666434 - DNA, 25 bp, Homo sapien
aacttatgccctcctgtgtgaaaat

SEQ ID NO: 666435 - DNA, 25 bp, Homo sapien
acttatgccctcctgtgtgaaaatc

SEQ ID NO: 666436 - DNA, 25 bp, Homo sapien
ttatgccctcctgtgtgaaaatctc

SEQ ID NO: 666437 - DNA, 25 bp, Homo sapien
atgccctcctgtgtgaaaatctcca

SEQ ID NO: 666438 - DNA, 25 bp, Homo sapien
tgtgtgaaaatctccactcccaatg

SEQ ID NO: 666439 - DNA, 25 bp, Homo sapien
tgtgaaaatctccactcccaatgtc

SEQ ID NO: 666440 - DNA, 25 bp, Homo sapien
tgaaaatctccactcccaatgtctg

SEQ ID NO: 666441 - DNA, 25 bp, Homo sapien
aaaatctccactcccaatgtctgag

SEQ ID NO: 666442 - DNA, 25 bp, Homo sapien
atctccactcccaatgtctgagggt

SEQ ID NO: 666443 - DNA, 25 bp, Homo sapien
ctccactcccaatgtctgagggttc

SEQ ID NO: 666444 - DNA, 25 bp, Homo sapien
aagggtaagatgttcaacgctgggc

SEQ ID NO: 666445 - DNA, 25 bp, Homo sapien
ggtaagatgttcaacgctgggcgca

SEQ ID NO: 666446 - DNA, 25 bp, Homo sapien
taagatgttcaacgctgggcgcagt

SEQ ID NO: 666447 - DNA, 25 bp, Homo sapien
tcagcaccgtaggaggctgaggaaa

SEQ ID NO: 666448 - DNA, 25 bp, Homo sapien
caacatagtaagacttcgtttctat

SEQ ID NO: 666449 - DNA, 25 bp, Homo sapien
gtaagacttcgtttctataaataat

SEQ ID NO: 666450 - DNA, 25 bp, Homo sapien
tcgtttgagcccgggcagttgtgac

SEQ ID NO: 666451 - DNA, 25 bp, Homo sapien
cagttgtgactgcagtgatccctga

SEQ ID NO: 666452 - DNA, 25 bp, Homo sapien
agttgtgactgcagtgatccctgat

SEQ ID NO: 666453 - DNA, 25 bp, Homo sapien
ttgtgactgcagtgatccctgatca

SEQ ID NO: 666454 - DNA, 25 bp, Homo sapien
gtgactgcagtgatccctgatcatg

SEQ ID NO: 666455 - DNA, 25 bp, Homo sapien
gagactctgtattataccaaaacaa

SEQ ID NO: 666456 - DNA, 25 bp, Homo sapien
tttgtaaatagccaggtgcactggc

SEQ ID NO: 666457 - DNA, 25 bp, Homo sapien
aaatagccaggtgcactggcatgca

SEQ ID NO: 666458 - DNA, 25 bp, Homo sapien
atagccaggtgcactggcatgcacc

SEQ ID NO: 666459 - DNA, 25 bp, Homo sapien
aggtgcactggcatgcacccataat

SEQ ID NO: 666460 - DNA, 25 bp, Homo sapien
tgcactggcatgcacccataatcct

SEQ ID NO: 666461 - DNA, 25 bp, Homo sapien
cactggcatgcacccataatcctag

SEQ ID NO: 666462 - DNA, 25 bp, Homo sapien
ctggcatgcacccataatcctagct

SEQ ID NO: 666463 - DNA, 25 bp, Homo sapien
attctagtccaacctctaacagagc

SEQ ID NO: 666464 - DNA, 25 bp, Homo sapien
ttctagtccaacctctaacagagca

SEQ ID NO: 666465 - DNA, 25 bp, Homo sapien
ctagtccaacctctaacagagcaag

SEQ ID NO: 666466 - DNA, 25 bp, Homo sapien
ggacaatcagaagtctctgccacaa

SEQ ID NO: 666467 - DNA, 25 bp, Homo sapien
tcagaagtctctgccacaaagtgag

SEQ ID NO: 666468 - DNA, 25 bp, Homo sapien
gagacccctcaaagtgggtggcaat

SEQ ID NO: 666469 - DNA, 25 bp, Homo sapien
gtggcaataaatgttggtcctctct

SEQ ID NO: 666470 - DNA, 25 bp, Homo sapien
ataaatgttggtcctctcttccctt

SEQ ID NO: 666471 - DNA, 25 bp, Homo sapien
aaggcaaaaccagagggtggctgca

SEQ ID NO: 666472 - DNA, 25 bp, Homo sapien
cagggataactgctggtagagccaa

SEQ ID NO: 666473 - DNA, 25 bp, Homo sapien
actgctggtagagccaacatctgtt

SEQ ID NO: 666474 - DNA, 25 bp, Homo sapien
ggctagtttaatcacatgagatgca

SEQ ID NO: 666475 - DNA, 25 bp, Homo sapien
gatgcatgtacttggttaagacctc

SEQ ID NO: 666476 - DNA, 25 bp, Homo sapien
agatctctgctgtatgcatgaaaga

SEQ ID NO: 666477 - DNA, 25 bp, Homo sapien
gagagatttgcagttatgctacatg

SEQ ID NO: 666478 - DNA, 25 bp, Homo sapien
aaagaagagtttgcctaaagtcgtg

SEQ ID NO: 666479 - DNA, 25 bp, Homo sapien
aattggttgcagttttcaccctatg

SEQ ID NO: 666480 - DNA, 25 bp, Homo sapien
agttttcaccctatgccacatattt

SEQ ID NO: 666481 - DNA, 25 bp, Homo sapien
gccacatattttcttctatctttgg

SEQ ID NO: 666482 - DNA, 25 bp, Homo sapien
atcaggtgaacaggaagtctcaaat

SEQ ID NO: 666483 - DNA, 25 bp, Homo sapien
aggtgaacaggaagtctcaaatttc

SEQ ID NO: 666484 - DNA, 25 bp, Homo sapien
gaacaggaagtctcaaatttctgaa

SEQ ID NO: 666485 - DNA, 25 bp, Homo sapien
aacaggaagtctcaaatttctgaat

SEQ ID NO: 666486 - DNA, 25 bp, Homo sapien
ttatgttctaaaaggttaccatgtg

SEQ ID NO: 666487 - DNA, 25 bp, Homo sapien
tgttctaaaaggttaccatgtgatg

SEQ ID NO: 666488 - DNA, 25 bp, Homo sapien
ttcttagttaccttatttcacttag

SEQ ID NO: 666489 - DNA, 25 bp, Homo sapien
tcttagttaccttatttcacttagc

SEQ ID NO: 666490 - DNA, 25 bp, Homo sapien
gtgaaataaggtaagccagaccctt

SEQ ID NO: 666491 - DNA, 25 bp, Homo sapien
taagccagacccttacctaacaaca

SEQ ID NO: 666492 - DNA, 25 bp, Homo sapien
agccagacccttacctaacaacata

SEQ ID NO: 666493 - DNA, 25 bp, Homo sapien
ccagacccttacctaacaacatata

SEQ ID NO: 666494 - DNA, 25 bp, Homo sapien
cagacccttacctaacaacatataa

SEQ ID NO: 666495 - DNA, 25 bp, Homo sapien
ttaacccaaaatgcatcaaatacct

SEQ ID NO: 666496 - DNA, 25 bp, Homo sapien
cccaaaatgcatcaaatacctaaag

SEQ ID NO: 666497 - DNA, 25 bp, Homo sapien
aatacctaaagataagagctcttgt

SEQ ID NO: 666498 - DNA, 25 bp, Homo sapien
ataagagctcttgttttcttagaat

SEQ ID NO: 666499 - DNA, 25 bp, Homo sapien
atgtaactgcttctttgctgtggca

SEQ ID NO: 666500 - DNA, 25 bp, Homo sapien
ctcctcttctgaaaccttgatactt

SEQ ID NO: 666501 - DNA, 25 bp, Homo sapien
gaaaccttgatacttccctatgaag

SEQ ID NO: 666502 - DNA, 25 bp, Homo sapien
tgaagccccgccttgggcttgtgac

SEQ ID NO: 666503 - DNA, 25 bp, Homo sapien
gggcttgtgacttgcttgtaaccag

SEQ ID NO: 666504 - DNA, 25 bp, Homo sapien
gcttgtaaccagtcaaatacagtgg

SEQ ID NO: 666505 - DNA, 25 bp, Homo sapien
agagttactacgtgacttccagggc

SEQ ID NO: 666506 - DNA, 25 bp, Homo sapien
gacttccagggctaggtcagaaaag

SEQ ID NO: 666507 - DNA, 25 bp, Homo sapien
aggatgcagcctcagggttcaacac

SEQ ID NO: 666508 - DNA, 25 bp, Homo sapien
ctcagggttcaacacacacttgggc

SEQ ID NO: 666509 - DNA, 25 bp, Homo sapien
tggagccaccatgcaagaaggctgc

SEQ ID NO: 666510 - DNA, 25 bp, Homo sapien
aactatgaggtaaatatgctttttc

SEQ ID NO: 666511 - DNA, 25 bp, Homo sapien
aatatgctttttctggtgcactgac

SEQ ID NO: 666512 - DNA, 25 bp, Homo sapien
atgctttttctggtgcactgacttt

SEQ ID NO: 666513 - DNA, 25 bp, Homo sapien
gctttttctggtgcactgactttac

SEQ ID NO: 666514 - DNA, 25 bp, Homo sapien
tttctggtgcactgactttaccaat

SEQ ID NO: 666515 - DNA, 25 bp, Homo sapien
ggtgcactgactttaccaatgtcta

SEQ ID NO: 666516 - DNA, 25 bp, Homo sapien
gcactgactttaccaatgtctaact

SEQ ID NO: 666517 - DNA, 25 bp, Homo sapien
gactttaccaatgtctaacttggag

SEQ ID NO: 666518 - DNA, 25 bp, Homo sapien
taccaatgtctaacttggaggagaa

SEQ ID NO: 666519 - DNA, 25 bp, Homo sapien
ctaacttggaggagaattgtacaat

SEQ ID NO: 666520 - DNA, 25 bp, Homo sapien
gaggagaattgtacaatagacacaa

SEQ ID NO: 666521 - DNA, 25 bp, Homo sapien
tcagaaccactgtttttctggctgc

SEQ ID NO: 666522 - DNA, 25 bp, Homo sapien
gtttttctggctgcttttgactaga

SEQ ID NO: 666523 - DNA, 25 bp, Homo sapien
gactagaaggtgaacattccagatg

SEQ ID NO: 666524 - DNA, 25 bp, Homo sapien
atgtagtgttgatgtttgtcccctc

SEQ ID NO: 666525 - DNA, 25 bp, Homo sapien
gaaatgtgacctccaatgttggtgg

SEQ ID NO: 666526 - DNA, 25 bp, Homo sapien
gtttgcatcatgaggaaggatccct

SEQ ID NO: 666527 - DNA, 25 bp, Homo sapien
atgaatggcttagtgtcctcctcat

SEQ ID NO: 666528 - DNA, 25 bp, Homo sapien
cttagtgtcctcctcatggtaatga

SEQ ID NO: 666529 - DNA, 25 bp, Homo sapien
ctgttaattcacatgctggtgccat

SEQ ID NO: 666530 - DNA, 25 bp, Homo sapien
catgcttatatagcctgcagaacca

SEQ ID NO: 666531 - DNA, 25 bp, Homo sapien
gaaccacgagccaaataaacagctt

SEQ ID NO: 666532 - DNA, 25 bp, Homo sapien
tgccacctgacccaggtgagggcat

SEQ ID NO: 666533 - DNA, 25 bp, Homo sapien
tgacccaggtgagggcattacgctt

SEQ ID NO: 666534 - DNA, 25 bp, Homo sapien
ccaggtgagggcattacgctttgtg

SEQ ID NO: 666535 - DNA, 25 bp, Homo sapien
gtgagggcattacgctttgtgttta

SEQ ID NO: 666536 - DNA, 25 bp, Homo sapien
gagggcattacgctttgtgtttatg

SEQ ID NO: 666537 - DNA, 25 bp, Homo sapien
cattacgctttgtgtttatgctcgc

SEQ ID NO: 666538 - DNA, 25 bp, Homo sapien
tacgctttgtgtttatgctcgcttt

SEQ ID NO: 666539 - DNA, 25 bp, Homo sapien
gctttgtgtttatgctcgctttgta

SEQ ID NO: 666540 - DNA, 25 bp, Homo sapien
ttgtgtttatgctcgctttgtattt

SEQ ID NO: 666541 - DNA, 25 bp, Homo sapien
gtttatgctcgctttgtatttggag

SEQ ID NO: 666542 - DNA, 25 bp, Homo sapien
atgctcgctttgtatttggaggaag

SEQ ID NO: 666543 - DNA, 25 bp, Homo sapien
gggaacatggtgaaaacctggctct

SEQ ID NO: 666544 - DNA, 25 bp, Homo sapien
ggaacatggtgaaaacctggctcta

SEQ ID NO: 666545 - DNA, 25 bp, Homo sapien
agtgagctgagcttgtacagctgca

SEQ ID NO: 666546 - DNA, 25 bp, Homo sapien
gtgagctgagcttgtacagctgcac

SEQ ID NO: 666547 - DNA, 25 bp, Homo sapien
tgagctgagcttgtacagctgcact

SEQ ID NO: 666548 - DNA, 25 bp, Homo sapien
gagctgagcttgtacagctgcactc

SEQ ID NO: 666549 - DNA, 25 bp, Homo sapien
agctgagcttgtacagctgcactcc

SEQ ID NO: 666550 - DNA, 25 bp, Homo sapien
gctgagcttgtacagctgcactcca

SEQ ID NO: 666551 - DNA, 25 bp, Homo sapien
ctgagcttgtacagctgcactccag

SEQ ID NO: 666552 - DNA, 25 bp, Homo sapien
tgagcttgtacagctgcactccagc

SEQ ID NO: 666553 - DNA, 25 bp, Homo sapien
agcttgtacagctgcactccagcct

SEQ ID NO: 666554 - DNA, 25 bp, Homo sapien
ttcagcacgggtctcagcctctttc

SEQ ID NO: 666555 - DNA, 25 bp, Homo sapien
tcagcctctttcagtttgtcagaca

SEQ ID NO: 666556 - DNA, 25 bp, Homo sapien
gcctctttcagtttgtcagacagaa

SEQ ID NO: 666557 - DNA, 25 bp, Homo sapien
atttcttcttcatatttgtcctcct

SEQ ID NO: 666558 - DNA, 25 bp, Homo sapien
atttgtcctccttttcagaatactt

SEQ ID NO: 666559 - DNA, 25 bp, Homo sapien
agaatacttttcagatgcagcctcc

SEQ ID NO: 666560 - DNA, 25 bp, Homo sapien
gcctccagagatttcagattgttag

SEQ ID NO: 666561 - DNA, 25 bp, Homo sapien
agtaacattcttgagttcttcttcc

SEQ ID NO: 666562 - DNA, 25 bp, Homo sapien
agttcttcttccaggtcaccacatt

SEQ ID NO: 666563 - DNA, 25 bp, Homo sapien
tccaggtcaccacattttagttcag

SEQ ID NO: 666564 - DNA, 25 bp, Homo sapien
acattttagttcagacacctccgca

SEQ ID NO: 666565 - DNA, 25 bp, Homo sapien
ggatgttgaaaaaagcacccttggt

SEQ ID NO: 666566 - DNA, 25 bp, Homo sapien
cacccttggtgaagtggagcagcaa

SEQ ID NO: 666567 - DNA, 25 bp, Homo sapien
agcaactcgctcagaagcctcatga

SEQ ID NO: 666568 - DNA, 25 bp, Homo sapien
gaagcctcatgagtctgtaacatcg

SEQ ID NO: 666569 - DNA, 25 bp, Homo sapien
gtctgtaacatcgtttgaactccaa

SEQ ID NO: 666570 - DNA, 25 bp, Homo sapien
ataaatccataatcatcactccacc

SEQ ID NO: 666571 - DNA, 25 bp, Homo sapien
taatcatcactccacctcggaaaaa

SEQ ID NO: 666572 - DNA, 25 bp, Homo sapien
ctcggaaaaatctcactctgctctt

SEQ ID NO: 666573 - DNA, 25 bp, Homo sapien
tgctcttctctatcttctacatgaa

SEQ ID NO: 666574 - DNA, 25 bp, Homo sapien
ggaactttcaccagctttataaaat

SEQ ID NO: 666575 - DNA, 25 bp, Homo sapien
taacccttttgtacacttgtttctg

SEQ ID NO: 666576 - DNA, 25 bp, Homo sapien
gaagccatgcgtagggagagaaata

SEQ ID NO: 666577 - DNA, 25 bp, Homo sapien
caataaccgtatgaagatgtcctgt

SEQ ID NO: 666578 - DNA, 25 bp, Homo sapien
ccgtatgaagatgtcctgttaaatt

SEQ ID NO: 666579 - DNA, 25 bp, Homo sapien
atttacaacactaacgatgtagact

SEQ ID NO: 666580 - DNA, 25 bp, Homo sapien
ggaaatgcctaataagtcaaagaag

SEQ ID NO: 666581 - DNA, 25 bp, Homo sapien
aaagctcttttctgcttaaggtgac

SEQ ID NO: 666582 - DNA, 25 bp, Homo sapien
ttaaggtgacatctttgaacacttt

SEQ ID NO: 666583 - DNA, 25 bp, Homo sapien
ttaacacaaagttgactcttctcgt

SEQ ID NO: 666584 - DNA, 25 bp, Homo sapien
caaagttgactcttctcgtaatggt

SEQ ID NO: 666585 - DNA, 25 bp, Homo sapien
gttgactcttctcgtaatggttttc

SEQ ID NO: 666586 - DNA, 25 bp, Homo sapien
ctcttctcgtaatggttttcatcag

SEQ ID NO: 666587 - DNA, 25 bp, Homo sapien
ggtccacaaagtcactcatgttctc

SEQ ID NO: 666588 - DNA, 25 bp, Homo sapien
gtcactcatgttctctgacaatcag

SEQ ID NO: 666589 - DNA, 25 bp, Homo sapien
aatcagacagtcacctaatctgggc

SEQ ID NO: 666590 - DNA, 25 bp, Homo sapien
taatctgggccccatccaggagtcc

SEQ ID NO: 666591 - DNA, 25 bp, Homo sapien
tggcggaggtttttaatttcagtct

SEQ ID NO: 666592 - DNA, 25 bp, Homo sapien
ttcacttgctcctgtgggtggaagt

SEQ ID NO: 666593 - DNA, 25 bp, Homo sapien
gtggaagtaagcagcacaggaactt

SEQ ID NO: 666594 - DNA, 25 bp, Homo sapien
caggaacttattcctcactggtaga

SEQ ID NO: 666595 - DNA, 25 bp, Homo sapien
ctggtagaaaacatccccttagaag

SEQ ID NO: 666596 - DNA, 25 bp, Homo sapien
gaagaaactagcaacggtcaatttt

SEQ ID NO: 666597 - DNA, 25 bp, Homo sapien
tttgacatcctcatattatttgtga

SEQ ID NO: 666598 - DNA, 25 bp, Homo sapien
gtgaaaaccacattttaaacgctgt

SEQ ID NO: 666599 - DNA, 25 bp, Homo sapien
gaaaaccacattttaaacgctgttg

SEQ ID NO: 666600 - DNA, 25 bp, Homo sapien
aaaccacattttaaacgctgttgca

SEQ ID NO: 666601 - DNA, 25 bp, Homo sapien
accacattttaaacgctgttgcatg

SEQ ID NO: 666602 - DNA, 25 bp, Homo sapien
ccacattttaaacgctgttgcatgt

SEQ ID NO: 666603 - DNA, 25 bp, Homo sapien
cattttaaacgctgttgcatgttgt

SEQ ID NO: 666604 - DNA, 25 bp, Homo sapien
attttaaacgctgttgcatgttgta

SEQ ID NO: 666605 - DNA, 25 bp, Homo sapien
tgttgtaataccaggtgataccttg

SEQ ID NO: 666606 - DNA, 25 bp, Homo sapien
ttgtaataccaggtgataccttggt

SEQ ID NO: 666607 - DNA, 25 bp, Homo sapien
ataccaggtgataccttggtaacct

SEQ ID NO: 666608 - DNA, 25 bp, Homo sapien
taccaggtgataccttggtaaccta

SEQ ID NO: 666609 - DNA, 25 bp, Homo sapien
agcattgggaccctagaatagccaa

SEQ ID NO: 666610 - DNA, 25 bp, Homo sapien
aatagccaagaattatccacaaggg

SEQ ID NO: 666611 - DNA, 25 bp, Homo sapien
aagggagacacaaccctccagatga

SEQ ID NO: 666612 - DNA, 25 bp, Homo sapien
gacacaaccctccagatgacattgg

SEQ ID NO: 666613 - DNA, 25 bp, Homo sapien
gatgacattggctccagcttttatc

SEQ ID NO: 666614 - DNA, 25 bp, Homo sapien
ggctccagcttttatcctgaattgg

SEQ ID NO: 666615 - DNA, 25 bp, Homo sapien
ggaagttacagttctcgggatcctt

SEQ ID NO: 666616 - DNA, 25 bp, Homo sapien
gttctcgggatccttctgtcataga

SEQ ID NO: 666617 - DNA, 25 bp, Homo sapien
cttctgtcatagaaactcacatgag

SEQ ID NO: 666618 - DNA, 25 bp, Homo sapien
gagacaaatgcgctcagcttcaatt

SEQ ID NO: 666619 - DNA, 25 bp, Homo sapien
acaaatgcgctcagcttcaattggt

SEQ ID NO: 666620 - DNA, 25 bp, Homo sapien
gttcgatgcagagctccaaccgaac

SEQ ID NO: 666621 - DNA, 25 bp, Homo sapien
acatttcctcaaagaaacggagtat

SEQ ID NO: 666622 - DNA, 25 bp, Homo sapien
gtaacaatgtaactttctgtctttc

SEQ ID NO: 666623 - DNA, 25 bp, Homo sapien
aatgtaactttctgtctttcattct

SEQ ID NO: 666624 - DNA, 25 bp, Homo sapien
tttcctacaaaaagagctatttctt

SEQ ID NO: 666625 - DNA, 25 bp, Homo sapien
agctatttcttctctcagtatcata

SEQ ID NO: 666626 - DNA, 25 bp, Homo sapien
tatttcttctctcagtatcatacag

SEQ ID NO: 666627 - DNA, 25 bp, Homo sapien
tcttctctcagtatcatacagattg

SEQ ID NO: 666628 - DNA, 25 bp, Homo sapien
atagatgtatatgtatggctgttaa

SEQ ID NO: 666629 - DNA, 25 bp, Homo sapien
ttgttggtataaaatggtgagtgtc

SEQ ID NO: 666630 - DNA, 25 bp, Homo sapien
atgatgataataaatagcggctaac

SEQ ID NO: 666631 - DNA, 25 bp, Homo sapien
tgtggagtcccatattttgttctgc

SEQ ID NO: 666632 - DNA, 25 bp, Homo sapien
ttttgttctgctttccactagtcca

SEQ ID NO: 666633 - DNA, 25 bp, Homo sapien
gctttccactagtccaggcttctga

SEQ ID NO: 666634 - DNA, 25 bp, Homo sapien
aggcttctgaggtcttctctgtgtt

SEQ ID NO: 666635 - DNA, 25 bp, Homo sapien
ttctctgtgttcattgcttattaat

SEQ ID NO: 666636 - DNA, 25 bp, Homo sapien
ttcagcaaagattaattgagctcct

SEQ ID NO: 666637 - DNA, 25 bp, Homo sapien
taattgagctcctgcaatgagacac

SEQ ID NO: 666638 - DNA, 25 bp, Homo sapien
taccctcagaaagcttgcaatttat

SEQ ID NO: 666639 - DNA, 25 bp, Homo sapien
gaaagaatactaacaaaacctgcaa

SEQ ID NO: 666640 - DNA, 25 bp, Homo sapien
gaatactaacaaaacctgcaaagtg

SEQ ID NO: 666641 - DNA, 25 bp, Homo sapien
taacaaaacctgcaaagtggtattt

SEQ ID NO: 666642 - DNA, 25 bp, Homo sapien
caaagttttgtaaccatgcattttt

SEQ ID NO: 666643 - DNA, 25 bp, Homo sapien
aagttttgtaaccatgcatttttat

SEQ ID NO: 666644 - DNA, 25 bp, Homo sapien
atgctgtccttctggcatcagtgag

SEQ ID NO: 666645 - DNA, 25 bp, Homo sapien
tgctgtccttctggcatcagtgaga

SEQ ID NO: 666646 - DNA, 25 bp, Homo sapien
gcatcagtgagagccaagttagcag

SEQ ID NO: 666647 - DNA, 25 bp, Homo sapien
tcagtgagagccaagttagcaggga

SEQ ID NO: 666648 - DNA, 25 bp, Homo sapien
agtgagagccaagttagcagggact

SEQ ID NO: 666649 - DNA, 25 bp, Homo sapien
tgagagccaagttagcagggacttt

SEQ ID NO: 666650 - DNA, 25 bp, Homo sapien
gagagccaagttagcagggacttta

SEQ ID NO: 666651 - DNA, 25 bp, Homo sapien
gagccaagttagcagggactttaaa

SEQ ID NO: 666652 - DNA, 25 bp, Homo sapien
gccaagttagcagggactttaaata

SEQ ID NO: 666653 - DNA, 25 bp, Homo sapien
aattccttttgtctacctaacattg

SEQ ID NO: 666654 - DNA, 25 bp, Homo sapien
ttagactgacactgttttaggcttt

SEQ ID NO: 666655 - DNA, 25 bp, Homo sapien
ttaggcttttcactaggcacattcc

SEQ ID NO: 666656 - DNA, 25 bp, Homo sapien
ggcacattccgaaggtaccaacaag

SEQ ID NO: 666657 - DNA, 25 bp, Homo sapien
gttaataacatcacctactctccac

SEQ ID NO: 666658 - DNA, 25 bp, Homo sapien
tactctccactaatagatgctatgc

SEQ ID NO: 666659 - DNA, 25 bp, Homo sapien
gtgatattgctattgacctgaaaat

SEQ ID NO: 666660 - DNA, 25 bp, Homo sapien
tgtgatagaacttctggttgcctat

SEQ ID NO: 666661 - DNA, 25 bp, Homo sapien
ggttgcctattgattattcctccat

SEQ ID NO: 666662 - DNA, 25 bp, Homo sapien
attgattattcctccatgtctgata

SEQ ID NO: 666663 - DNA, 25 bp, Homo sapien
tgtctgataaatgaatctgcttcct

SEQ ID NO: 666664 - DNA, 25 bp, Homo sapien
taattttgttgctggatgttttacc

SEQ ID NO: 666665 - DNA, 25 bp, Homo sapien
taccctttctttaagtgcttaagtg

SEQ ID NO: 666666 - DNA, 25 bp, Homo sapien
cagcttttacataaactgtcttaat

SEQ ID NO: 666667 - DNA, 25 bp, Homo sapien
gtacaataagtcatttaatccagtt

SEQ ID NO: 666668 - DNA, 25 bp, Homo sapien
aatccagttgttttcaactagaagt

SEQ ID NO: 666669 - DNA, 25 bp, Homo sapien
ctagaagtgatgttacctcccaggg

SEQ ID NO: 666670 - DNA, 25 bp, Homo sapien
aacattttttgtttgtcaatattgg

SEQ ID NO: 666671 - DNA, 25 bp, Homo sapien
gtcaatattggagttggctactgat

SEQ ID NO: 666672 - DNA, 25 bp, Homo sapien
tagaaaccaggattgctactaagca

SEQ ID NO: 666673 - DNA, 25 bp, Homo sapien
ggattgctactaagcatcctgcaat

SEQ ID NO: 666674 - DNA, 25 bp, Homo sapien
gctactaagcatcctgcaatgcata

SEQ ID NO: 666675 - DNA, 25 bp, Homo sapien
atggtgaaaccgcatgcataagcat

SEQ ID NO: 666676 - DNA, 25 bp, Homo sapien
tggtgaaaccgcatgcataagcatg

SEQ ID NO: 666677 - DNA, 25 bp, Homo sapien
ggtgaaaccgcatgcataagcatgg

SEQ ID NO: 666678 - DNA, 25 bp, Homo sapien
gtgaaaccgcatgcataagcatggt

SEQ ID NO: 666679 - DNA, 25 bp, Homo sapien
tgaaaccgcatgcataagcatggtg

SEQ ID NO: 666680 - DNA, 25 bp, Homo sapien
gaaaccgcatgcataagcatggtgg

SEQ ID NO: 666681 - DNA, 25 bp, Homo sapien
aaaccgcatgcataagcatggtggc

SEQ ID NO: 666682 - DNA, 25 bp, Homo sapien
aaccgcatgcataagcatggtggca

SEQ ID NO: 666683 - DNA, 25 bp, Homo sapien
accgcatgcataagcatggtggcac

SEQ ID NO: 666684 - DNA, 25 bp, Homo sapien
gggacagtgatgtgacagccaccaa

SEQ ID NO: 666685 - DNA, 25 bp, Homo sapien
gacagccaccaagtccatggtctga

SEQ ID NO: 666686 - DNA, 25 bp, Homo sapien
gcctcattgtggagtgttgcagcat

SEQ ID NO: 666687 - DNA, 25 bp, Homo sapien
gattttcctaatcactgctaccagt

SEQ ID NO: 666688 - DNA, 25 bp, Homo sapien
aatcactgctaccagttgggtgcta

SEQ ID NO: 666689 - DNA, 25 bp, Homo sapien
ttgggtgctaatgagccccagttct

SEQ ID NO: 666690 - DNA, 25 bp, Homo sapien
agttctggttccactggtgacattt

SEQ ID NO: 666691 - DNA, 25 bp, Homo sapien
ggtgacatttcagtttacacatcgc

SEQ ID NO: 666692 - DNA, 25 bp, Homo sapien
cagtttacacatcgctgccatttgg

SEQ ID NO: 666693 - DNA, 25 bp, Homo sapien
aagtccaagccacttaaacctcagg

SEQ ID NO: 666694 - DNA, 25 bp, Homo sapien
aaacctcaggctcacattgattaga

SEQ ID NO: 666695 - DNA, 25 bp, Homo sapien
atgttcattcatgcatctgatggca

SEQ ID NO: 666696 - DNA, 25 bp, Homo sapien
tcatgcatctgatggcaatttgtaa

SEQ ID NO: 666697 - DNA, 25 bp, Homo sapien
aaatgtattgagtggctgacatgca

SEQ ID NO: 666698 - DNA, 25 bp, Homo sapien
gagtggctgacatgcaacagatctt

SEQ ID NO: 666699 - DNA, 25 bp, Homo sapien
tgacatgcaacagatcttagggaaa

SEQ ID NO: 666700 - DNA, 25 bp, Homo sapien
gcaacagatcttagggaaaacatga

SEQ ID NO: 666701 - DNA, 25 bp, Homo sapien
aatgttctccagactctcaaagagc

SEQ ID NO: 666702 - DNA, 25 bp, Homo sapien
gactctcaaagagctggaatctaga

SEQ ID NO: 666703 - DNA, 25 bp, Homo sapien
gaaagttctgtggaacttcagaaga

SEQ ID NO: 666704 - DNA, 25 bp, Homo sapien
agagaaaggcatattttccttcagt

SEQ ID NO: 666705 - DNA, 25 bp, Homo sapien
tttccttcagtaatctcaggaggga

SEQ ID NO: 666706 - DNA, 25 bp, Homo sapien
acatgctcaggctaaaaccagagga

SEQ ID NO: 666707 - DNA, 25 bp, Homo sapien
gtcttcgtgagaaggagccctagtt

SEQ ID NO: 666708 - DNA, 25 bp, Homo sapien
gggtgatgcctcatctgagtaaact

SEQ ID NO: 666709 - DNA, 25 bp, Homo sapien
atctgagtaaacttcttcccacttt

SEQ ID NO: 666710 - DNA, 25 bp, Homo sapien
taaacttcttcccacttttgctggg

SEQ ID NO: 666711 - DNA, 25 bp, Homo sapien
ctacaaggtctaaagcaaaggctgc

SEQ ID NO: 666712 - DNA, 25 bp, Homo sapien
gccagtgacagccacttgtgtagac

SEQ ID NO: 666713 - DNA, 25 bp, Homo sapien
gacaaggccgagctatctgcattga

SEQ ID NO: 666714 - DNA, 25 bp, Homo sapien
tctgcattgaatgaggtgacttacc

SEQ ID NO: 666715 - DNA, 25 bp, Homo sapien
ggtgacttacctcagttgtaggtat

SEQ ID NO: 666716 - DNA, 25 bp, Homo sapien
gtaggtatgaatctatagccaagga

SEQ ID NO: 666717 - DNA, 25 bp, Homo sapien
taacccgaacattccttttctatca

SEQ ID NO: 666718 - DNA, 25 bp, Homo sapien
ttccttttctatcaatcccgggtct

SEQ ID NO: 666719 - DNA, 25 bp, Homo sapien
tccttttctatcaatcccgggtctt

SEQ ID NO: 666720 - DNA, 25 bp, Homo sapien
ttttctatcaatcccgggtctttag

SEQ ID NO: 666721 - DNA, 25 bp, Homo sapien
tatcaatcccgggtctttaggcaaa

SEQ ID NO: 666722 - DNA, 25 bp, Homo sapien
tcaatcccgggtctttaggcaaact

SEQ ID NO: 666723 - DNA, 25 bp, Homo sapien
taggcaaactcaaccaactgtcaac

SEQ ID NO: 666724 - DNA, 25 bp, Homo sapien
ctatagcctggaagcacaccccacc

SEQ ID NO: 666725 - DNA, 25 bp, Homo sapien
agcctggaagcacaccccaccctat

SEQ ID NO: 666726 - DNA, 25 bp, Homo sapien
aatgtatacaaccaagccgtgccct

SEQ ID NO: 666727 - DNA, 25 bp, Homo sapien
tgtatacaaccaagccgtgccctga

SEQ ID NO: 666728 - DNA, 25 bp, Homo sapien
gacccagtcgttgttggagaatgaa

SEQ ID NO: 666729 - DNA, 25 bp, Homo sapien
gagaatgaagccctcagcctgaaga

SEQ ID NO: 666730 - DNA, 25 bp, Homo sapien
gaagaaccagagtctagcaaggcag

SEQ ID NO: 666731 - DNA, 25 bp, Homo sapien
gcaaggcagactgatccatcctgta

SEQ ID NO: 666732 - DNA, 25 bp, Homo sapien
atcctgtaccgcatttggcagcttc

SEQ ID NO: 666733 - DNA, 25 bp, Homo sapien
agcttcaactcgctgggaggtcacc

SEQ ID NO: 666734 - DNA, 25 bp, Homo sapien
ggaggtcaccttattgttcccaatt

SEQ ID NO: 666735 - DNA, 25 bp, Homo sapien
gttcccaattcaggagtcagcttgc

SEQ ID NO: 666736 - DNA, 25 bp, Homo sapien
agtcagcttgctgattcccgctggg

SEQ ID NO: 666737 - DNA, 25 bp, Homo sapien
gggccattccccaagggagagtcta

SEQ ID NO: 666738 - DNA, 25 bp, Homo sapien
ttccccaagggagagtctacgaaat

SEQ ID NO: 666739 - DNA, 25 bp, Homo sapien
gaagcctgaaggatgtctggagtca

SEQ ID NO: 666740 - DNA, 25 bp, Homo sapien
tctggagtcagcctgttcaatacca

SEQ ID NO: 666741 - DNA, 25 bp, Homo sapien
gcctgttcaataccagcttcagcaa

SEQ ID NO: 666742 - DNA, 25 bp, Homo sapien
accagcttcagcaataattagatta

SEQ ID NO: 666743 - DNA, 25 bp, Homo sapien
gattaaaccaatcaatatcctgcat

SEQ ID NO: 666744 - DNA, 25 bp, Homo sapien
aatatcctgcattaggcctctgact

SEQ ID NO: 666745 - DNA, 25 bp, Homo sapien
attaggcctctgactatctactttt

SEQ ID NO: 666746 - DNA, 25 bp, Homo sapien
ggcctctgactatctacttttacat

SEQ ID NO: 666747 - DNA, 25 bp, Homo sapien
gagacataaggactgttggtagcat

SEQ ID NO: 666748 - DNA, 25 bp, Homo sapien
ggtagcatgtactctctaagctttg

SEQ ID NO: 666749 - DNA, 25 bp, Homo sapien
ctaagctttgcttctaataaatcta

SEQ ID NO: 666750 - DNA, 25 bp, Homo sapien
atcttttcaagactgcatgtgatga

SEQ ID NO: 666751 - DNA, 25 bp, Homo sapien
caagactgcatgtgatgagtttttt

SEQ ID NO: 666752 - DNA, 25 bp, Homo sapien
ttttactcgatctcgcaatgtctgc

SEQ ID NO: 666753 - DNA, 25 bp, Homo sapien
tcgatctcgcaatgtctgccttaat

SEQ ID NO: 666754 - DNA, 25 bp, Homo sapien
tctcgcaatgtctgccttaatattt

SEQ ID NO: 666755 - DNA, 25 bp, Homo sapien
aatgtctgccttaatatttcacaat

SEQ ID NO: 666756 - DNA, 25 bp, Homo sapien
aaagtcttgatagatttgtcaaagt

SEQ ID NO: 666757 - DNA, 25 bp, Homo sapien
cctatgctggtttagaagttcgaaa

SEQ ID NO: 666758 - DNA, 25 bp, Homo sapien
gtaattatgctcaaataggtacaca

SEQ ID NO: 666759 - DNA, 25 bp, Homo sapien
gctcaaataggtacacatatacata

SEQ ID NO: 666760 - DNA, 25 bp, Homo sapien
tgtgcaattggaacttttgaagtat

SEQ ID NO: 666761 - DNA, 25 bp, Homo sapien
tggatgtacctctgcctgacatcga

SEQ ID NO: 666762 - DNA, 25 bp, Homo sapien
tacctctgcctgacatcgactacat

SEQ ID NO: 666763 - DNA, 25 bp, Homo sapien
atcgactacatggagatcccagtgg

SEQ ID NO: 666764 - DNA, 25 bp, Homo sapien
tgggatgctgaagccgataagtcac

SEQ ID NO: 666765 - DNA, 25 bp, Homo sapien
gaagccgataagtcacttctcattg

SEQ ID NO: 666766 - DNA, 25 bp, Homo sapien
tcacttctcattggcgtgttcaagc

SEQ ID NO: 666767 - DNA, 25 bp, Homo sapien
cattggcgtgttcaagcatggttat

SEQ ID NO: 666768 - DNA, 25 bp, Homo sapien
gtacaatgccatgcgagcagaccca

SEQ ID NO: 666769 - DNA, 25 bp, Homo sapien
agcagacccagcactttgcttcctg

SEQ ID NO: 666770 - DNA, 25 bp, Homo sapien
aggacaaagtagatggcctccagaa

SEQ ID NO: 666771 - DNA, 25 bp, Homo sapien
tagatggcctccagaaacaaacgga

SEQ ID NO: 666772 - DNA, 25 bp, Homo sapien
ggtgaaatgatagggagtcaaaact

SEQ ID NO: 666773 - DNA, 25 bp, Homo sapien
ctcttgtgctgagtcggttcctggg

SEQ ID NO: 666774 - DNA, 25 bp, Homo sapien
caagatatgagccagtttatcaatc

SEQ ID NO: 666775 - DNA, 25 bp, Homo sapien
atccatggagtgcagagtctgcaaa

SEQ ID NO: 666776 - DNA, 25 bp, Homo sapien
caaaatatctcaagcgctgatctgt

SEQ ID NO: 666777 - DNA, 25 bp, Homo sapien
atatctcaagcgctgatctgttttt

SEQ ID NO: 666778 - DNA, 25 bp, Homo sapien
tctcaagcgctgatctgttttttaa

SEQ ID NO: 666779 - DNA, 25 bp, Homo sapien
aatagtgatgttatcctgagaagca

SEQ ID NO: 666780 - DNA, 25 bp, Homo sapien
gtgatgttatcctgagaagcaattt

SEQ ID NO: 666781 - DNA, 25 bp, Homo sapien
gttatcctgagaagcaatttgggag

SEQ ID NO: 666782 - DNA, 25 bp, Homo sapien
agcaatttgggaggtttagaatctt

SEQ ID NO: 666783 - DNA, 25 bp, Homo sapien
atgcagtctggccatttctttattt

SEQ ID NO: 666784 - DNA, 25 bp, Homo sapien
tttctttatttcaattttcctgtca

SEQ ID NO: 666785 - DNA, 25 bp, Homo sapien
tccttatgtccctaaaccagggata

SEQ ID NO: 666786 - DNA, 25 bp, Homo sapien
gttagcaggtatatttctttacaat

SEQ ID NO: 666787 - DNA, 25 bp, Homo sapien
aagtttcttgtttgaccttgctgaa

SEQ ID NO: 666788 - DNA, 25 bp, Homo sapien
gaaggcaacatgagctcttacagct

SEQ ID NO: 666789 - DNA, 25 bp, Homo sapien
tgacagatcatctcaagccaagcct

SEQ ID NO: 666790 - DNA, 25 bp, Homo sapien
aagcctctgtggtcccagagcaaag

SEQ ID NO: 666791 - DNA, 25 bp, Homo sapien
aaagtcccactcaggtccagctgtg

SEQ ID NO: 666792 - DNA, 25 bp, Homo sapien
caggcaggtgcccattcaaggactg

SEQ ID NO: 666793 - DNA, 25 bp, Homo sapien
tcaaggactgcttttcaggtttctt

SEQ ID NO: 666794 - DNA, 25 bp, Homo sapien
ttttcctaacttcctcaggacctag

SEQ ID NO: 666795 - DNA, 25 bp, Homo sapien
aacttcctcaggacctaggtcacct

SEQ ID NO: 666796 - DNA, 25 bp, Homo sapien
cctcaggacctaggtcacctttatt

SEQ ID NO: 666797 - DNA, 25 bp, Homo sapien
attcactcttttttccttggcagtt

SEQ ID NO: 666798 - DNA, 25 bp, Homo sapien
tcactcttttttccttggcagttta

SEQ ID NO: 666799 - DNA, 25 bp, Homo sapien
tttccttggcagtttaatcattcag

SEQ ID NO: 666800 - DNA, 25 bp, Homo sapien
ggcagtttaatcattcaggaatccc

SEQ ID NO: 666801 - DNA, 25 bp, Homo sapien
aatcattcaggaatccctctcttaa

SEQ ID NO: 666802 - DNA, 25 bp, Homo sapien
ttcaggaatccctctcttaaaggaa

SEQ ID NO: 666803 - DNA, 25 bp, Homo sapien
gaatccctctcttaaaggaaattgt

SEQ ID NO: 666804 - DNA, 25 bp, Homo sapien
gtgaataaaaacgatctttttgtct

SEQ ID NO: 666805 - DNA, 25 bp, Homo sapien
atcaaggtaacagatgcctttattt

SEQ ID NO: 666806 - DNA, 25 bp, Homo sapien
tcaaggtaacagatgcctttatttt

SEQ ID NO: 666807 - DNA, 25 bp, Homo sapien
tccctcaaagaattctatttacggt

SEQ ID NO: 666808 - DNA, 25 bp, Homo sapien
ctcaaagaattctatttacggtaca

SEQ ID NO: 666809 - DNA, 25 bp, Homo sapien
tcaaagaattctatttacggtacaa

SEQ ID NO: 666810 - DNA, 25 bp, Homo sapien
agaattctatttacggtacaaagca

SEQ ID NO: 666811 - DNA, 25 bp, Homo sapien
gaattctatttacggtacaaagcag

SEQ ID NO: 666812 - DNA, 25 bp, Homo sapien
aattctatttacggtacaaagcagc

SEQ ID NO: 666813 - DNA, 25 bp, Homo sapien
attctatttacggtacaaagcagcg

SEQ ID NO: 666814 - DNA, 25 bp, Homo sapien
gtgcaacatcatgtattaatatcaa

SEQ ID NO: 666815 - DNA, 25 bp, Homo sapien
agacaagggtgctgtatctttgatt

SEQ ID NO: 666816 - DNA, 25 bp, Homo sapien
caagggtgctgtatctttgattatt

SEQ ID NO: 666817 - DNA, 25 bp, Homo sapien
gattgttgaagcatttatcttgttg

SEQ ID NO: 666818 - DNA, 25 bp, Homo sapien
gcatttatcttgttgatttcttaca

SEQ ID NO: 666819 - DNA, 25 bp, Homo sapien
ggacgatgtcagtcaagcagcactt

SEQ ID NO: 666820 - DNA, 25 bp, Homo sapien
gatgtcagtcaagcagcactttttc

SEQ ID NO: 666821 - DNA, 25 bp, Homo sapien
gtcagtcaagcagcactttttcaga

SEQ ID NO: 666822 - DNA, 25 bp, Homo sapien
gtcaagcagcactttttcagaatat

SEQ ID NO: 666823 - DNA, 25 bp, Homo sapien
gcagcactttttcagaatatacaga

SEQ ID NO: 666824 - DNA, 25 bp, Homo sapien
aatatgatgtggttgagtgttaaca

SEQ ID NO: 666825 - DNA, 25 bp, Homo sapien
tatgaaaattattactctttttggg

SEQ ID NO: 666826 - DNA, 25 bp, Homo sapien
gtatgacttttatatgaaccccttc

SEQ ID NO: 666827 - DNA, 25 bp, Homo sapien
tatgaaccccttctttagggtccag

SEQ ID NO: 666828 - DNA, 25 bp, Homo sapien
ttctttagggtccagaaggaattgt

SEQ ID NO: 666829 - DNA, 25 bp, Homo sapien
gaattgtggactgaatcactagcct

SEQ ID NO: 666830 - DNA, 25 bp, Homo sapien
ggactgaatcactagccttaggtct

SEQ ID NO: 666831 - DNA, 25 bp, Homo sapien
gaatcactagccttaggtctttcag

SEQ ID NO: 666832 - DNA, 25 bp, Homo sapien
gccttaggtctttcagcaaacagcc

SEQ ID NO: 666833 - DNA, 25 bp, Homo sapien
tcagcaaacagcctatcagggccat

SEQ ID NO: 666834 - DNA, 25 bp, Homo sapien
caaacagcctatcagggccatttat

SEQ ID NO: 666835 - DNA, 25 bp, Homo sapien
tttgcattttactttgctgactttg

SEQ ID NO: 666836 - DNA, 25 bp, Homo sapien
gaagttgagactttctacacaccag

SEQ ID NO: 666837 - DNA, 25 bp, Homo sapien
agactttctacacaccagtgcctag

SEQ ID NO: 666838 - DNA, 25 bp, Homo sapien
cagtgcctagtcttcatgatgctta

SEQ ID NO: 666839 - DNA, 25 bp, Homo sapien
tcatgatgcttatgcccaaccctga

SEQ ID NO: 666840 - DNA, 25 bp, Homo sapien
tttcctctatataatcctgcctcat

SEQ ID NO: 666841 - DNA, 25 bp, Homo sapien
taatcctgcctcattacatttctga

SEQ ID NO: 666842 - DNA, 25 bp, Homo sapien
gaggctatcaggctatcttctcata

SEQ ID NO: 666843 - DNA, 25 bp, Homo sapien
tcaggctatcttctcatagacccat

SEQ ID NO: 666844 - DNA, 25 bp, Homo sapien
atagacccatcatttgtccagcaga

SEQ ID NO: 666845 - DNA, 25 bp, Homo sapien
aagaccccaatgttgtacttatggt

SEQ ID NO: 666846 - DNA, 25 bp, Homo sapien
cttatggtttgactttatatctctg

SEQ ID NO: 666847 - DNA, 25 bp, Homo sapien
tccctcttacccaaagggtgtcagt

SEQ ID NO: 666848 - DNA, 25 bp, Homo sapien
ggctgaactgatgctcacactggga

SEQ ID NO: 666849 - DNA, 25 bp, Homo sapien
gactcctcactgtctctgtttggct

SEQ ID NO: 666850 - DNA, 25 bp, Homo sapien
ttgtccctcacctgtgttgctaaca

SEQ ID NO: 666851 - DNA, 25 bp, Homo sapien
gttgctaacactccctgaattaact

SEQ ID NO: 666852 - DNA, 25 bp, Homo sapien
ttaacttccaggactcaatatggct

SEQ ID NO: 666853 - DNA, 25 bp, Homo sapien
caatatggctcctgttttcctggtt

SEQ ID NO: 666854 - DNA, 25 bp, Homo sapien
gttttcctggttggactccgactga

SEQ ID NO: 666855 - DNA, 25 bp, Homo sapien
ggactccgactgatgataatgccat

SEQ ID NO: 666856 - DNA, 25 bp, Homo sapien
aatgccatgaggtcaatcgtgtgat

SEQ ID NO: 666857 - DNA, 25 bp, Homo sapien
gtgtgatgccgaacaggagcctctg

SEQ ID NO: 666858 - DNA, 25 bp, Homo sapien
atcaggtgaacaggaagtctcaaat

SEQ ID NO: 666859 - DNA, 25 bp, Homo sapien
tcaggtgaacaggaagtctcaaatt

SEQ ID NO: 666860 - DNA, 25 bp, Homo sapien
caggtgaacaggaagtctcaaattt

SEQ ID NO: 666861 - DNA, 25 bp, Homo sapien
aggtgaacaggaagtctcaaatttc

SEQ ID NO: 666862 - DNA, 25 bp, Homo sapien
gaacaggaagtctcaaatttctgaa

SEQ ID NO: 666863 - DNA, 25 bp, Homo sapien
aacaggaagtctcaaatttctgaat

SEQ ID NO: 666864 - DNA, 25 bp, Homo sapien
ttatgttctaaaaggttaccatgtg

SEQ ID NO: 666865 - DNA, 25 bp, Homo sapien
tatgttctaaaaggttaccatgtga

SEQ ID NO: 666866 - DNA, 25 bp, Homo sapien
atgttctaaaaggttaccatgtgat

SEQ ID NO: 666867 - DNA, 25 bp, Homo sapien
tgttctaaaaggttaccatgtgatg

SEQ ID NO: 666868 - DNA, 25 bp, Homo sapien
ttaaatcaagaaacaggccaggcgc

SEQ ID NO: 666869 - DNA, 25 bp, Homo sapien
taaatcaagaaacaggccaggcgca

SEQ ID NO: 666870 - DNA, 25 bp, Homo sapien
gtgaacccaggagatcacaccattg

SEQ ID NO: 666871 - DNA, 25 bp, Homo sapien
tgaacccaggagatcacaccattga

SEQ ID NO: 666872 - DNA, 25 bp, Homo sapien
gaacccaggagatcacaccattgaa

SEQ ID NO: 666873 - DNA, 25 bp, Homo sapien
aacccaggagatcacaccattgaac

SEQ ID NO: 666874 - DNA, 25 bp, Homo sapien
acccaggagatcacaccattgaact

SEQ ID NO: 666875 - DNA, 25 bp, Homo sapien
cccaggagatcacaccattgaactc

SEQ ID NO: 666876 - DNA, 25 bp, Homo sapien
ccaggagatcacaccattgaactcc

SEQ ID NO: 666877 - DNA, 25 bp, Homo sapien
caggagatcacaccattgaactcca

SEQ ID NO: 666878 - DNA, 25 bp, Homo sapien
aggagatcacaccattgaactccag

SEQ ID NO: 666879 - DNA, 25 bp, Homo sapien
aactatgccttttggttatgttgcc

SEQ ID NO: 666880 - DNA, 25 bp, Homo sapien
atgccttttggttatgttgccttca

SEQ ID NO: 666881 - DNA, 25 bp, Homo sapien
gccttttggttatgttgccttcaaa

SEQ ID NO: 666882 - DNA, 25 bp, Homo sapien
tggttatgttgccttcaaactctgt

SEQ ID NO: 666883 - DNA, 25 bp, Homo sapien
gttatgttgccttcaaactctgttg

SEQ ID NO: 666884 - DNA, 25 bp, Homo sapien
atgttgccttcaaactctgttgaaa

SEQ ID NO: 666885 - DNA, 25 bp, Homo sapien
aactctgttgaaatcctctggcagc

SEQ ID NO: 666886 - DNA, 25 bp, Homo sapien
ctgttgaaatcctctggcagcattc

SEQ ID NO: 666887 - DNA, 25 bp, Homo sapien
ttgaaatcctctggcagcattccac

SEQ ID NO: 666888 - DNA, 25 bp, Homo sapien
tctggcagcattccaccagttgaga

SEQ ID NO: 666889 - DNA, 25 bp, Homo sapien
tggcagcattccaccagttgagaag

SEQ ID NO: 666890 - DNA, 25 bp, Homo sapien
agaggctgacatgctccagggagaa

SEQ ID NO: 666891 - DNA, 25 bp, Homo sapien
agggagaacgccacatgcagatgaa

SEQ ID NO: 666892 - DNA, 25 bp, Homo sapien
agacgcagggtggttgcatctacaa

SEQ ID NO: 666893 - DNA, 25 bp, Homo sapien
aagaccaccggcaaaacaccagaag

SEQ ID NO: 666894 - DNA, 25 bp, Homo sapien
ggcctggaatagatacctccttgga

SEQ ID NO: 666895 - DNA, 25 bp, Homo sapien
tccttggagccctcagcaggagcca

SEQ ID NO: 666896 - DNA, 25 bp, Homo sapien
ggcacagacagcttgatctcagact

SEQ ID NO: 666897 - DNA, 25 bp, Homo sapien
gaactaagaccaaacatttcttctg

SEQ ID NO: 666898 - DNA, 25 bp, Homo sapien
tgttttttgtagttccaccactcag

SEQ ID NO: 666899 - DNA, 25 bp, Homo sapien
tccaccactcaggttctggtatttt

SEQ ID NO: 666900 - DNA, 25 bp, Homo sapien
tagggcagccctagaaaagtgagat

SEQ ID NO: 666901 - DNA, 25 bp, Homo sapien
gaacaaaactataccatcgtgtggg

SEQ ID NO: 666902 - DNA, 25 bp, Homo sapien
gaagcaaatccatacaagtctccaa

SEQ ID NO: 666903 - DNA, 25 bp, Homo sapien
tccatacaagtctccaatatgtttg

SEQ ID NO: 666904 - DNA, 25 bp, Homo sapien
gaattggttgcattgattttcctca

SEQ ID NO: 666905 - DNA, 25 bp, Homo sapien
ggttgcattgattttcctcagctaa

SEQ ID NO: 666906 - DNA, 25 bp, Homo sapien
tgattttcctcagctaatggcctag

SEQ ID NO: 666907 - DNA, 25 bp, Homo sapien
gctaatggcctaggatagatgctga

SEQ ID NO: 666908 - DNA, 25 bp, Homo sapien
ggatagatgctgaattgtcctcaga

SEQ ID NO: 666909 - DNA, 25 bp, Homo sapien
gatgctgaattgtcctcagaaaata

SEQ ID NO: 666910 - DNA, 25 bp, Homo sapien
attagagcagcttatttccacttaa

SEQ ID NO: 666911 - DNA, 25 bp, Homo sapien
gcagcttatttccacttaagacttt

SEQ ID NO: 666912 - DNA, 25 bp, Homo sapien
tgaggccaccaaagggcaccttgaa

SEQ ID NO: 666913 - DNA, 25 bp, Homo sapien
aagggcaccttgaacactggatggc

SEQ ID NO: 666914 - DNA, 25 bp, Homo sapien
ccttgaacactggatggccccagga

SEQ ID NO: 666915 - DNA, 25 bp, Homo sapien
ttgaaccccatcctgattgatccag

SEQ ID NO: 666916 - DNA, 25 bp, Homo sapien
accttggcccagactgcaggcctgg

SEQ ID NO: 666917 - DNA, 25 bp, Homo sapien
gaaactactatactcctttttggca

SEQ ID NO: 666918 - DNA, 25 bp, Homo sapien
ctatactcctttttggcatagctgt

SEQ ID NO: 666919 - DNA, 25 bp, Homo sapien
ggcatagctgtacgattttacattc

SEQ ID NO: 666920 - DNA, 25 bp, Homo sapien
ccagtaatgtgtgaaagctctagtt

SEQ ID NO: 666921 - DNA, 25 bp, Homo sapien
tctagtttttactcatgctcctcag

SEQ ID NO: 666922 - DNA, 25 bp, Homo sapien
atgctcctcagcgtttgatgtttta

SEQ ID NO: 666923 - DNA, 25 bp, Homo sapien
taaatatgtatctaagtttcctcca

SEQ ID NO: 666924 - DNA, 25 bp, Homo sapien
atatgtatctaagtttcctccatgc

SEQ ID NO: 666925 - DNA, 25 bp, Homo sapien
atgtatctaagtttcctccatgcct

SEQ ID NO: 666926 - DNA, 25 bp, Homo sapien
tgtatctaagtttcctccatgcctt

SEQ ID NO: 666927 - DNA, 25 bp, Homo sapien
tatctaagtttcctccatgccttct

SEQ ID NO: 666928 - DNA, 25 bp, Homo sapien
ctaagtttcctccatgccttctcat

SEQ ID NO: 666929 - DNA, 25 bp, Homo sapien
catttgggtaaatactaaggattgc

SEQ ID NO: 666930 - DNA, 25 bp, Homo sapien
aatactaaggattgcaattgctgga

SEQ ID NO: 666931 - DNA, 25 bp, Homo sapien
ctaaggattgcaattgctggactgt

SEQ ID NO: 666932 - DNA, 25 bp, Homo sapien
aaggattgcaattgctggactgtat

SEQ ID NO: 666933 - DNA, 25 bp, Homo sapien
gattgcaattgctggactgtatgac

SEQ ID NO: 666934 - DNA, 25 bp, Homo sapien
aataatcatatcatgcttttgctca

SEQ ID NO: 666935 - DNA, 25 bp, Homo sapien
gctcagggagtgtggccacaatatc

SEQ ID NO: 666936 - DNA, 25 bp, Homo sapien
gtgtggccacaatatctggaaatac

SEQ ID NO: 666937 - DNA, 25 bp, Homo sapien
gaacttgaagattagggataccctt

SEQ ID NO: 666938 - DNA, 25 bp, Homo sapien
gataccctttttgtaaacagtagat

SEQ ID NO: 666939 - DNA, 25 bp, Homo sapien
gtcagggaatggagacaccattgaa

SEQ ID NO: 666940 - DNA, 25 bp, Homo sapien
agttttctagaaaggtgtggctcta

SEQ ID NO: 666941 - DNA, 25 bp, Homo sapien
gaaaggtgtggctctagatcagaaa

SEQ ID NO: 666942 - DNA, 25 bp, Homo sapien
ggtgtggctctagatcagaaatatg

SEQ ID NO: 666943 - DNA, 25 bp, Homo sapien
tgaggtcaagggaaatttatttctc

SEQ ID NO: 666944 - DNA, 25 bp, Homo sapien
atttatttctcatctcacatggaga

SEQ ID NO: 666945 - DNA, 25 bp, Homo sapien
agagcttgctggtcatcccagaccc

SEQ ID NO: 666946 - DNA, 25 bp, Homo sapien
ggtcatcccagacccttgggcaagg

SEQ ID NO: 666947 - DNA, 25 bp, Homo sapien
gggcaagacagcagcgtccagcagt

SEQ ID NO: 666948 - DNA, 25 bp, Homo sapien
agcgtccagcagtcggcttgtgcag

SEQ ID NO: 666949 - DNA, 25 bp, Homo sapien
cagtcggcttgtgcagggcagcctt

SEQ ID NO: 666950 - DNA, 25 bp, Homo sapien
cagccttccaattgcccaaaatatg

SEQ ID NO: 666951 - DNA, 25 bp, Homo sapien
tcccggacaccatccttggaagaga

SEQ ID NO: 666952 - DNA, 25 bp, Homo sapien
gagaacctagttccttaccgatcct

SEQ ID NO: 666953 - DNA, 25 bp, Homo sapien
ttaccgatcctttcgtgcctcagtc

SEQ ID NO: 666954 - DNA, 25 bp, Homo sapien
acccagaccaattccagccttggtg

SEQ ID NO: 666955 - DNA, 25 bp, Homo sapien
tggtgaggcgtttccctctgaccaa

SEQ ID NO: 666956 - DNA, 25 bp, Homo sapien
gagttagattgaaatccaatcataa

SEQ ID NO: 666957 - DNA, 25 bp, Homo sapien
attgaaatccaatcataatgaaatg

SEQ ID NO: 666958 - DNA, 25 bp, Homo sapien
tgaaatccaatcataatgaaatgtg

SEQ ID NO: 666959 - DNA, 25 bp, Homo sapien
gaaatgtggattttgactatagcta

SEQ ID NO: 666960 - DNA, 25 bp, Homo sapien
aaatgtggattttgactatagctaa

SEQ ID NO: 666961 - DNA, 25 bp, Homo sapien
aatgtggattttgactatagctaat

SEQ ID NO: 666962 - DNA, 25 bp, Homo sapien
atgtggattttgactatagctaatt

SEQ ID NO: 666963 - DNA, 25 bp, Homo sapien
tgtggattttgactatagctaattt

SEQ ID NO: 666964 - DNA, 25 bp, Homo sapien
gtggattttgactatagctaatttt

SEQ ID NO: 666965 - DNA, 25 bp, Homo sapien
tggattttgactatagctaattttt

SEQ ID NO: 666966 - DNA, 25 bp, Homo sapien
ggattttgactatagctaatttttt

SEQ ID NO: 666967 - DNA, 25 bp, Homo sapien
gacattgtggtgaggtgagctcccc

SEQ ID NO: 666968 - DNA, 25 bp, Homo sapien
acattgtggtgaggtgagctcccca

SEQ ID NO: 666969 - DNA, 25 bp, Homo sapien
cattgtggtgaggtgagctccccaa

SEQ ID NO: 666970 - DNA, 25 bp, Homo sapien
cccaaaatggcacctcggtcctgga

SEQ ID NO: 666971 - DNA, 25 bp, Homo sapien
ccaaaatggcacctcggtcctggac

SEQ ID NO: 666972 - DNA, 25 bp, Homo sapien
caaaatggcacctcggtcctggacg

SEQ ID NO: 666973 - DNA, 25 bp, Homo sapien
aaaatggcacctcggtcctggacgc

SEQ ID NO: 666974 - DNA, 25 bp, Homo sapien
aaatggcacctcggtcctggacgca

SEQ ID NO: 666975 - DNA, 25 bp, Homo sapien
aatggcacctcggtcctggacgcac

SEQ ID NO: 666976 - DNA, 25 bp, Homo sapien
atggcacctcggtcctggacgcaca

SEQ ID NO: 666977 - DNA, 25 bp, Homo sapien
tggcacctcggtcctggacgcacaa

SEQ ID NO: 666978 - DNA, 25 bp, Homo sapien
caccgacagagtaagagactaatac

SEQ ID NO: 666979 - DNA, 25 bp, Homo sapien
gactaatactgttaattgaattccc

SEQ ID NO: 666980 - DNA, 25 bp, Homo sapien
taatactgttaattgaattccccta

SEQ ID NO: 666981 - DNA, 25 bp, Homo sapien
tactgttaattgaattcccctaaag

SEQ ID NO: 666982 - DNA, 25 bp, Homo sapien
ggaaaatctcgatgatgtccatcac

SEQ ID NO: 666983 - DNA, 25 bp, Homo sapien
gaaaatctcgatgatgtccatcacc

SEQ ID NO: 666984 - DNA, 25 bp, Homo sapien
aatctcgatgatgtccatcaccgac

SEQ ID NO: 666985 - DNA, 25 bp, Homo sapien
atctcgatgatgtccatcaccgaca

SEQ ID NO: 666986 - DNA, 25 bp, Homo sapien
tctcgatgatgtccatcaccgacag

SEQ ID NO: 666987 - DNA, 25 bp, Homo sapien
tcgatgatgtccatcaccgacagag

SEQ ID NO: 666988 - DNA, 25 bp, Homo sapien
catcaccgacagagtaagagactaa

SEQ ID NO: 666989 - DNA, 25 bp, Homo sapien
gctttgctgaattattgtttccaca

SEQ ID NO: 666990 - DNA, 25 bp, Homo sapien
tgtttccacactggaattcctcagc

SEQ ID NO: 666991 - DNA, 25 bp, Homo sapien
ggaattcctcagcatgcttcctgaa

SEQ ID NO: 666992 - DNA, 25 bp, Homo sapien
atgcttcctgaatgccttctgctgt

SEQ ID NO: 666993 - DNA, 25 bp, Homo sapien
gaatgccttctgctgtagcgaatct

SEQ ID NO: 666994 - DNA, 25 bp, Homo sapien
tgctgtagcgaatctcctgcagggt

SEQ ID NO: 666995 - DNA, 25 bp, Homo sapien
tctcctgcagggtccacacgttagt

SEQ ID NO: 666996 - DNA, 25 bp, Homo sapien
acacgttagtggctctgtacgctac

SEQ ID NO: 666997 - DNA, 25 bp, Homo sapien
ggctctgtacgctacttttacttta

SEQ ID NO: 666998 - DNA, 25 bp, Homo sapien
tacttttactttaggtttctgattg

SEQ ID NO: 666999 - DNA, 25 bp, Homo sapien
ggtttatgcctataagtaatgtcta

SEQ ID NO: 667000 - DNA, 25 bp, Homo sapien
atggccctctctccagcttgtgtga

SEQ ID NO: 667001 - DNA, 25 bp, Homo sapien
tccagcttgtgtgagccggctccaa

SEQ ID NO: 667002 - DNA, 25 bp, Homo sapien
gtgtgagccggctccaacacacatc

SEQ ID NO: 667003 - DNA, 25 bp, Homo sapien
aacacacatcctgtggagcgagagt

SEQ ID NO: 667004 - DNA, 25 bp, Homo sapien
acatcctgtggagcgagagtttggt

SEQ ID NO: 667005 - DNA, 25 bp, Homo sapien
atatcagaacacattgcacttagta

SEQ ID NO: 667006 - DNA, 25 bp, Homo sapien
tgctgtcacccacctaagatgtaac

SEQ ID NO: 667007 - DNA, 25 bp, Homo sapien
acccacctaagatgtaacttgctcc

SEQ ID NO: 667008 - DNA, 25 bp, Homo sapien
cacgtggaactaatgaggcagaagt

SEQ ID NO: 667009 - DNA, 25 bp, Homo sapien
gaggcagaagttacactgtgccagt

SEQ ID NO: 667010 - DNA, 25 bp, Homo sapien
ttacactgtgccagtttgggcccag

SEQ ID NO: 667011 - DNA, 25 bp, Homo sapien
ttgatggcccaacactgccaggaag

SEQ ID NO: 667012 - DNA, 25 bp, Homo sapien
tggcccaacactgccaggaagcagg

SEQ ID NO: 667013 - DNA, 25 bp, Homo sapien
aagcaggagggcaggctgtctctac

SEQ ID NO: 667014 - DNA, 25 bp, Homo sapien
gggcaggctgtctctactgtggaat

SEQ ID NO: 667015 - DNA, 25 bp, Homo sapien
aggctgtctctactgtggaattcgg

SEQ ID NO: 667016 - DNA, 25 bp, Homo sapien
gtctctactgtggaattcgggagtg

SEQ ID NO: 667017 - DNA, 25 bp, Homo sapien
gagtgggatgtacacttttggcaca

SEQ ID NO: 667018 - DNA, 25 bp, Homo sapien
ggatgtacacttttggcacatataa

SEQ ID NO: 667019 - DNA, 25 bp, Homo sapien
aaagtctctgatattagttctatca

SEQ ID NO: 667020 - DNA, 25 bp, Homo sapien
attagttctatcatcttaaaaaggt

SEQ ID NO: 667021 - DNA, 25 bp, Homo sapien
aaggtgcaatttgaccaggcatggt

SEQ ID NO: 667022 - DNA, 25 bp, Homo sapien
gacatatcacacaccaaccgtgtgc

SEQ ID NO: 667023 - DNA, 25 bp, Homo sapien
aaccgtgtgcaaagcactctaccta

SEQ ID NO: 667024 - DNA, 25 bp, Homo sapien
tgtgcaaagcactctacctaaagat

SEQ ID NO: 667025 - DNA, 25 bp, Homo sapien
gcactctacctaaagatcagcgcta

SEQ ID NO: 667026 - DNA, 25 bp, Homo sapien
aaagatcagcgctaacagaggaata

SEQ ID NO: 667027 - DNA, 25 bp, Homo sapien
aggaataagcagaggcctccaggag

SEQ ID NO: 667028 - DNA, 25 bp, Homo sapien
aggcctccaggagcaaagagtgaaa

SEQ ID NO: 667029 - DNA, 25 bp, Homo sapien
aagtctcccaaggattcaagtacgg

SEQ ID NO: 667030 - DNA, 25 bp, Homo sapien
gtgggtggagctttcaccgtagaat

SEQ ID NO: 667031 - DNA, 25 bp, Homo sapien
gctttcaccgtagaatctttcctgg

SEQ ID NO: 667032 - DNA, 25 bp, Homo sapien
caccgtagaatctttcctggagaaa

SEQ ID NO: 667033 - DNA, 25 bp, Homo sapien
ggcagatctctaaaactaatggtac

SEQ ID NO: 667034 - DNA, 25 bp, Homo sapien
ggtacaaaccactctgtgatacatt

SEQ ID NO: 667035 - DNA, 25 bp, Homo sapien
taaaatacatcccactctgtcatac

SEQ ID NO: 667036 - DNA, 25 bp, Homo sapien
cccactctgtcatactgcaaacaag

SEQ ID NO: 667037 - DNA, 25 bp, Homo sapien
tgcaaacaagtagctgctccccagt

SEQ ID NO: 667038 - DNA, 25 bp, Homo sapien
gctgctccccagtctttgaaaaagt

SEQ ID NO: 667039 - DNA, 25 bp, Homo sapien
tgtactcatgggttctgcaggtttt

SEQ ID NO: 667040 - DNA, 25 bp, Homo sapien
tttccttgacatttagaggtcttgc

SEQ ID NO: 667041 - DNA, 25 bp, Homo sapien
gaggtcttgcaaagtggtttattat

SEQ ID NO: 667042 - DNA, 25 bp, Homo sapien
gatcttgtggacatctcgctattta

SEQ ID NO: 667043 - DNA, 25 bp, Homo sapien
attttaaaaccgtctggcagatctc

SEQ ID NO: 667044 - DNA, 25 bp, Homo sapien
ggttttggacttagtgcttttatat

SEQ ID NO: 667045 - DNA, 25 bp, Homo sapien
ttttttaaagaagccatcccatgga

SEQ ID NO: 667046 - DNA, 25 bp, Homo sapien
catcccatggaatgcttctctcatt

SEQ ID NO: 667047 - DNA, 25 bp, Homo sapien
tctctcattccagtgctgtagtaag

SEQ ID NO: 667048 - DNA, 25 bp, Homo sapien
ccagtgctgtagtaagggttgccct

SEQ ID NO: 667049 - DNA, 25 bp, Homo sapien
ggacctagaaaattcacttatcata

SEQ ID NO: 667050 - DNA, 25 bp, Homo sapien
aataatatttttgtcctggtgaata

SEQ ID NO: 667051 - DNA, 25 bp, Homo sapien
atttacattgtaccacacactgtgc

SEQ ID NO: 667052 - DNA, 25 bp, Homo sapien
cacactgtgctagttgctttataca

SEQ ID NO: 667053 - DNA, 25 bp, Homo sapien
catttaattcttaccttagagacta

SEQ ID NO: 667054 - DNA, 25 bp, Homo sapien
agatctatctgtgaattactttgag

SEQ ID NO: 667055 - DNA, 25 bp, Homo sapien
tttttcactgctttgaacaacttca

SEQ ID NO: 667056 - DNA, 25 bp, Homo sapien
acttcattctgctcaggatcccagc

SEQ ID NO: 667057 - DNA, 25 bp, Homo sapien
ggatcccagctcagaaccaacgtag

SEQ ID NO: 667058 - DNA, 25 bp, Homo sapien
aacatcagttgttctatattgtcaa

SEQ ID NO: 667059 - DNA, 25 bp, Homo sapien
tatattgtcaaagtccaggctcatg

SEQ ID NO: 667060 - DNA, 25 bp, Homo sapien
agtccaggctcatgatctgttttgg

SEQ ID NO: 667061 - DNA, 25 bp, Homo sapien
gatctgttttggatgaaagtggcta

SEQ ID NO: 667062 - DNA, 25 bp, Homo sapien
agatacattcagattgccaactaca

SEQ ID NO: 667063 - DNA, 25 bp, Homo sapien
gggcaacttagatactggatggcaa

SEQ ID NO: 667064 - DNA, 25 bp, Homo sapien
gatactggatggcaacctgggtcaa

SEQ ID NO: 667065 - DNA, 25 bp, Homo sapien
gcaacctgggtcaaagccggccata

SEQ ID NO: 667066 - DNA, 25 bp, Homo sapien
gatcctaatgctttggctggccaga

SEQ ID NO: 667067 - DNA, 25 bp, Homo sapien
aatgctttggctggccagaatggcc

SEQ ID NO: 667068 - DNA, 25 bp, Homo sapien
agaatggccctgaccatgctctcat

SEQ ID NO: 667069 - DNA, 25 bp, Homo sapien
ctgaccatgctctcataggaggaat

SEQ ID NO: 667070 - DNA, 25 bp, Homo sapien
ggctgtagttgtatttgtcacgctg

SEQ ID NO: 667071 - DNA, 25 bp, Homo sapien
tgtcacgctgtgttctatctttctg

SEQ ID NO: 667072 - DNA, 25 bp, Homo sapien
atctttctgcttggtcgatatctgg

SEQ ID NO: 667073 - DNA, 25 bp, Homo sapien
tggtcgatatctggcaaggcataaa

SEQ ID NO: 667074 - DNA, 25 bp, Homo sapien
gagctgaagatgcaccagatgctga

SEQ ID NO: 667075 - DNA, 25 bp, Homo sapien
gccattatcaatgctgaaggcagcc

SEQ ID NO: 667076 - DNA, 25 bp, Homo sapien
gaaggcagccaagtcaatgctgaag

SEQ ID NO: 667077 - DNA, 25 bp, Homo sapien
gtggttttatagcagatctgcaatt

SEQ ID NO: 667078 - DNA, 25 bp, Homo sapien
atctgcaattattaatagttatgcc

SEQ ID NO: 667079 - DNA, 25 bp, Homo sapien
ataatcgtttaacagtgcatatgtt

SEQ ID NO: 667080 - DNA, 25 bp, Homo sapien
gacaatgtgtatagacagatgtgta

SEQ ID NO: 667081 - DNA, 25 bp, Homo sapien
gagaaacatctatcgaacagacaat

SEQ ID NO: 667082 - DNA, 25 bp, Homo sapien
atcgaacagacaatatacatacaca

SEQ ID NO: 667083 - DNA, 25 bp, Homo sapien
acatacacatcaaacacaacagcag

SEQ ID NO: 667084 - DNA, 25 bp, Homo sapien
acaacagcagttttagtgaccataa

SEQ ID NO: 667085 - DNA, 25 bp, Homo sapien
cagcagttttagtgaccataatatt

SEQ ID NO: 667086 - DNA, 25 bp, Homo sapien
tagtgaccataatatttatttctca

SEQ ID NO: 667087 - DNA, 25 bp, Homo sapien
tgcttactttagtgacaactgaaaa

SEQ ID NO: 667088 - DNA, 25 bp, Homo sapien
atatggccccattatggcagcattt

SEQ ID NO: 667089 - DNA, 25 bp, Homo sapien
ggcagcattttctatgcttttcaga

SEQ ID NO: 667090 - DNA, 25 bp, Homo sapien
aaactgattgttctctcctttgtgc

SEQ ID NO: 667091 - DNA, 25 bp, Homo sapien
attgttctctcctttgtgcccttat

SEQ ID NO: 667092 - DNA, 25 bp, Homo sapien
tgtgcccttatgtattatattgact

SEQ ID NO: 667093 - DNA, 25 bp, Homo sapien
ggtgaattatacttttctgttctta

SEQ ID NO: 667094 - DNA, 25 bp, Homo sapien
gttcttatttgttttcacgtctcta

SEQ ID NO: 667095 - DNA, 25 bp, Homo sapien
gaatataggccagaatctatcttct

SEQ ID NO: 667096 - DNA, 25 bp, Homo sapien
gaatctatcttctgtgtatatttcc

SEQ ID NO: 667097 - DNA, 25 bp, Homo sapien
tctcccaggatagtgcctgtgattc

SEQ ID NO: 667098 - DNA, 25 bp, Homo sapien
gtgcctgtgattcgatagatacaat

SEQ ID NO: 667099 - DNA, 25 bp, Homo sapien
tcttggtcacagttgatccctcaac

SEQ ID NO: 667100 - DNA, 25 bp, Homo sapien
gcatctcaccctcaaaatgtttgtt

SEQ ID NO: 667101 - DNA, 25 bp, Homo sapien
ttgggacccaagaggcaaaccttga

SEQ ID NO: 667102 - DNA, 25 bp, Homo sapien
gatgggttatttctttcaccttgga

SEQ ID NO: 667103 - DNA, 25 bp, Homo sapien
ccttggattggctcatctgctggga

SEQ ID NO: 667104 - DNA, 25 bp, Homo sapien
agccaagctgacatttcctttcctt

SEQ ID NO: 667105 - DNA, 25 bp, Homo sapien
tttgtctgcctatcactacgtagag

SEQ ID NO: 667106 - DNA, 25 bp, Homo sapien
aaagccatgcgcgtggagtccagca

SEQ ID NO: 667107 - DNA, 25 bp, Homo sapien
gtccagcacatcacccagaaggcag

SEQ ID NO: 667108 - DNA, 25 bp, Homo sapien
ggcagatgttctatctccattttac

SEQ ID NO: 667109 - DNA, 25 bp, Homo sapien
cacacctggattgcctggtacttaa

SEQ ID NO: 667110 - DNA, 25 bp, Homo sapien
tcaggtggatttaagcattcgggtt

SEQ ID NO: 667111 - DNA, 25 bp, Homo sapien
ggtggatttaagcattcgggttact

SEQ ID NO: 667112 - DNA, 25 bp, Homo sapien
gtggatttaagcattcgggttactg

SEQ ID NO: 667113 - DNA, 25 bp, Homo sapien
ggatttaagcattcgggttactgat

SEQ ID NO: 667114 - DNA, 25 bp, Homo sapien
tttaagcattcgggttactgatgat

SEQ ID NO: 667115 - DNA, 25 bp, Homo sapien
ttcaagtagatggaagcggtgatac

SEQ ID NO: 667116 - DNA, 25 bp, Homo sapien
agatggaagcggtgatacatcttcc

SEQ ID NO: 667117 - DNA, 25 bp, Homo sapien
gtgatacatcttccaatgaagaaat

SEQ ID NO: 667118 - DNA, 25 bp, Homo sapien
aataggaagtacaagagatgcagat

SEQ ID NO: 667119 - DNA, 25 bp, Homo sapien
aagtacaagagatgcagatgagaat

SEQ ID NO: 667120 - DNA, 25 bp, Homo sapien
gatgagaatgaatttctagggaata

SEQ ID NO: 667121 - DNA, 25 bp, Homo sapien
gagccaaacgtatggccacctctga

SEQ ID NO: 667122 - DNA, 25 bp, Homo sapien
aaacgtatggccacctctgaccact

SEQ ID NO: 667123 - DNA, 25 bp, Homo sapien
tgaccactcgaccagcccagcatgg

SEQ ID NO: 667124 - DNA, 25 bp, Homo sapien
tttctgggtagcttatcacgccttc

SEQ ID NO: 667125 - DNA, 25 bp, Homo sapien
tgggtagcttatcacgccttccaag

SEQ ID NO: 667126 - DNA, 25 bp, Homo sapien
ggtagcttatcacgccttccaagca

SEQ ID NO: 667127 - DNA, 25 bp, Homo sapien
agcttatcacgccttccaagcattg

SEQ ID NO: 667128 - DNA, 25 bp, Homo sapien
ttatcacgccttccaagcattgcct

SEQ ID NO: 667129 - DNA, 25 bp, Homo sapien
gccttccaagcattgcctttatctt

SEQ ID NO: 667130 - DNA, 25 bp, Homo sapien
tccaagcattgcctttatcttcctt

SEQ ID NO: 667131 - DNA, 25 bp, Homo sapien
tttatcttccttctccccatcaagc

SEQ ID NO: 667132 - DNA, 25 bp, Homo sapien
gtcacttctctgtcttgccaagaga

SEQ ID NO: 667133 - DNA, 25 bp, Homo sapien
cttctctgtcttgccaagagagatc

SEQ ID NO: 667134 - DNA, 25 bp, Homo sapien
ttctacataaacatctgctggaaac

SEQ ID NO: 667135 - DNA, 25 bp, Homo sapien
aatgacgtttatagcttcttggtct

SEQ ID NO: 667136 - DNA, 25 bp, Homo sapien
cgtttatagcttcttggtctttaat

SEQ ID NO: 667137 - DNA, 25 bp, Homo sapien
gcttcttggtctttaataagtctga

SEQ ID NO: 667138 - DNA, 25 bp, Homo sapien
gaatttgtgatacattccttcccaa

SEQ ID NO: 667139 - DNA, 25 bp, Homo sapien
cttcactgatatgcatcatattaga

SEQ ID NO: 667140 - DNA, 25 bp, Homo sapien
ttaagaacatttctctgaactgtct

SEQ ID NO: 667141 - DNA, 25 bp, Homo sapien
aactgtctgtatcaatcatacctga

SEQ ID NO: 667142 - DNA, 25 bp, Homo sapien
gtctgtatcaatcatacctgagagt

SEQ ID NO: 667143 - DNA, 25 bp, Homo sapien
aaccaggagatccagcgcgccctgt

SEQ ID NO: 667144 - DNA, 25 bp, Homo sapien
tctgtggctgtttccagtccaaagt

SEQ ID NO: 667145 - DNA, 25 bp, Homo sapien
tggctgtttccagtccaaagtgccc

SEQ ID NO: 667146 - DNA, 25 bp, Homo sapien
caaagtgccctttcgttccaggtct

SEQ ID NO: 667147 - DNA, 25 bp, Homo sapien
ttccaggtctcccagcgaggtctga

SEQ ID NO: 667148 - DNA, 25 bp, Homo sapien
tctcgctgccaccagaaagggtgtg

SEQ ID NO: 667149 - DNA, 25 bp, Homo sapien
gtgctgggcactttcggcgccagct

SEQ ID NO: 667150 - DNA, 25 bp, Homo sapien
ttcgccatctattgcgtggtgggca

SEQ ID NO: 667151 - DNA, 25 bp, Homo sapien
tctattgcgtggtgggcagccatga

SEQ ID NO: 667152 - DNA, 25 bp, Homo sapien
gcagccatgaggacccggcggtcta

SEQ ID NO: 667153 - DNA, 25 bp, Homo sapien
gaggacccggcggtctacacttacg

SEQ ID NO: 667154 - DNA, 25 bp, Homo sapien
ggccagaaatctgtaaatttggtat

SEQ ID NO: 667155 - DNA, 25 bp, Homo sapien
gaattgccagttttttcctggactc

SEQ ID NO: 667156 - DNA, 25 bp, Homo sapien
ttcctggactctttccttgcagaag

SEQ ID NO: 667157 - DNA, 25 bp, Homo sapien
gactctttccttgcagaagcgattt

SEQ ID NO: 667158 - DNA, 25 bp, Homo sapien
gaagcgattttcaggacaactcaag

SEQ ID NO: 667159 - DNA, 25 bp, Homo sapien
tttcaggacaactcaagccaattaa

SEQ ID NO: 667160 - DNA, 25 bp, Homo sapien
cactttccctatctgtttggatgaa

SEQ ID NO: 667161 - DNA, 25 bp, Homo sapien
gaagttaactagctagtcactaagt

SEQ ID NO: 667162 - DNA, 25 bp, Homo sapien
gtcactaagtgaattttgaaacctc

SEQ ID NO: 667163 - DNA, 25 bp, Homo sapien
ctaaatgatagctgctcttggtgtt

SEQ ID NO: 667164 - DNA, 25 bp, Homo sapien
ggtcatgtaacatgcataatctctg

SEQ ID NO: 667165 - DNA, 25 bp, Homo sapien
agcctcagatatgtagcaacacaga

SEQ ID NO: 667166 - DNA, 25 bp, Homo sapien
aaactgggttatgggcaggactgca

SEQ ID NO: 667167 - DNA, 25 bp, Homo sapien
caggactgcaagtactggttaggca

SEQ ID NO: 667168 - DNA, 25 bp, Homo sapien
gtactggttaggcagatacctgtat

SEQ ID NO: 667169 - DNA, 25 bp, Homo sapien
tttctcttcctaactctcagaacgt

SEQ ID NO: 667170 - DNA, 25 bp, Homo sapien
tcagaacgtgttctgtgtcacttag

SEQ ID NO: 667171 - DNA, 25 bp, Homo sapien
ctgtgtcacttagggcaacttatgc

SEQ ID NO: 667172 - DNA, 25 bp, Homo sapien
gccagtgctatgcttgcacagcctg

SEQ ID NO: 667173 - DNA, 25 bp, Homo sapien
ccatgagccaaataagcctctttct

SEQ ID NO: 667174 - DNA, 25 bp, Homo sapien
taagcctctttctaagttacccaca

SEQ ID NO: 667175 - DNA, 25 bp, Homo sapien
tctaagttacccacagcctcagata

SEQ ID NO: 667176 - DNA, 25 bp, Homo sapien
agaatccgggagttcgtgccgcctt

SEQ ID NO: 667177 - DNA, 25 bp, Homo sapien
agacaatctgatcaaagccatcttg

SEQ ID NO: 667178 - DNA, 25 bp, Homo sapien
aaagccatcttgtcagtcaccaaag

SEQ ID NO: 667179 - DNA, 25 bp, Homo sapien
gtcagtcaccaaagagtaccgcctg

SEQ ID NO: 667180 - DNA, 25 bp, Homo sapien
ccgctgcatcatcgtgggcaatgga

SEQ ID NO: 667181 - DNA, 25 bp, Homo sapien
gcaatggaggcgttcttgccaacaa

SEQ ID NO: 667182 - DNA, 25 bp, Homo sapien
gcgttcttgccaacaagtctctggg

SEQ ID NO: 667183 - DNA, 25 bp, Homo sapien
tggacgcacaatatccagcgagaga

SEQ ID NO: 667184 - DNA, 25 bp, Homo sapien
agaaagagtttctgcggaagctggt

SEQ ID NO: 667185 - DNA, 25 bp, Homo sapien
aagctggtgaaagctcgcgtcatca

SEQ ID NO: 667186 - DNA, 25 bp, Homo sapien
ctcgcgtcatcactgatctaagcag

SEQ ID NO: 667187 - DNA, 25 bp, Homo sapien
atatgtatctaagtttcctccatgc

SEQ ID NO: 667188 - DNA, 25 bp, Homo sapien
atgtatctaagtttcctccatgcct

SEQ ID NO: 667189 - DNA, 25 bp, Homo sapien
tgtatctaagtttcctccatgcctt

SEQ ID NO: 667190 - DNA, 25 bp, Homo sapien
tatctaagtttcctccatgccttct

SEQ ID NO: 667191 - DNA, 25 bp, Homo sapien
ctaagtttcctccatgccttctcat

SEQ ID NO: 667192 - DNA, 25 bp, Homo sapien
ttgatagctcttttctttttagcac

SEQ ID NO: 667193 - DNA, 25 bp, Homo sapien
gcactgtaaatattccattttctgg

SEQ ID NO: 667194 - DNA, 25 bp, Homo sapien
gttgctataaacatccatgtgcaga

SEQ ID NO: 667195 - DNA, 25 bp, Homo sapien
aatactaaggattgcaattgctgga

SEQ ID NO: 667196 - DNA, 25 bp, Homo sapien
gattgcaattgctggactgtatgac

SEQ ID NO: 667197 - DNA, 25 bp, Homo sapien
ggactgtatgacaagagtatattta

SEQ ID NO: 667198 - DNA, 25 bp, Homo sapien
acaacaagaccatttgtgacagcag

SEQ ID NO: 667199 - DNA, 25 bp, Homo sapien
gtgtccacgcatgacctgaaggtga

SEQ ID NO: 667200 - DNA, 25 bp, Homo sapien
ggtgaaatacttggctaccttggaa

SEQ ID NO: 667201 - DNA, 25 bp, Homo sapien
tggctaccttggaaactttgacaaa

SEQ ID NO: 667202 - DNA, 25 bp, Homo sapien
ctttgacaaaacattacggtgctga

SEQ ID NO: 667203 - DNA, 25 bp, Homo sapien
ggtgctgaaatatttgagacttcca

SEQ ID NO: 667204 - DNA, 25 bp, Homo sapien
gagacttccatgttactgatttcat

SEQ ID NO: 667205 - DNA, 25 bp, Homo sapien
gaattggtttcattcgaatgacggt

SEQ ID NO: 667206 - DNA, 25 bp, Homo sapien
gacggtggaaacgttctctactacg

SEQ ID NO: 667207 - DNA, 25 bp, Homo sapien
tggtgactgggaatcttggaatcca

SEQ ID NO: 667208 - DNA, 25 bp, Homo sapien
gaaccttctcaccaggatgcggata

SEQ ID NO: 667209 - DNA, 25 bp, Homo sapien
gtgaaactagttctctaatggacat

SEQ ID NO: 667210 - DNA, 25 bp, Homo sapien
gaaaatgtaattctggcaaaaatcc

SEQ ID NO: 667211 - DNA, 25 bp, Homo sapien
aggaagaccactcagatgcaatatt

SEQ ID NO: 667212 - DNA, 25 bp, Homo sapien
gaccactcagatgcaatattaaaat

SEQ ID NO: 667213 - DNA, 25 bp, Homo sapien
aaatctgacaaatttcatcaggact

SEQ ID NO: 667214 - DNA, 25 bp, Homo sapien
aatttcatcaggacttattttttat

SEQ ID NO: 667215 - DNA, 25 bp, Homo sapien
atggaacgggttctgatggaaaata

SEQ ID NO: 667216 - DNA, 25 bp, Homo sapien
gatggaaaatatatttcagcccaaa

SEQ ID NO: 667217 - DNA, 25 bp, Homo sapien
atttcagcccaaacttgcagcttat

SEQ ID NO: 667218 - DNA, 25 bp, Homo sapien
gcccaaacttgcagcttatcgtcag

SEQ ID NO: 667219 - DNA, 25 bp, Homo sapien
tgcagcttatcgtcagcttcctgtt

SEQ ID NO: 667220 - DNA, 25 bp, Homo sapien
gagactctgtattataccaaaacaa

SEQ ID NO: 667221 - DNA, 25 bp, Homo sapien
ttttttgtaaatagccaggtgcact

SEQ ID NO: 667222 - DNA, 25 bp, Homo sapien
aaatagccaggtgcactggcatgca

SEQ ID NO: 667223 - DNA, 25 bp, Homo sapien
atagccaggtgcactggcatgcacc

SEQ ID NO: 667224 - DNA, 25 bp, Homo sapien
aggtgcactggcatgcacccataat

SEQ ID NO: 667225 - DNA, 25 bp, Homo sapien
gcactggcatgcacccataatccta

SEQ ID NO: 667226 - DNA, 25 bp, Homo sapien
ctggcatgcacccataatcctagct

SEQ ID NO: 667227 - DNA, 25 bp, Homo sapien
atggcttgagtccatgagccctgga

SEQ ID NO: 667228 - DNA, 25 bp, Homo sapien
tgatttcaccattctagtccaacct

SEQ ID NO: 667229 - DNA, 25 bp, Homo sapien
attctagtccaacctctaacagagc

SEQ ID NO: 667230 - DNA, 25 bp, Homo sapien
ctagtccaacctctaacagagcaag

SEQ ID NO: 667231 - DNA, 25 bp, Homo sapien
tttattcatccatcgttgggtcagg

SEQ ID NO: 667232 - DNA, 25 bp, Homo sapien
tccatcgttgggtcaggttctacag

SEQ ID NO: 667233 - DNA, 25 bp, Homo sapien
ggtcaggttctacaggacagacccc

SEQ ID NO: 667234 - DNA, 25 bp, Homo sapien
ggtcacccttgttatgctgtagcaa

SEQ ID NO: 667235 - DNA, 25 bp, Homo sapien
aagaacttagctccattgtgtccat

SEQ ID NO: 667236 - DNA, 25 bp, Homo sapien
cattgtgtccatgccctagggcttt

SEQ ID NO: 667237 - DNA, 25 bp, Homo sapien
tagggctttgtggaaggccaaactt

SEQ ID NO: 667238 - DNA, 25 bp, Homo sapien
aataacctatagtacctggtggaag

SEQ ID NO: 667239 - DNA, 25 bp, Homo sapien
gaaatttccaagcagcaaagtcttc

SEQ ID NO: 667240 - DNA, 25 bp, Homo sapien
gtcttcaagaagtgcaatggctact

SEQ ID NO: 667241 - DNA, 25 bp, Homo sapien
aatggctacttctaacagcttacaa

SEQ ID NO: 667242 - DNA, 25 bp, Homo sapien
ccaaacagcaactctatttcttaga

SEQ ID NO: 667243 - DNA, 25 bp, Homo sapien
agcaactctatttcttagacatgga

SEQ ID NO: 667244 - DNA, 25 bp, Homo sapien
ctatttcttagacatggaggcattg

SEQ ID NO: 667245 - DNA, 25 bp, Homo sapien
catggaggcattgggttgccagcta

SEQ ID NO: 667246 - DNA, 25 bp, Homo sapien
gcattgggttgccagctagaaccaa

SEQ ID NO: 667247 - DNA, 25 bp, Homo sapien
tgggttgccagctagaaccaactgc

SEQ ID NO: 667248 - DNA, 25 bp, Homo sapien
agctagaaccaactgccctgatact

SEQ ID NO: 667249 - DNA, 25 bp, Homo sapien
aaccaactgccctgatactcttcat

SEQ ID NO: 667250 - DNA, 25 bp, Homo sapien
tgatactcttcatccagttaagtgg

SEQ ID NO: 667251 - DNA, 25 bp, Homo sapien
gttaagtggaaaccttagcaactat

SEQ ID NO: 667252 - DNA, 25 bp, Homo sapien
gtggaaaccttagcaactataataa

SEQ ID NO: 667253 - DNA, 25 bp, Homo sapien
ctttgatacaggttggcttttctct

SEQ ID NO: 667254 - DNA, 25 bp, Homo sapien
tttgatacaggttggcttttctctt

SEQ ID NO: 667255 - DNA, 25 bp, Homo sapien
ttgatacaggttggcttttctcttt

SEQ ID NO: 667256 - DNA, 25 bp, Homo sapien
tttggaatgaagaaatcaagagact

SEQ ID NO: 667257 - DNA, 25 bp, Homo sapien
tcaagagactaattttttacccatc

SEQ ID NO: 667258 - DNA, 25 bp, Homo sapien
agagactaattttttacccatccat

SEQ ID NO: 667259 - DNA, 25 bp, Homo sapien
gagactaattttttacccatccatc

SEQ ID NO: 667260 - DNA, 25 bp, Homo sapien
atccagccacatctttcctaagtga

SEQ ID NO: 667261 - DNA, 25 bp, Homo sapien
tccagccacatctttcctaagtgac

SEQ ID NO: 667262 - DNA, 25 bp, Homo sapien
tcctaagtgacaggacatatcacac

SEQ ID NO: 667263 - DNA, 25 bp, Homo sapien
taagtgacaggacatatcacacacc

SEQ ID NO: 667264 - DNA, 25 bp, Homo sapien
tcttcctctttgtgtgcttgatgga

SEQ ID NO: 667265 - DNA, 25 bp, Homo sapien
ttattgcttgttgatggactaaaaa

SEQ ID NO: 667266 - DNA, 25 bp, Homo sapien
tgcttgttgatggactaaaaaatat

SEQ ID NO: 667267 - DNA, 25 bp, Homo sapien
taaatactgtaggaacatgaagcct

SEQ ID NO: 667268 - DNA, 25 bp, Homo sapien
gacaactgagctaaaatttttcaaa

SEQ ID NO: 667269 - DNA, 25 bp, Homo sapien
gaaaaattaatcctgttatgatgat

SEQ ID NO: 667270 - DNA, 25 bp, Homo sapien
aattaatcctgttatgatgatacat

SEQ ID NO: 667271 - DNA, 25 bp, Homo sapien
aaaagattctattttaagctaatat

SEQ ID NO: 667272 - DNA, 25 bp, Homo sapien
ttaaatcctatttacttgtcatgaa

SEQ ID NO: 667273 - DNA, 25 bp, Homo sapien
aaatcctatttacttgtcatgaatg

SEQ ID NO: 667274 - DNA, 25 bp, Homo sapien
aatcctatttacttgtcatgaatgt

SEQ ID NO: 667275 - DNA, 25 bp, Homo sapien
caggaaatgcaagcacccctagttg

SEQ ID NO: 667276 - DNA, 25 bp, Homo sapien
aagcacccctagttgctgagaacag

SEQ ID NO: 667277 - DNA, 25 bp, Homo sapien
tagttgctgagaacagctcctggct

SEQ ID NO: 667278 - DNA, 25 bp, Homo sapien
gaaataaggatctcagtcttacaac

SEQ ID NO: 667279 - DNA, 25 bp, Homo sapien
ggaagtgaatccatccctagggcct

SEQ ID NO: 667280 - DNA, 25 bp, Homo sapien
catccctagggcctctggaaaggaa

SEQ ID NO: 667281 - DNA, 25 bp, Homo sapien
tttgaccttgtggaacctggagcag

SEQ ID NO: 667282 - DNA, 25 bp, Homo sapien
tggagcagagaaccagttgagccat

SEQ ID NO: 667283 - DNA, 25 bp, Homo sapien
gttgagccatgcagtgtctagactt

SEQ ID NO: 667284 - DNA, 25 bp, Homo sapien
gccatgcagtgtctagacttctgaa

SEQ ID NO: 667285 - DNA, 25 bp, Homo sapien
gacttctgaattacagactgtgaga

SEQ ID NO: 667286 - DNA, 25 bp, Homo sapien
gaagggatacttcaggactagaaag

SEQ ID NO: 667287 - DNA, 25 bp, Homo sapien
aagtcacaaatcttcaaaaggtggt

SEQ ID NO: 667288 - DNA, 25 bp, Homo sapien
aatcttcaaaaggtggtagtagtag

SEQ ID NO: 667289 - DNA, 25 bp, Homo sapien
aggataagaattcccggtccgacag

SEQ ID NO: 667290 - DNA, 25 bp, Homo sapien
ttcccggtccgacagaaagaggtct

SEQ ID NO: 667291 - DNA, 25 bp, Homo sapien
ggtccgacagaaagaggtctatatc

SEQ ID NO: 667292 - DNA, 25 bp, Homo sapien
ggtctatatcagagagtagtcgatc

SEQ ID NO: 667293 - DNA, 25 bp, Homo sapien
tcagagagtagtcgatcaggcaaaa

SEQ ID NO: 667294 - DNA, 25 bp, Homo sapien
gtcgatcaggcaaaagatcttcaag

SEQ ID NO: 667295 - DNA, 25 bp, Homo sapien
ggcgttaatggaagaagccaggctt

SEQ ID NO: 667296 - DNA, 25 bp, Homo sapien
agaaagcacagaaggagcgtggatc

SEQ ID NO: 667297 - DNA, 25 bp, Homo sapien
agaatgcatactggattaaagtact

SEQ ID NO: 667298 - DNA, 25 bp, Homo sapien
aaagtcacgtgaaacttctactgga

SEQ ID NO: 667299 - DNA, 25 bp, Homo sapien
agtcacgtgaaacttctactggaaa

SEQ ID NO: 667300 - DNA, 25 bp, Homo sapien
gtcacgtgaaacttctactggaaag

SEQ ID NO: 667301 - DNA, 25 bp, Homo sapien
cacgtgaaacttctactggaaagaa

SEQ ID NO: 667302 - DNA, 25 bp, Homo sapien
actggaaagaaatcctacacgtaat

SEQ ID NO: 667303 - DNA, 25 bp, Homo sapien
gaaagaaatcctacacgtaatatgg

SEQ ID NO: 667304 - DNA, 25 bp, Homo sapien
cctacacgtaatatggaaagcctgg

SEQ ID NO: 667305 - DNA, 25 bp, Homo sapien
acgtaatatggaaagcctggtgcaa

SEQ ID NO: 667306 - DNA, 25 bp, Homo sapien
atatggaaagcctggtgcaaaataa

SEQ ID NO: 667307 - DNA, 25 bp, Homo sapien
ttgtataatgcttgtgaaaattcac

SEQ ID NO: 667308 - DNA, 25 bp, Homo sapien
ggtgacaagaaattgccctgatcaa

SEQ ID NO: 667309 - DNA, 25 bp, Homo sapien
gaaattgccctgatcaaactgccac

SEQ ID NO: 667310 - DNA, 25 bp, Homo sapien
tgccctgatcaaactgccacagtga

SEQ ID NO: 667311 - DNA, 25 bp, Homo sapien
aaactgccacagtgacacaccatga

SEQ ID NO: 667312 - DNA, 25 bp, Homo sapien
tgccacagtgacacaccatgaaaaa

SEQ ID NO: 667313 - DNA, 25 bp, Homo sapien
tggcaatggcttcatacccaggtca

SEQ ID NO: 667314 - DNA, 25 bp, Homo sapien
aatggcttcatacccaggtcacagg

SEQ ID NO: 667315 - DNA, 25 bp, Homo sapien
ttcatacccaggtcacaggtgcaaa

SEQ ID NO: 667316 - DNA, 25 bp, Homo sapien
tacccaggtcacaggtgcaaatttg

SEQ ID NO: 667317 - DNA, 25 bp, Homo sapien
gtcacaggtgcaaatttggtgcagc

SEQ ID NO: 667318 - DNA, 25 bp, Homo sapien
atttggtgcagcaaagcagcattaa

SEQ ID NO: 667319 - DNA, 25 bp, Homo sapien
aacaaatttgtcatacattcacagg

SEQ ID NO: 667320 - DNA, 25 bp, Homo sapien
caaatttgtcatacattcacaggga

SEQ ID NO: 667321 - DNA, 25 bp, Homo sapien
aaatttgtcatacattcacagggaa

SEQ ID NO: 667322 - DNA, 25 bp, Homo sapien
aatttgtcatacattcacagggaat

SEQ ID NO: 667323 - DNA, 25 bp, Homo sapien
tttgtcatacattcacagggaatga

SEQ ID NO: 667324 - DNA, 25 bp, Homo sapien
tacattcacagggaatgaatctatg

SEQ ID NO: 667325 - DNA, 25 bp, Homo sapien
acagggaatgaatctatgtattgtt

SEQ ID NO: 667326 - DNA, 25 bp, Homo sapien
agggaatgaatctatgtattgttaa

SEQ ID NO: 667327 - DNA, 25 bp, Homo sapien
ttttgtctgtttgaagttttgactt

SEQ ID NO: 667328 - DNA, 25 bp, Homo sapien
gacagttttttacttaagatgtagc

SEQ ID NO: 667329 - DNA, 25 bp, Homo sapien
cagttttttacttaagatgtagctt

SEQ ID NO: 667330 - DNA, 25 bp, Homo sapien
ccagaagacctgcatatgggctgtt

SEQ ID NO: 667331 - DNA, 25 bp, Homo sapien
cagaagacctgcatatgggctgttg

SEQ ID NO: 667332 - DNA, 25 bp, Homo sapien
agaagacctgcatatgggctgttga

SEQ ID NO: 667333 - DNA, 25 bp, Homo sapien
gaagacctgcatatgggctgttgac

SEQ ID NO: 667334 - DNA, 25 bp, Homo sapien
aagacctgcatatgggctgttgact

SEQ ID NO: 667335 - DNA, 25 bp, Homo sapien
agacctgcatatgggctgttgactc

SEQ ID NO: 667336 - DNA, 25 bp, Homo sapien
ctgcatatgggctgttgactcatgc

SEQ ID NO: 667337 - DNA, 25 bp, Homo sapien
gcatatgggctgttgactcatgcaa

SEQ ID NO: 667338 - DNA, 25 bp, Homo sapien
catatgggctgttgactcatgcaaa

SEQ ID NO: 667339 - DNA, 25 bp, Homo sapien
atatgggctgttgactcatgcaaat

SEQ ID NO: 667340 - DNA, 25 bp, Homo sapien
tatgggctgttgactcatgcaaatg

SEQ ID NO: 667341 - DNA, 25 bp, Homo sapien
actgagctgcaaagggaaaaactta

SEQ ID NO: 667342 - DNA, 25 bp, Homo sapien
tcaaggagcagccatggccccagac

SEQ ID NO: 667343 - DNA, 25 bp, Homo sapien
atggccccagacttgtcgcacggat

SEQ ID NO: 667344 - DNA, 25 bp, Homo sapien
cagacttgtcgcacggatgcagaaa

SEQ ID NO: 667345 - DNA, 25 bp, Homo sapien
tcgcacggatgcagaaaacttaatg

SEQ ID NO: 667346 - DNA, 25 bp, Homo sapien
aacttaatggaggaggctgaggtca

SEQ ID NO: 667347 - DNA, 25 bp, Homo sapien
ctgaggtcagaatgggaagagtttt

SEQ ID NO: 667348 - DNA, 25 bp, Homo sapien
gtgaggaactgattgctgtgcatta

SEQ ID NO: 667349 - DNA, 25 bp, Homo sapien
gattgctgtgcattattttccactg

SEQ ID NO: 667350 - DNA, 25 bp, Homo sapien
attttccactgaacagaccttcttt

SEQ ID NO: 667351 - DNA, 25 bp, Homo sapien
tgaacagaccttcttttaacttcta

SEQ ID NO: 667352 - DNA, 25 bp, Homo sapien
ctgttatcagaggactttggattat

SEQ ID NO: 667353 - DNA, 25 bp, Homo sapien
tcagaggactttggattatcatgaa

SEQ ID NO: 667354 - DNA, 25 bp, Homo sapien
atgaaaccttgacatctaggaatct

SEQ ID NO: 667355 - DNA, 25 bp, Homo sapien
accttgacatctaggaatcttgttc

SEQ ID NO: 667356 - DNA, 25 bp, Homo sapien
gttcctgattgattaacttctctaa

SEQ ID NO: 667357 - DNA, 25 bp, Homo sapien
taacttctctaacatctcatttcct

SEQ ID NO: 667358 - DNA, 25 bp, Homo sapien
catctcatttccttatcggttgata

SEQ ID NO: 667359 - DNA, 25 bp, Homo sapien
tcatttccttatcggttgatagcga

SEQ ID NO: 667360 - DNA, 25 bp, Homo sapien
ttccttatcggttgatagcgaagta

SEQ ID NO: 667361 - DNA, 25 bp, Homo sapien
tagcgaagtatattgttctgggatt

SEQ ID NO: 667362 - DNA, 25 bp, Homo sapien
gtatattgttctgggattttaattt

SEQ ID NO: 667363 - DNA, 25 bp, Homo sapien
ctctaacaaagggtgccatgacaca

SEQ ID NO: 667364 - DNA, 25 bp, Homo sapien
aacaaagggtgccatgacacaggca

SEQ ID NO: 667365 - DNA, 25 bp, Homo sapien
ataaatggcaaagctgttggaaacc

SEQ ID NO: 667366 - DNA, 25 bp, Homo sapien
aaccagaaaaccatgtaattttgag

SEQ ID NO: 667367 - DNA, 25 bp, Homo sapien
atcaatcctgtattgtgatacacta

SEQ ID NO: 667368 - DNA, 25 bp, Homo sapien
gtgatacactaagaccaaacttgaa

SEQ ID NO: 667369 - DNA, 25 bp, Homo sapien
gaccaaacttgaatgttattccaca

SEQ ID NO: 667370 - DNA, 25 bp, Homo sapien
gttattccacataagaatctagcca

SEQ ID NO: 667371 - DNA, 25 bp, Homo sapien
atctagccaacagaatgtagttcag

SEQ ID NO: 667372 - DNA, 25 bp, Homo sapien
ggtgaggaaactatattttatggaa

SEQ ID NO: 667373 - DNA, 25 bp, Homo sapien
ggaattgctaatacatttaaaacag

SEQ ID NO: 667374 - DNA, 25 bp, Homo sapien
gaaaatactctaacaagtacttttg

SEQ ID NO: 667375 - DNA, 25 bp, Homo sapien
aagtacttttgaatacagtttctga

SEQ ID NO: 667376 - DNA, 25 bp, Homo sapien
ttttgaatacagtttctgataactt

SEQ ID NO: 667377 - DNA, 25 bp, Homo sapien
aatgcatgaagtaaaaatgtccaaa

SEQ ID NO: 667378 - DNA, 25 bp, Homo sapien
aattgaggagttcttgaaactgcta

SEQ ID NO: 667379 - DNA, 25 bp, Homo sapien
gaggagttcttgaaactgctaacca

SEQ ID NO: 667380 - DNA, 25 bp, Homo sapien
ggagttcttgaaactgctaaccaag

SEQ ID NO: 667381 - DNA, 25 bp, Homo sapien
aactgctaaccaagatcagacaaag

SEQ ID NO: 667382 - DNA, 25 bp, Homo sapien
aaccaagatcagacaaagcaagaat

SEQ ID NO: 667383 - DNA, 25 bp, Homo sapien
tgaattgtggttctttatttttcag

SEQ ID NO: 667384 - DNA, 25 bp, Homo sapien
taaggtccctccagtgtacaacaat

SEQ ID NO: 667385 - DNA, 25 bp, Homo sapien
ttccttttctatcaatcccgggtct

SEQ ID NO: 667386 - DNA, 25 bp, Homo sapien
tccttttctatcaatcccgggtctt

SEQ ID NO: 667387 - DNA, 25 bp, Homo sapien
ctatagcctggaagcacaccccacc

SEQ ID NO: 667388 - DNA, 25 bp, Homo sapien
tatagcctggaagcacaccccaccc

SEQ ID NO: 667389 - DNA, 25 bp, Homo sapien
atagcctggaagcacaccccaccct

SEQ ID NO: 667390 - DNA, 25 bp, Homo sapien
tagcctggaagcacaccccacccta

SEQ ID NO: 667391 - DNA, 25 bp, Homo sapien
agcctggaagcacaccccaccctat

SEQ ID NO: 667392 - DNA, 25 bp, Homo sapien
gcctggaagcacaccccaccctatc

SEQ ID NO: 667393 - DNA, 25 bp, Homo sapien
gaagcacaccccaccctatcccgtt

SEQ ID NO: 667394 - DNA, 25 bp, Homo sapien
caagccgtgccctgaccacctgggg

SEQ ID NO: 667395 - DNA, 25 bp, Homo sapien
agccgtgccctgaccacctggggca

SEQ ID NO: 667396 - DNA, 25 bp, Homo sapien
tgattttacaactcactaacagatc

SEQ ID NO: 667397 - DNA, 25 bp, Homo sapien
acagatcttgacctacagtttgaaa

SEQ ID NO: 667398 - DNA, 25 bp, Homo sapien
gtactgaagagtcttgtttccttta

SEQ ID NO: 667399 - DNA, 25 bp, Homo sapien
gtttcctttatttagaacagtgcaa

SEQ ID NO: 667400 - DNA, 25 bp, Homo sapien
atctgggtagagttgtgcgttgtac

SEQ ID NO: 667401 - DNA, 25 bp, Homo sapien
gttgtgcgttgtacataacctttga

SEQ ID NO: 667402 - DNA, 25 bp, Homo sapien
gttgtacataacctttgatagtcat

SEQ ID NO: 667403 - DNA, 25 bp, Homo sapien
gacttgatttatcctgacagcatac

SEQ ID NO: 667404 - DNA, 25 bp, Homo sapien
tacataatttttggctggctaatac

SEQ ID NO: 667405 - DNA, 25 bp, Homo sapien
ggctggctaatacattatccgattg

SEQ ID NO: 667406 - DNA, 25 bp, Homo sapien
attatccgattgttaattacagcaa

SEQ ID NO: 667407 - DNA, 25 bp, Homo sapien
tacaatttgtagatccacatcccct

SEQ ID NO: 667408 - DNA, 25 bp, Homo sapien
atttttctccatgtccaatgccagt

SEQ ID NO: 667409 - DNA, 25 bp, Homo sapien
ctccatgtccaatgccagtaacttg

SEQ ID NO: 667410 - DNA, 25 bp, Homo sapien
gtaacttggcattattggactttta

SEQ ID NO: 667411 - DNA, 25 bp, Homo sapien
aaatttttgtcaggcatgtcagttt

SEQ ID NO: 667412 - DNA, 25 bp, Homo sapien
ttcacttgtatctcactgtgttttg

SEQ ID NO: 667413 - DNA, 25 bp, Homo sapien
tttccacacttagtaatatggttga

SEQ ID NO: 667414 - DNA, 25 bp, Homo sapien
atatggttgaacatccctttcatgt

SEQ ID NO: 667415 - DNA, 25 bp, Homo sapien
atccctttcatgtttactggtcaca

SEQ ID NO: 667416 - DNA, 25 bp, Homo sapien
gttcatgtcttctggtcatttttca

SEQ ID NO: 667417 - DNA, 25 bp, Homo sapien
acttttatgctgatatgcaggaaca

SEQ ID NO: 667418 - DNA, 25 bp, Homo sapien
aacagaagacatgagcaaagtacaa

SEQ ID NO: 667419 - DNA, 25 bp, Homo sapien
gagtataaccatacctactgtataa

SEQ ID NO: 667420 - DNA, 25 bp, Homo sapien
aacatgcaggaattagttacacatc

SEQ ID NO: 667421 - DNA, 25 bp, Homo sapien
agttacacatcaacataagaccagt

SEQ ID NO: 667422 - DNA, 25 bp, Homo sapien
cataagaccagttagaagttcacgt

SEQ ID NO: 667423 - DNA, 25 bp, Homo sapien
gttagaagttcacgtccaaggtcaa

SEQ ID NO: 667424 - DNA, 25 bp, Homo sapien
gaagttcacgtccaaggtcaatgat

SEQ ID NO: 667425 - DNA, 25 bp, Homo sapien
ccaaggtcaatgatacatttttctt

SEQ ID NO: 667426 - DNA, 25 bp, Homo sapien
ctaactatgaggtatgaggactgac

SEQ ID NO: 667427 - DNA, 25 bp, Homo sapien
gaggtatgaggactgaccctgacaa

SEQ ID NO: 667428 - DNA, 25 bp, Homo sapien
ggactgaccctgacaaaaagacaaa

SEQ ID NO: 667429 - DNA, 25 bp, Homo sapien
gttccaaattttgctgccctttcag

SEQ ID NO: 667430 - DNA, 25 bp, Homo sapien
tttcaggccttcaactctaagtctt

SEQ ID NO: 667431 - DNA, 25 bp, Homo sapien
caactctaagtcttctccttttctt

SEQ ID NO: 667432 - DNA, 25 bp, Homo sapien
gtttgtgtgaactctctcaacttaa

SEQ ID NO: 667433 - DNA, 25 bp, Homo sapien
atgacaccctattcatactcctatc

SEQ ID NO: 667434 - DNA, 25 bp, Homo sapien
tactcctatctgcatcttcatctat

SEQ ID NO: 667435 - DNA, 25 bp, Homo sapien
tattctttctcctatccacttgtgt

SEQ ID NO: 667436 - DNA, 25 bp, Homo sapien
ttgtgtgtgccctggattctcctca

SEQ ID NO: 667437 - DNA, 25 bp, Homo sapien
agggaccaatctcctcagggacctg

SEQ ID NO: 667438 - DNA, 25 bp, Homo sapien
ctggttaatcagttatctcctttct

SEQ ID NO: 667439 - DNA, 25 bp, Homo sapien
tctcctttctttcctgtatcttaaa

SEQ ID NO: 667440 - DNA, 25 bp, Homo sapien
ttctttcttaaatgtcctctttact

SEQ ID NO: 667441 - DNA, 25 bp, Homo sapien
tctttcttaaatgtcctctttactt

SEQ ID NO: 667442 - DNA, 25 bp, Homo sapien
actttctctatcatttttcagacta

SEQ ID NO: 667443 - DNA, 25 bp, Homo sapien
ctttctctatcatttttcagactat

SEQ ID NO: 667444 - DNA, 25 bp, Homo sapien
ttctctatcatttttcagactattc

SEQ ID NO: 667445 - DNA, 25 bp, Homo sapien
ctctatcatttttcagactattctt

SEQ ID NO: 667446 - DNA, 25 bp, Homo sapien
ctatcatttttcagactattcttat

SEQ ID NO: 667447 - DNA, 25 bp, Homo sapien
atcatttttcagactattcttatct

SEQ ID NO: 667448 - DNA, 25 bp, Homo sapien
catttttcagactattcttatcttt

SEQ ID NO: 667449 - DNA, 25 bp, Homo sapien
ttttcagactattcttatctttttt

SEQ ID NO: 667450 - DNA, 25 bp, Homo sapien
ttcagactattcttatcttttttaa

SEQ ID NO: 667451 - DNA, 25 bp, Homo sapien
gggtctcttcatgttacccgggctg

SEQ ID NO: 667452 - DNA, 25 bp, Homo sapien
gagttagattgaaatccaatcataa

SEQ ID NO: 667453 - DNA, 25 bp, Homo sapien
tgaaatccaatcataatgaaatgtg

SEQ ID NO: 667454 - DNA, 25 bp, Homo sapien
gaaatgtggattttgactatagcta

SEQ ID NO: 667455 - DNA, 25 bp, Homo sapien
aaatgtggattttgactatagctaa

SEQ ID NO: 667456 - DNA, 25 bp, Homo sapien
aatgtggattttgactatagctaat

SEQ ID NO: 667457 - DNA, 25 bp, Homo sapien
atgtggattttgactatagctaatt

SEQ ID NO: 667458 - DNA, 25 bp, Homo sapien
tgtggattttgactatagctaattt

SEQ ID NO: 667459 - DNA, 25 bp, Homo sapien
gtggattttgactatagctaatttt

SEQ ID NO: 667460 - DNA, 25 bp, Homo sapien
tggattttgactatagctaattttt

SEQ ID NO: 667461 - DNA, 25 bp, Homo sapien
ggattttgactatagctaatttttt

SEQ ID NO: 667462 - DNA, 25 bp, Homo sapien
tatgtatgttagagaaagcagctac

SEQ ID NO: 667463 - DNA, 25 bp, Homo sapien
gcagctacagcaaagcttcttgtta

SEQ ID NO: 667464 - DNA, 25 bp, Homo sapien
aaagcttcttgttatcagatgcctg

SEQ ID NO: 667465 - DNA, 25 bp, Homo sapien
ttgttatcagatgcctgtgctcctt

SEQ ID NO: 667466 - DNA, 25 bp, Homo sapien
atcagatgcctgtgctccttttctt

SEQ ID NO: 667467 - DNA, 25 bp, Homo sapien
atgacattggctgtgacatctcacc

SEQ ID NO: 667468 - DNA, 25 bp, Homo sapien
gtgacatctcaccatgtgtgcaaaa

SEQ ID NO: 667469 - DNA, 25 bp, Homo sapien
tcaccatgtgtgcaaaaacagttcc

SEQ ID NO: 667470 - DNA, 25 bp, Homo sapien
ggaggtgttatcattagcacataat

SEQ ID NO: 667471 - DNA, 25 bp, Homo sapien
tagcacataatggaagtgtcactgt

SEQ ID NO: 667472 - DNA, 25 bp, Homo sapien
ggaagtgtcactgtttgaagataat

SEQ ID NO: 667473 - DNA, 25 bp, Homo sapien
gatgctcccatagcactggagtggc

SEQ ID NO: 667474 - DNA, 25 bp, Homo sapien
gctcccatagcactggagtggcaga

SEQ ID NO: 667475 - DNA, 25 bp, Homo sapien
agtggcagatagttgccgttctcgt

SEQ ID NO: 667476 - DNA, 25 bp, Homo sapien
agatagttgccgttctcgtcgcact

SEQ ID NO: 667477 - DNA, 25 bp, Homo sapien
ctcgtcgcacttgggcctgaatgaa

SEQ ID NO: 667478 - DNA, 25 bp, Homo sapien
acttgggcctgaatgaacccgggtg

SEQ ID NO: 667479 - DNA, 25 bp, Homo sapien
tggacagcagggatgtggctgacct

SEQ ID NO: 667480 - DNA, 25 bp, Homo sapien
acctcttcctggcacttggtcagta

SEQ ID NO: 667481 - DNA, 25 bp, Homo sapien
ggcacttggtcagtactttcggtgg

SEQ ID NO: 667482 - DNA, 25 bp, Homo sapien
gggaagacacaccagcagtagccga

SEQ ID NO: 667483 - DNA, 25 bp, Homo sapien
agcagtagccgatgctcccatagca

SEQ ID NO: 667484 - DNA, 25 bp, Homo sapien
ggttttgattattccgttaatgctg

SEQ ID NO: 667485 - DNA, 25 bp, Homo sapien
attccgttaatgctgagtctgtttc

SEQ ID NO: 667486 - DNA, 25 bp, Homo sapien
aatgctgagtctgtttcacaaacga

SEQ ID NO: 667487 - DNA, 25 bp, Homo sapien
gtttcacaaacgagattagcagaat

SEQ ID NO: 667488 - DNA, 25 bp, Homo sapien
aaatatgttgatgattatcggtgac

SEQ ID NO: 667489 - DNA, 25 bp, Homo sapien
gattatcggtgactgctcaccacac

SEQ ID NO: 667490 - DNA, 25 bp, Homo sapien
tcggtgactgctcaccacacagcat

SEQ ID NO: 667491 - DNA, 25 bp, Homo sapien
caggccgagtcagttggcccagtga

SEQ ID NO: 667492 - DNA, 25 bp, Homo sapien
agtcagttggcccagtgactcccac

SEQ ID NO: 667493 - DNA, 25 bp, Homo sapien
catgagtgtgagctgatttgcaccc

SEQ ID NO: 667494 - DNA, 25 bp, Homo sapien
caccctctgtaagtgcctgctgtgg

SEQ ID NO: 667495 - DNA, 25 bp, Homo sapien
atagccactttcatccaaaacagat

SEQ ID NO: 667496 - DNA, 25 bp, Homo sapien
aacagatcatgagcctggactttga

SEQ ID NO: 667497 - DNA, 25 bp, Homo sapien
atcatgagcctggactttgacaata

SEQ ID NO: 667498 - DNA, 25 bp, Homo sapien
aaatgttaactacgattattctacg

SEQ ID NO: 667499 - DNA, 25 bp, Homo sapien
gattattctacgttggttctgagct

SEQ ID NO: 667500 - DNA, 25 bp, Homo sapien
tggttctgagctgggatcctgagca

SEQ ID NO: 667501 - DNA, 25 bp, Homo sapien
gagctgggatcctgagcagaatgaa

SEQ ID NO: 667502 - DNA, 25 bp, Homo sapien
aatgggcaactttttgctgtgttac

SEQ ID NO: 667503 - DNA, 25 bp, Homo sapien
gctgtgttactgtatcttaatagct

SEQ ID NO: 667504 - DNA, 25 bp, Homo sapien
gccccatgtgtagttggcaatctga

SEQ ID NO: 667505 - DNA, 25 bp, Homo sapien
gttggcaatctgaatgtatctttac

SEQ ID NO: 667506 - DNA, 25 bp, Homo sapien
cactgcccctgtaggctgcaggcag

SEQ ID NO: 667507 - DNA, 25 bp, Homo sapien
gcagctgcttcagttgagagataca

SEQ ID NO: 667508 - DNA, 25 bp, Homo sapien
cagctgcttcagttgagagatacac

SEQ ID NO: 667509 - DNA, 25 bp, Homo sapien
agctgcttcagttgagagatacact

SEQ ID NO: 667510 - DNA, 25 bp, Homo sapien
gcttcagttgagagatacactgagc

SEQ ID NO: 667511 - DNA, 25 bp, Homo sapien
tcagttgagagatacactgagctcc

SEQ ID NO: 667512 - DNA, 25 bp, Homo sapien
gtacaaagcagcgactggatgccct

SEQ ID NO: 667513 - DNA, 25 bp, Homo sapien
tacaaagcagcgactggatgccctg

SEQ ID NO: 667514 - DNA, 25 bp, Homo sapien
acaaagcagcgactggatgccctgc

SEQ ID NO: 667515 - DNA, 25 bp, Homo sapien
caaagcagcgactggatgccctgct

SEQ ID NO: 667516 - DNA, 25 bp, Homo sapien
aaagcagcgactggatgccctgctg

SEQ ID NO: 667517 - DNA, 25 bp, Homo sapien
ttttaaggcttttgagcgccagatt

SEQ ID NO: 667518 - DNA, 25 bp, Homo sapien
taaggcttttgagcgccagattcag

SEQ ID NO: 667519 - DNA, 25 bp, Homo sapien
gcttttgagcgccagattcagacac

SEQ ID NO: 667520 - DNA, 25 bp, Homo sapien
ttttgagcgccagattcagacactc

SEQ ID NO: 667521 - DNA, 25 bp, Homo sapien
agcgccagattcagacactcagtag

SEQ ID NO: 667522 - DNA, 25 bp, Homo sapien
gccagattcagacactcagtagttt

SEQ ID NO: 667523 - DNA, 25 bp, Homo sapien
gattcagacactcagtagttttaca

SEQ ID NO: 667524 - DNA, 25 bp, Homo sapien
agacactcagtagttttacatgaga

SEQ ID NO: 667525 - DNA, 25 bp, Homo sapien
ttacatgagagtgctacaacatcct

SEQ ID NO: 667526 - DNA, 25 bp, Homo sapien
gagagtgctacaacatcctcactaa

SEQ ID NO: 667527 - DNA, 25 bp, Homo sapien
cactaagtagtatttgggttcatca

SEQ ID NO: 667528 - DNA, 25 bp, Homo sapien
tgacagtttctcaaaagaattaaag

SEQ ID NO: 667529 - DNA, 25 bp, Homo sapien
gacagtttctcaaaagaattaaaga

SEQ ID NO: 667530 - DNA, 25 bp, Homo sapien
acagtttctcaaaagaattaaagat

SEQ ID NO: 667531 - DNA, 25 bp, Homo sapien
ttaaagatagaactagctgggtgca

SEQ ID NO: 667532 - DNA, 25 bp, Homo sapien
taaagatagaactagctgggtgcag

SEQ ID NO: 667533 - DNA, 25 bp, Homo sapien
aaagatagaactagctgggtgcagt

SEQ ID NO: 667534 - DNA, 25 bp, Homo sapien
aagatagaactagctgggtgcagtg

SEQ ID NO: 667535 - DNA, 25 bp, Homo sapien
agatagaactagctgggtgcagtgg

SEQ ID NO: 667536 - DNA, 25 bp, Homo sapien
gggcagatcacgaagtcagtagatc

SEQ ID NO: 667537 - DNA, 25 bp, Homo sapien
ggcagatcacgaagtcagtagatcg

SEQ ID NO: 667538 - DNA, 25 bp, Homo sapien
gcagatcacgaagtcagtagatcga

SEQ ID NO: 667539 - DNA, 25 bp, Homo sapien
aatactccattgtggatatactacg

SEQ ID NO: 667540 - DNA, 25 bp, Homo sapien
ctccattgtggatatactacgtttg

SEQ ID NO: 667541 - DNA, 25 bp, Homo sapien
cattgtggatatactacgtttggtt

SEQ ID NO: 667542 - DNA, 25 bp, Homo sapien
ttgtggatatactacgtttggttta

SEQ ID NO: 667543 - DNA, 25 bp, Homo sapien
gtggatatactacgtttggtttatg

SEQ ID NO: 667544 - DNA, 25 bp, Homo sapien
ggatatactacgtttggtttatgtg

SEQ ID NO: 667545 - DNA, 25 bp, Homo sapien
gatatactacgtttggtttatgtgt

SEQ ID NO: 667546 - DNA, 25 bp, Homo sapien
tactacgtttggtttatgtgtttct

SEQ ID NO: 667547 - DNA, 25 bp, Homo sapien
cacaggttcacaacaccatgcctga

SEQ ID NO: 667548 - DNA, 25 bp, Homo sapien
acaggttcacaacaccatgcctgac

SEQ ID NO: 667549 - DNA, 25 bp, Homo sapien
caggttcacaacaccatgcctgact

SEQ ID NO: 667550 - DNA, 25 bp, Homo sapien
ataaaagtaaccagatcaccccagg

SEQ ID NO: 667551 - DNA, 25 bp, Homo sapien
ccccaggggagcttttatattgata

SEQ ID NO: 667552 - DNA, 25 bp, Homo sapien
gaccccagtgcctataaaagtgcct

SEQ ID NO: 667553 - DNA, 25 bp, Homo sapien
agtgcctggcagatacatagttgtc

SEQ ID NO: 667554 - DNA, 25 bp, Homo sapien
catagttgtcaattgataagtgcat

SEQ ID NO: 667555 - DNA, 25 bp, Homo sapien
atgaacagacatagagatacctctt

SEQ ID NO: 667556 - DNA, 25 bp, Homo sapien
gagatacctctttctgatgaacaga

SEQ ID NO: 667557 - DNA, 25 bp, Homo sapien
gaacagatagatgtataaaccagta

SEQ ID NO: 667558 - DNA, 25 bp, Homo sapien
accagtaagatcattctatgtgcta

SEQ ID NO: 667559 - DNA, 25 bp, Homo sapien
aatgtttcattctatgtgctatgga

SEQ ID NO: 667560 - DNA, 25 bp, Homo sapien
atgtttcctacaataattcattaaa

SEQ ID NO: 667561 - DNA, 25 bp, Homo sapien
gcaatcattccttttaaatacaaca

SEQ ID NO: 667562 - DNA, 25 bp, Homo sapien
caatcattccttttaaatacaacag

SEQ ID NO: 667563 - DNA, 25 bp, Homo sapien
atcattccttttaaatacaacagag

SEQ ID NO: 667564 - DNA, 25 bp, Homo sapien
tcattccttttaaatacaacagagt

SEQ ID NO: 667565 - DNA, 25 bp, Homo sapien
cattccttttaaatacaacagagtt

SEQ ID NO: 667566 - DNA, 25 bp, Homo sapien
taaatacaacagagttaccttagaa

SEQ ID NO: 667567 - DNA, 25 bp, Homo sapien
agtaaacaaatgtaggctggacgcc

SEQ ID NO: 667568 - DNA, 25 bp, Homo sapien
gtaaacaaatgtaggctggacgccg

SEQ ID NO: 667569 - DNA, 25 bp, Homo sapien
taaacaaatgtaggctggacgccgt

SEQ ID NO: 667570 - DNA, 25 bp, Homo sapien
aacaaatgtaggctggacgccgtgg

SEQ ID NO: 667571 - DNA, 25 bp, Homo sapien
aaatgtaggctggacgccgtggctc

SEQ ID NO: 667572 - DNA, 25 bp, Homo sapien
cataagaagcatctccccagccagg

SEQ ID NO: 667573 - DNA, 25 bp, Homo sapien
ataagaagcatctccccagccaggt

SEQ ID NO: 667574 - DNA, 25 bp, Homo sapien
taagaagcatctccccagccaggtg

SEQ ID NO: 667575 - DNA, 25 bp, Homo sapien
aagaagcatctccccagccaggtgt

SEQ ID NO: 667576 - DNA, 25 bp, Homo sapien
agaagcatctccccagccaggtgtg

SEQ ID NO: 667577 - DNA, 25 bp, Homo sapien
gaagcatctccccagccaggtgtgg

SEQ ID NO: 667578 - DNA, 25 bp, Homo sapien
aagcatctccccagccaggtgtggt

SEQ ID NO: 667579 - DNA, 25 bp, Homo sapien
agcatctccccagccaggtgtggtg

SEQ ID NO: 667580 - DNA, 25 bp, Homo sapien
tgggcaacgagaggggaactccatc

SEQ ID NO: 667581 - DNA, 25 bp, Homo sapien
gggcaacgagaggggaactccatct

SEQ ID NO: 667582 - DNA, 25 bp, Homo sapien
ggcaacgagaggggaactccatctc

SEQ ID NO: 667583 - DNA, 25 bp, Homo sapien
atggtgaaaccgcatgcataagcat

SEQ ID NO: 667584 - DNA, 25 bp, Homo sapien
tggtgaaaccgcatgcataagcatg

SEQ ID NO: 667585 - DNA, 25 bp, Homo sapien
ggtgaaaccgcatgcataagcatgg

SEQ ID NO: 667586 - DNA, 25 bp, Homo sapien
gtgaaaccgcatgcataagcatggt

SEQ ID NO: 667587 - DNA, 25 bp, Homo sapien
tgaaaccgcatgcataagcatggtg

SEQ ID NO: 667588 - DNA, 25 bp, Homo sapien
gaaaccgcatgcataagcatggtgg

SEQ ID NO: 667589 - DNA, 25 bp, Homo sapien
aaaccgcatgcataagcatggtggc

SEQ ID NO: 667590 - DNA, 25 bp, Homo sapien
aaccgcatgcataagcatggtggca

SEQ ID NO: 667591 - DNA, 25 bp, Homo sapien
accgcatgcataagcatggtggcac

SEQ ID NO: 667592 - DNA, 25 bp, Homo sapien
ccgcatgcataagcatggtggcaca

SEQ ID NO: 667593 - DNA, 25 bp, Homo sapien
cgcatgcataagcatggtggcacat

SEQ ID NO: 667594 - DNA, 25 bp, Homo sapien
ccgacccagagggatgttttcccat

SEQ ID NO: 667595 - DNA, 25 bp, Homo sapien
cgacccagagggatgttttcccatc

SEQ ID NO: 667596 - DNA, 25 bp, Homo sapien
gacccagagggatgttttcccatcc

SEQ ID NO: 667597 - DNA, 25 bp, Homo sapien
ccagagggatgttttcccatcccaa

SEQ ID NO: 667598 - DNA, 25 bp, Homo sapien
aaggctttcaaacttgtgaccacca

SEQ ID NO: 667599 - DNA, 25 bp, Homo sapien
aggctttcaaacttgtgaccaccac

SEQ ID NO: 667600 - DNA, 25 bp, Homo sapien
ggctttcaaacttgtgaccaccacc

SEQ ID NO: 667601 - DNA, 25 bp, Homo sapien
ctttcaaacttgtgaccaccaccac

SEQ ID NO: 667602 - DNA, 25 bp, Homo sapien
tggtgtgcacgtgcatgcgcacaca

SEQ ID NO: 667603 - DNA, 25 bp, Homo sapien
ggtgtgcacgtgcatgcgcacacac

SEQ ID NO: 667604 - DNA, 25 bp, Homo sapien
cacacatacacttaaatgaaacaaa

SEQ ID NO: 667605 - DNA, 25 bp, Homo sapien
aactcaggtgagtgtctcttcagct

SEQ ID NO: 667606 - DNA, 25 bp, Homo sapien
aggtgagtgtctcttcagctaggaa

SEQ ID NO: 667607 - DNA, 25 bp, Homo sapien
agctaggaaaaactgaggcaacgtc

SEQ ID NO: 667608 - DNA, 25 bp, Homo sapien
aactgaggcaacgtccttgaactga

SEQ ID NO: 667609 - DNA, 25 bp, Homo sapien
ggcaacgtccttgaactgatgctta

SEQ ID NO: 667610 - DNA, 25 bp, Homo sapien
gtccttgaactgatgcttacggagg

SEQ ID NO: 667611 - DNA, 25 bp, Homo sapien
agagatgcaacaactgtaccagata

SEQ ID NO: 667612 - DNA, 25 bp, Homo sapien
gtaccagatagcagatattgaaagc

SEQ ID NO: 667613 - DNA, 25 bp, Homo sapien
acaaccacagtgaagcaccacttcg

SEQ ID NO: 667614 - DNA, 25 bp, Homo sapien
acttcgtccccactgagatggctaa

SEQ ID NO: 667615 - DNA, 25 bp, Homo sapien
gtccccactgagatggctaaaatct

SEQ ID NO: 667616 - DNA, 25 bp, Homo sapien
taggcaataagctaaaatactactt

SEQ ID NO: 667617 - DNA, 25 bp, Homo sapien
aatactactttgtaataaactgtgt

SEQ ID NO: 667618 - DNA, 25 bp, Homo sapien
gtaataaactgtgtagcatactgtt

SEQ ID NO: 667619 - DNA, 25 bp, Homo sapien
aactgtgtagcatactgtttaagag

SEQ ID NO: 667620 - DNA, 25 bp, Homo sapien
aaataacctgttatagccgggcgcg

SEQ ID NO: 667621 - DNA, 25 bp, Homo sapien
aataacctgttatagccgggcgcgg

SEQ ID NO: 667622 - DNA, 25 bp, Homo sapien
agataaaacctctcacatggcatat

SEQ ID NO: 667623 - DNA, 25 bp, Homo sapien
ataaaacctctcacatggcatatgt

SEQ ID NO: 667624 - DNA, 25 bp, Homo sapien
aaacctctcacatggcatatgtatt

SEQ ID NO: 667625 - DNA, 25 bp, Homo sapien
cctctcacatggcatatgtatttat

SEQ ID NO: 667626 - DNA, 25 bp, Homo sapien
tggcatatgtatttatactacacat

SEQ ID NO: 667627 - DNA, 25 bp, Homo sapien
ggattttgtcaattgttttactaat

SEQ ID NO: 667628 - DNA, 25 bp, Homo sapien
tctgtgtcagattccaatctggata

SEQ ID NO: 667629 - DNA, 25 bp, Homo sapien
acatgttgcatttgttcatcacgtc

SEQ ID NO: 667630 - DNA, 25 bp, Homo sapien
gttcatcacgtctcctttgtttttc

SEQ ID NO: 667631 - DNA, 25 bp, Homo sapien
gctgtgacagtttcttattcttttc

SEQ ID NO: 667632 - DNA, 25 bp, Homo sapien
aactgtcactaaattttgcttgtca

SEQ ID NO: 667633 - DNA, 25 bp, Homo sapien
cttgtcagatgttttctcctgggtt

SEQ ID NO: 667634 - DNA, 25 bp, Homo sapien
tctcctgggttagactgggcttaca

SEQ ID NO: 667635 - DNA, 25 bp, Homo sapien
gttagactgggcttacaggttttgg

SEQ ID NO: 667636 - DNA, 25 bp, Homo sapien
ggaaatgtctttctcatctcatcta

SEQ ID NO: 667637 - DNA, 25 bp, Homo sapien
gtctttctcatctcatctaataaat

SEQ ID NO: 667638 - DNA, 25 bp, Homo sapien
ctgaggaggagactcactagaactc

SEQ ID NO: 667639 - DNA, 25 bp, Homo sapien
gaggaggagactcactagaactcag

SEQ ID NO: 667640 - DNA, 25 bp, Homo sapien
ggaggagactcactagaactcagga

SEQ ID NO: 667641 - DNA, 25 bp, Homo sapien
gaggagactcactagaactcaggaa

SEQ ID NO: 667642 - DNA, 25 bp, Homo sapien
ggagactcactagaactcaggaagc

SEQ ID NO: 667643 - DNA, 25 bp, Homo sapien
agactcactagaactcaggaagcag

SEQ ID NO: 667644 - DNA, 25 bp, Homo sapien
aatctttaatagcttattccaggtg

SEQ ID NO: 667645 - DNA, 25 bp, Homo sapien
atctttaatagcttattccaggtga

SEQ ID NO: 667646 - DNA, 25 bp, Homo sapien
ctttaatagcttattccaggtgatc

SEQ ID NO: 667647 - DNA, 25 bp, Homo sapien
ttaatagcttattccaggtgatcgg

SEQ ID NO: 667648 - DNA, 25 bp, Homo sapien
taatagcttattccaggtgatcggg

SEQ ID NO: 667649 - DNA, 25 bp, Homo sapien
ttcccagccccaaagaacttggtgg

SEQ ID NO: 667650 - DNA, 25 bp, Homo sapien
caaagaacttggtggcaagggcctt

SEQ ID NO: 667651 - DNA, 25 bp, Homo sapien
caagggccttggtggcgttcacgca

SEQ ID NO: 667652 - DNA, 25 bp, Homo sapien
tggcgttcacgcagatcgtctttta

SEQ ID NO: 667653 - DNA, 25 bp, Homo sapien
gatcgtcttttattagcggtctgta

SEQ ID NO: 667654 - DNA, 25 bp, Homo sapien
attagcggtctgtaaagcacctccc

SEQ ID NO: 667655 - DNA, 25 bp, Homo sapien
ggtctgtaaagcacctcccagggtc

SEQ ID NO: 667656 - DNA, 25 bp, Homo sapien
ccgaccccagattggaggaagcctt

SEQ ID NO: 667657 - DNA, 25 bp, Homo sapien
aagccttgagaggtcagtagcacca

SEQ ID NO: 667658 - DNA, 25 bp, Homo sapien
gagggcgcgatgtgcagccgatggt

SEQ ID NO: 667659 - DNA, 25 bp, Homo sapien
gggttgtcagcactgggaaggcttg

SEQ ID NO: 667660 - DNA, 25 bp, Homo sapien
tcaaggtaacagatgcctttatttt

SEQ ID NO: 667661 - DNA, 25 bp, Homo sapien
gtaacagatgcctttattttaacta

SEQ ID NO: 667662 - DNA, 25 bp, Homo sapien
gcagagcttccactgcccctgtagg

SEQ ID NO: 667663 - DNA, 25 bp, Homo sapien
gcaggcagctgcttcagttgagaga

SEQ ID NO: 667664 - DNA, 25 bp, Homo sapien
gttgagagatacactgagctccctc

SEQ ID NO: 667665 - DNA, 25 bp, Homo sapien
tccctcaaagaattctatttacggt

SEQ ID NO: 667666 - DNA, 25 bp, Homo sapien
tcaaagaattctatttacggtacaa

SEQ ID NO: 667667 - DNA, 25 bp, Homo sapien
gaattctatttacggtacaaagcag

SEQ ID NO: 667668 - DNA, 25 bp, Homo sapien
attctatttacggtacaaagcagcg

SEQ ID NO: 667669 - DNA, 25 bp, Homo sapien
tacaaagcagcgactggatgccctg

SEQ ID NO: 667670 - DNA, 25 bp, Homo sapien
atgccctgctggattcccactattt

SEQ ID NO: 667671 - DNA, 25 bp, Homo sapien
taacctgaagtgagactactagatc

SEQ ID NO: 667672 - DNA, 25 bp, Homo sapien
gatcatatggtggttctactttctt

SEQ ID NO: 667673 - DNA, 25 bp, Homo sapien
gttttccatagaggctgcacagttt

SEQ ID NO: 667674 - DNA, 25 bp, Homo sapien
gaggctgcacagttttactttccca

SEQ ID NO: 667675 - DNA, 25 bp, Homo sapien
tactttcccagaaacactgtagaag

SEQ ID NO: 667676 - DNA, 25 bp, Homo sapien
aatttctccccattgttaacactcg

SEQ ID NO: 667677 - DNA, 25 bp, Homo sapien
tgttaacactcgttatctttttctt

SEQ ID NO: 667678 - DNA, 25 bp, Homo sapien
gactattctaatgggcttgaggcaa

SEQ ID NO: 667679 - DNA, 25 bp, Homo sapien
gaggcaatatctctttgtggttttg

SEQ ID NO: 667680 - DNA, 25 bp, Homo sapien
ttgatttgcatatccctgattagtg

SEQ ID NO: 667681 - DNA, 25 bp, Homo sapien
catgtatctgttggtcatttggata

SEQ ID NO: 667682 - DNA, 25 bp, Homo sapien
tttctactaccttagttaagtctct

SEQ ID NO: 667683 - DNA, 25 bp, Homo sapien
agttaagtctctcattagcgctcag

SEQ ID NO: 667684 - DNA, 25 bp, Homo sapien
agcgctcagctagatttcagaaaca

SEQ ID NO: 667685 - DNA, 25 bp, Homo sapien
tcagaaacagtgatgaccttcttga

SEQ ID NO: 667686 - DNA, 25 bp, Homo sapien
atctaactcttaaaccaccaacaca

SEQ ID NO: 667687 - DNA, 25 bp, Homo sapien
ggcctttaaaaaccatctgacaatt

SEQ ID NO: 667688 - DNA, 25 bp, Homo sapien
aaccatctgacaattgccagcacat

SEQ ID NO: 667689 - DNA, 25 bp, Homo sapien
gccagcacattaagtggtgtccttc

SEQ ID NO: 667690 - DNA, 25 bp, Homo sapien
aagtggtgtccttcaggatctgctc

SEQ ID NO: 667691 - DNA, 25 bp, Homo sapien
ttcctgcttctctaaccacgacttg

SEQ ID NO: 667692 - DNA, 25 bp, Homo sapien
taaccacgacttgacctgtgcttct

SEQ ID NO: 667693 - DNA, 25 bp, Homo sapien
tccataggaaagctgtttagatctg

SEQ ID NO: 667694 - DNA, 25 bp, Homo sapien
agatctgaggacttaactcactttg

SEQ ID NO: 667695 - DNA, 25 bp, Homo sapien
gaggacttaactcactttgtacggt

SEQ ID NO: 667696 - DNA, 25 bp, Homo sapien
aaacccatagactggctcttgaatg

SEQ ID NO: 667697 - DNA, 25 bp, Homo sapien
ttttcaggtaaaggtgtgtgacgca

SEQ ID NO: 667698 - DNA, 25 bp, Homo sapien
gtgtgtgacgcaggagaagatctta

SEQ ID NO: 667699 - DNA, 25 bp, Homo sapien
gaagatcttagaaactgtatgaaac

SEQ ID NO: 667700 - DNA, 25 bp, Homo sapien
tacgtattcagtataaaccttctct

SEQ ID NO: 667701 - DNA, 25 bp, Homo sapien
ttcagtataaaccttctcttttcca

SEQ ID NO: 667702 - DNA, 25 bp, Homo sapien
tttccagcatgtgggtatacattca

SEQ ID NO: 667703 - DNA, 25 bp, Homo sapien
ggtatacattcatcattccctagaa

SEQ ID NO: 667704 - DNA, 25 bp, Homo sapien
aggcggagtcgatctggaacataca

SEQ ID NO: 667705 - DNA, 25 bp, Homo sapien
ggaacatacagctcgagatcaagaa

SEQ ID NO: 667706 - DNA, 25 bp, Homo sapien
gcaggtcccgcagtcacagtgaaag

SEQ ID NO: 667707 - DNA, 25 bp, Homo sapien
gtgaaagccctcgaagacatcataa

SEQ ID NO: 667708 - DNA, 25 bp, Homo sapien
gacatcataatcatggttctcctca

SEQ ID NO: 667709 - DNA, 25 bp, Homo sapien
tggttctcctcaccttaaggccaag

SEQ ID NO: 667710 - DNA, 25 bp, Homo sapien
taaggccaagcataccagagatgat

SEQ ID NO: 667711 - DNA, 25 bp, Homo sapien
aaaatctcgttctcgatctcagagc

SEQ ID NO: 667712 - DNA, 25 bp, Homo sapien
tcgatctcagagcaagtctcgggat

SEQ ID NO: 667713 - DNA, 25 bp, Homo sapien
aagtctcgggatcactcagatgcag

SEQ ID NO: 667714 - DNA, 25 bp, Homo sapien
gggacaggcgtgaacgatctcgctc

SEQ ID NO: 667715 - DNA, 25 bp, Homo sapien
tctcctactgcttgctcatgaatat

SEQ ID NO: 667716 - DNA, 25 bp, Homo sapien
atgaatatgcttctttcttcccatg

SEQ ID NO: 667717 - DNA, 25 bp, Homo sapien
cttcccatgtaataggcagacttcc

SEQ ID NO: 667718 - DNA, 25 bp, Homo sapien
aggcagacttcctagaatgctcttc

SEQ ID NO: 667719 - DNA, 25 bp, Homo sapien
ttcctagaatgctcttcttctctga

SEQ ID NO: 667720 - DNA, 25 bp, Homo sapien
tctgagaggaggcttcaattcttca

SEQ ID NO: 667721 - DNA, 25 bp, Homo sapien
cctgtgactgcatgggtaagtcaaa

SEQ ID NO: 667722 - DNA, 25 bp, Homo sapien
gctagttatgttgtccagccaagtt

SEQ ID NO: 667723 - DNA, 25 bp, Homo sapien
tgtccagccaagttttaccaataaa

SEQ ID NO: 667724 - DNA, 25 bp, Homo sapien
ccccacatagtactgtgtatgtttc

SEQ ID NO: 667725 - DNA, 25 bp, Homo sapien
gtatgtttctagttgggtctaacct

SEQ ID NO: 667726 - DNA, 25 bp, Homo sapien
aagcctagggttaggaatcttgaat

SEQ ID NO: 667727 - DNA, 25 bp, Homo sapien
tgccactaccttgtatgaccttggt

SEQ ID NO: 667728 - DNA, 25 bp, Homo sapien
tatgaccttggtcaagtactccctg

SEQ ID NO: 667729 - DNA, 25 bp, Homo sapien
accttggtcaagtactccctgtggc

SEQ ID NO: 667730 - DNA, 25 bp, Homo sapien
aagtactccctgtggccctcagtgt

SEQ ID NO: 667731 - DNA, 25 bp, Homo sapien
tctgtacaatactccttagcggcca

SEQ ID NO: 667732 - DNA, 25 bp, Homo sapien
caatactccttagcggccatgagac

SEQ ID NO: 667733 - DNA, 25 bp, Homo sapien
gcctcctctttggactggagaggct

SEQ ID NO: 667734 - DNA, 25 bp, Homo sapien
ggagaggctggaaagccaacttcca

SEQ ID NO: 667735 - DNA, 25 bp, Homo sapien
gaaagccaacttccagtcacctgga

SEQ ID NO: 667736 - DNA, 25 bp, Homo sapien
tggagtaattgcatctccaggcctc

SEQ ID NO: 667737 - DNA, 25 bp, Homo sapien
ggacactgcttagttgcgtagggtt

SEQ ID NO: 667738 - DNA, 25 bp, Homo sapien
tgcttagttgcgtagggtttccttt

SEQ ID NO: 667739 - DNA, 25 bp, Homo sapien
ggctgatgcgcgttgtgattgcacc

SEQ ID NO: 667740 - DNA, 25 bp, Homo sapien
gatgcgcgttgtgattgcaccgaac

SEQ ID NO: 667741 - DNA, 25 bp, Homo sapien
gttgtgattgcaccgaacgttctgc

SEQ ID NO: 667742 - DNA, 25 bp, Homo sapien
caccgaacgttctgcatttactaaa

SEQ ID NO: 667743 - DNA, 25 bp, Homo sapien
taaatgcccccgaattggacacttg

SEQ ID NO: 667744 - DNA, 25 bp, Homo sapien
tggacacttggagacggttaatttc

SEQ ID NO: 667745 - DNA, 25 bp, Homo sapien
agacggttaatttcctgttatgtga

SEQ ID NO: 667746 - DNA, 25 bp, Homo sapien
aaagtgccagattctctagtaaaac

SEQ ID NO: 667747 - DNA, 25 bp, Homo sapien
gattctctagtaaaacaagtcacct

SEQ ID NO: 667748 - DNA, 25 bp, Homo sapien
atcatcattgttctcgtggccactg

SEQ ID NO: 667749 - DNA, 25 bp, Homo sapien
tcattgttctcgtggccactggcat

SEQ ID NO: 667750 - DNA, 25 bp, Homo sapien
ttctcgtggccactggcatcatctt

SEQ ID NO: 667751 - DNA, 25 bp, Homo sapien
ggaccgcagccagaagcgacgcaga

SEQ ID NO: 667752 - DNA, 25 bp, Homo sapien
agaagcgacgcagaccctcagggca

SEQ ID NO: 667753 - DNA, 25 bp, Homo sapien
gcgacgcagaccctcagggcagcaa

SEQ ID NO: 667754 - DNA, 25 bp, Homo sapien
tgacagacctgtccccggctggagt

SEQ ID NO: 667755 - DNA, 25 bp, Homo sapien
tgtccccggctggagtcactgtgct

SEQ ID NO: 667756 - DNA, 25 bp, Homo sapien
cccctgaccatgaggagccccgagg

SEQ ID NO: 667757 - DNA, 25 bp, Homo sapien
tccagccttccagttgaaccggatt

SEQ ID NO: 667758 - DNA, 25 bp, Homo sapien
ccagttgaaccggattcccctggtg

SEQ ID NO: 667759 - DNA, 25 bp, Homo sapien
gttaagaagccatcaggggtggggc

SEQ ID NO: 667760 - DNA, 25 bp, Homo sapien
aggtgggcagatcatttgaggacat

SEQ ID NO: 667761 - DNA, 25 bp, Homo sapien
ggtgggcagatcatttgaggacatg

SEQ ID NO: 667762 - DNA, 25 bp, Homo sapien
cagatcatttgaggacatgagtttg

SEQ ID NO: 667763 - DNA, 25 bp, Homo sapien
agatcatttgaggacatgagtttga

SEQ ID NO: 667764 - DNA, 25 bp, Homo sapien
gatcatttgaggacatgagtttgag

SEQ ID NO: 667765 - DNA, 25 bp, Homo sapien
atcatttgaggacatgagtttgaga

SEQ ID NO: 667766 - DNA, 25 bp, Homo sapien
tcatttgaggacatgagtttgagac

SEQ ID NO: 667767 - DNA, 25 bp, Homo sapien
catttgaggacatgagtttgagacc

SEQ ID NO: 667768 - DNA, 25 bp, Homo sapien
atttgaggacatgagtttgagacca

SEQ ID NO: 667769 - DNA, 25 bp, Homo sapien
tttgaggacatgagtttgagaccag

SEQ ID NO: 667770 - DNA, 25 bp, Homo sapien
taatcatgaacgtatatgtatctga

SEQ ID NO: 667771 - DNA, 25 bp, Homo sapien
atgtatctgataatgtaccctttat

SEQ ID NO: 667772 - DNA, 25 bp, Homo sapien
taatgtaccctttatttatgctcaa

SEQ ID NO: 667773 - DNA, 25 bp, Homo sapien
gtaccctttatttatgctcaatgag

SEQ ID NO: 667774 - DNA, 25 bp, Homo sapien
ccctttatttatgctcaatgagatt

SEQ ID NO: 667775 - DNA, 25 bp, Homo sapien
gatttaacatgttcatctcagaaag

SEQ ID NO: 667776 - DNA, 25 bp, Homo sapien
agaaagggatagatcaagctgcaaa

SEQ ID NO: 667777 - DNA, 25 bp, Homo sapien
gctgcaaaaagtttgcatacataga

SEQ ID NO: 667778 - DNA, 25 bp, Homo sapien
gatctaaatagcatgactaacaagt

SEQ ID NO: 667779 - DNA, 25 bp, Homo sapien
taattttttcaagcacacatataat

SEQ ID NO: 667780 - DNA, 25 bp, Homo sapien
aaaattgaccaggtacaaatcacat

SEQ ID NO: 667781 - DNA, 25 bp, Homo sapien
aacccaagtcttcattcagacacgt

SEQ ID NO: 667782 - DNA, 25 bp, Homo sapien
tcagacacgtcttcattgcagtggg

SEQ ID NO: 667783 - DNA, 25 bp, Homo sapien
taggccttcggccaggacctcctta

SEQ ID NO: 667784 - DNA, 25 bp, Homo sapien
agaatccttgaagacactttcctcc

SEQ ID NO: 667785 - DNA, 25 bp, Homo sapien
ttgaagacactttcctccatgctga

SEQ ID NO: 667786 - DNA, 25 bp, Homo sapien
actttcctccatgctgactcagaag

SEQ ID NO: 667787 - DNA, 25 bp, Homo sapien
gctgactcagaagttttcccactct

SEQ ID NO: 667788 - DNA, 25 bp, Homo sapien
aggtccgtacaacttcaggagcctt

SEQ ID NO: 667789 - DNA, 25 bp, Homo sapien
tcaggagcctttttgttggaagctt

SEQ ID NO: 667790 - DNA, 25 bp, Homo sapien
gttggaagcttttctgcagtgagac

SEQ ID NO: 667791 - DNA, 25 bp, Homo sapien
accccagttggcatcattctatgag

SEQ ID NO: 667792 - DNA, 25 bp, Homo sapien
ttggttgacccccactgtaacctga

SEQ ID NO: 667793 - DNA, 25 bp, Homo sapien
tgtaacctgacctgacctgtggcgg

SEQ ID NO: 667794 - DNA, 25 bp, Homo sapien
ggtacgggaactgtcttagtaatca

SEQ ID NO: 667795 - DNA, 25 bp, Homo sapien
ggaactgtcttagtaatcatggaga

SEQ ID NO: 667796 - DNA, 25 bp, Homo sapien
atggagactggctgaacctgagtgc

SEQ ID NO: 667797 - DNA, 25 bp, Homo sapien
gctgaacctgagtgccaagctgtca

SEQ ID NO: 667798 - DNA, 25 bp, Homo sapien
agtgccaagctgtcagtagggtctg

SEQ ID NO: 667799 - DNA, 25 bp, Homo sapien
gtagggtctgagatgggaaactcct

SEQ ID NO: 667800 - DNA, 25 bp, Homo sapien
atgggaaactcctgaaagtatgatt

SEQ ID NO: 667801 - DNA, 25 bp, Homo sapien
gaaagtatgatttcatttcccagaa

SEQ ID NO: 667802 - DNA, 25 bp, Homo sapien
tgtaaagaatggataccagcaatga

SEQ ID NO: 667803 - DNA, 25 bp, Homo sapien
aaagaagaaccatactctttccact

SEQ ID NO: 667804 - DNA, 25 bp, Homo sapien
ctgacatgatccaacgaggaatatt

SEQ ID NO: 667805 - DNA, 25 bp, Homo sapien
gatccaacgaggaatattttgccac

SEQ ID NO: 667806 - DNA, 25 bp, Homo sapien
acgaggaatattttgccacacggca

SEQ ID NO: 667807 - DNA, 25 bp, Homo sapien
ttgccacacggcaaatatataccgt

SEQ ID NO: 667808 - DNA, 25 bp, Homo sapien
gtataattttctgtaccacttgata

SEQ ID NO: 667809 - DNA, 25 bp, Homo sapien
ttctgtaccacttgatagaaaggta

SEQ ID NO: 667810 - DNA, 25 bp, Homo sapien
aagtaatatgtgcttatcgtgtaac

SEQ ID NO: 667811 - DNA, 25 bp, Homo sapien
aatatgtgcttatcgtgtaactacc

SEQ ID NO: 667812 - DNA, 25 bp, Homo sapien
atgtgcttatcgtgtaactacctaa

SEQ ID NO: 667813 - DNA, 25 bp, Homo sapien
gtgcttatcgtgtaactacctaaaa

SEQ ID NO: 667814 - DNA, 25 bp, Homo sapien
tgaaggtcatccgagaagtgagcaa

SEQ ID NO: 667815 - DNA, 25 bp, Homo sapien
catccgagaagtgagcaagccagtt

SEQ ID NO: 667816 - DNA, 25 bp, Homo sapien
agtggaggtccccagatccccagtc

SEQ ID NO: 667817 - DNA, 25 bp, Homo sapien
ccccagtcctcctgtgcaagttgga

SEQ ID NO: 667818 - DNA, 25 bp, Homo sapien
tcctgtgcaagttggacctggacaa

SEQ ID NO: 667819 - DNA, 25 bp, Homo sapien
ggacctggacaaggtatatctgtct

SEQ ID NO: 667820 - DNA, 25 bp, Homo sapien
aggtatatctgtctccactaagtct

SEQ ID NO: 667821 - DNA, 25 bp, Homo sapien
tatatctgtctccactaagtcttcc

SEQ ID NO: 667822 - DNA, 25 bp, Homo sapien
gaaagtcaggcaactgccaaactgt

SEQ ID NO: 667823 - DNA, 25 bp, Homo sapien
aactgccaaactgtaggtgcccagc

SEQ ID NO: 667824 - DNA, 25 bp, Homo sapien
cagagctggcacaacagtaggtgct

SEQ ID NO: 667825 - DNA, 25 bp, Homo sapien
gaggtacagctgttgaacatcttca

SEQ ID NO: 667826 - DNA, 25 bp, Homo sapien
aatgtgtcaaattcatcatcaccat

SEQ ID NO: 667827 - DNA, 25 bp, Homo sapien
atcaaaactatttgcttctgcactg

SEQ ID NO: 667828 - DNA, 25 bp, Homo sapien
gcttctgcactgaaacaaaattctt

SEQ ID NO: 667829 - DNA, 25 bp, Homo sapien
aattcttcagagtcttcaaagggag

SEQ ID NO: 667830 - DNA, 25 bp, Homo sapien
aagggagtggaatcccctggatctt

SEQ ID NO: 667831 - DNA, 25 bp, Homo sapien
aatcccctggatcttctgttgatgt

SEQ ID NO: 667832 - DNA, 25 bp, Homo sapien
ggatcttctgttgatgtttgactgt

SEQ ID NO: 667833 - DNA, 25 bp, Homo sapien
gatgtttgactgtttgtgaatgttg

SEQ ID NO: 667834 - DNA, 25 bp, Homo sapien
gtctgctcttcattagtatcatctt

SEQ ID NO: 667835 - DNA, 25 bp, Homo sapien
gtatcatcttcagcacatttcaaca

SEQ ID NO: 667836 - DNA, 25 bp, Homo sapien
tccctttcttcatctggataaggaa

SEQ ID NO: 667837 - DNA, 25 bp, Homo sapien
tcatctggataaggaaggctggact

SEQ ID NO: 667838 - DNA, 25 bp, Homo sapien
ctggataaggaaggctggactgcac

SEQ ID NO: 667839 - DNA, 25 bp, Homo sapien
tggactgcaccttctctacaggctg

SEQ ID NO: 667840 - DNA, 25 bp, Homo sapien
tgcaccttctctacaggctgagttg

SEQ ID NO: 667841 - DNA, 25 bp, Homo sapien
accttctctacaggctgagttggac

SEQ ID NO: 667842 - DNA, 25 bp, Homo sapien
ctacaggctgagttggacattcgca

SEQ ID NO: 667843 - DNA, 25 bp, Homo sapien
aggctgagttggacattcgcagatc

SEQ ID NO: 667844 - DNA, 25 bp, Homo sapien
gagttggacattcgcagatctaccc

SEQ ID NO: 667845 - DNA, 25 bp, Homo sapien
gttggacattcgcagatctaccctc

SEQ ID NO: 667846 - DNA, 25 bp, Homo sapien
ccaacctgcattctgcctcaagcag

SEQ ID NO: 667847 - DNA, 25 bp, Homo sapien
agataggaaagcagtgacccataat

SEQ ID NO: 667848 - DNA, 25 bp, Homo sapien
aagcagtgacccataatggaggaaa

SEQ ID NO: 667849 - DNA, 25 bp, Homo sapien
actgaaactgacctagaattgacac

SEQ ID NO: 667850 - DNA, 25 bp, Homo sapien
tgacctagaattgacacagatgtta

SEQ ID NO: 667851 - DNA, 25 bp, Homo sapien
gttagaataagcatggaaggacttt

SEQ ID NO: 667852 - DNA, 25 bp, Homo sapien
acatttattatgagtgtattctgta

SEQ ID NO: 667853 - DNA, 25 bp, Homo sapien
aagaggtacatagagaccagatcaa

SEQ ID NO: 667854 - DNA, 25 bp, Homo sapien
gattaaggcgaagaatgcactggat

SEQ ID NO: 667855 - DNA, 25 bp, Homo sapien
gcactggatgggattaatagttgat

SEQ ID NO: 667856 - DNA, 25 bp, Homo sapien
aaattggtgaacttgaagacagagc

SEQ ID NO: 667857 - DNA, 25 bp, Homo sapien
gaagacagagcaatggaaactacaa

SEQ ID NO: 667858 - DNA, 25 bp, Homo sapien
gaaactgacactgcacctgatgggt

SEQ ID NO: 667859 - DNA, 25 bp, Homo sapien
gacactgcacctgatgggttaacaa

SEQ ID NO: 667860 - DNA, 25 bp, Homo sapien
gggttaacaagatctaggcttcaga

SEQ ID NO: 667861 - DNA, 25 bp, Homo sapien
ggcttcagaaggtgacagatatgag

SEQ ID NO: 667862 - DNA, 25 bp, Homo sapien
acagatatgagtgaggaccatgtgt

SEQ ID NO: 667863 - DNA, 25 bp, Homo sapien
gatgaaaaggttccggcactatagt

SEQ ID NO: 667864 - DNA, 25 bp, Homo sapien
gggccatgttgactccttttcaacc

SEQ ID NO: 667865 - DNA, 25 bp, Homo sapien
actccttttcaaccatttgtcacag

SEQ ID NO: 667866 - DNA, 25 bp, Homo sapien
ttcaaccatttgtcacagacgtgag

SEQ ID NO: 667867 - DNA, 25 bp, Homo sapien
aaacaaatactgaaagtctctactt

SEQ ID NO: 667868 - DNA, 25 bp, Homo sapien
agtctctacttacatccaaatttta

SEQ ID NO: 667869 - DNA, 25 bp, Homo sapien
gctctcttgtaattaatctgtgttg

SEQ ID NO: 667870 - DNA, 25 bp, Homo sapien
ttggcaaagaatgtctggaacatgg

SEQ ID NO: 667871 - DNA, 25 bp, Homo sapien
ggaacatggacttggcggtcagtaa

SEQ ID NO: 667872 - DNA, 25 bp, Homo sapien
gacttggcggtcagtaacctgtaac

SEQ ID NO: 667873 - DNA, 25 bp, Homo sapien
aacctgtaacagagctacaactagg

SEQ ID NO: 667874 - DNA, 25 bp, Homo sapien
gtggtagtagtcacttatttaagaa

SEQ ID NO: 667875 - DNA, 25 bp, Homo sapien
ttcaggtaaacagctgcaccctctg

SEQ ID NO: 667876 - DNA, 25 bp, Homo sapien
cctctgtaccccttaagtggcaaag

SEQ ID NO: 667877 - DNA, 25 bp, Homo sapien
gtggcaaagaagctgttatagtctt

SEQ ID NO: 667878 - DNA, 25 bp, Homo sapien
cactatgagtgctataattctgaat

SEQ ID NO: 667879 - DNA, 25 bp, Homo sapien
tcccaattcgccctaagactttggg

SEQ ID NO: 667880 - DNA, 25 bp, Homo sapien
aggatcttcggaatgatgagcacac

SEQ ID NO: 667881 - DNA, 25 bp, Homo sapien
aatgatgagcacacaaggcgggagc

SEQ ID NO: 667882 - DNA, 25 bp, Homo sapien
acacaaggcgggagctagccaagat

SEQ ID NO: 667883 - DNA, 25 bp, Homo sapien
gatgaagcaggagccggtgaaacct

SEQ ID NO: 667884 - DNA, 25 bp, Homo sapien
aggcagagatatggcaaacaggatt

SEQ ID NO: 667885 - DNA, 25 bp, Homo sapien
acaggattggcgcttttgggtacat

SEQ ID NO: 667886 - DNA, 25 bp, Homo sapien
attggcgcttttgggtacatggagt

SEQ ID NO: 667887 - DNA, 25 bp, Homo sapien
tttgggtacatggagtgttcagcaa

SEQ ID NO: 667888 - DNA, 25 bp, Homo sapien
aggtttttgaaatggctacgagagc

SEQ ID NO: 667889 - DNA, 25 bp, Homo sapien
gctgctctgcaagctagacgtggga

SEQ ID NO: 667890 - DNA, 25 bp, Homo sapien
agcccttatgcggttaattttgaag

SEQ ID NO: 667891 - DNA, 25 bp, Homo sapien
gacagaatacttctaacacccagaa

SEQ ID NO: 667892 - DNA, 25 bp, Homo sapien
ttttgtgtgtgcctttccagtcaac

SEQ ID NO: 667893 - DNA, 25 bp, Homo sapien
aacccaccttctggaggcaacagat

SEQ ID NO: 667894 - DNA, 25 bp, Homo sapien
atcaacgggattattcagtaggaac

SEQ ID NO: 667895 - DNA, 25 bp, Homo sapien
attcagtaggaactctcttctgcct

SEQ ID NO: 667896 - DNA, 25 bp, Homo sapien
gaactctcttctgcctggtttcttt

SEQ ID NO: 667897 - DNA, 25 bp, Homo sapien
tggtttctttcactcgtcatgttct

SEQ ID NO: 667898 - DNA, 25 bp, Homo sapien
tcactcgtcatgttctggaggttaa

SEQ ID NO: 667899 - DNA, 25 bp, Homo sapien
ggaggttaatccgtgttcattaccg

SEQ ID NO: 667900 - DNA, 25 bp, Homo sapien
aatccgtgttcattaccgtaattgt

SEQ ID NO: 667901 - DNA, 25 bp, Homo sapien
taccgtaattgttgagaagtttcct

SEQ ID NO: 667902 - DNA, 25 bp, Homo sapien
ctctatgtctcagatgcattccata

SEQ ID NO: 667903 - DNA, 25 bp, Homo sapien
atgtctcagatgcattccataaggc

SEQ ID NO: 667904 - DNA, 25 bp, Homo sapien
gtctcagatgcattccataaggcat

SEQ ID NO: 667905 - DNA, 25 bp, Homo sapien
gatgcattccataaggcatttcttg

SEQ ID NO: 667906 - DNA, 25 bp, Homo sapien
tgcattccataaggcatttcttgag

SEQ ID NO: 667907 - DNA, 25 bp, Homo sapien
cccaacagggtgactttcaaggcca

SEQ ID NO: 667908 - DNA, 25 bp, Homo sapien
ccaacagggtgactttcaaggccaa

SEQ ID NO: 667909 - DNA, 25 bp, Homo sapien
gaagttcctctgaacactattatct

SEQ ID NO: 667910 - DNA, 25 bp, Homo sapien
agttcctctgaacactattatcttc

SEQ ID NO: 667911 - DNA, 25 bp, Homo sapien
gttcctctgaacactattatcttca

SEQ ID NO: 667912 - DNA, 25 bp, Homo sapien
tgaacactattatcttcatgggcag

SEQ ID NO: 667913 - DNA, 25 bp, Homo sapien
gctcaggcaagaagtccagctgctg

SEQ ID NO: 667914 - DNA, 25 bp, Homo sapien
gcaagaagtccagctgctgagtgct

SEQ ID NO: 667915 - DNA, 25 bp, Homo sapien
ctgagtgctcaatccttgtctcctg

SEQ ID NO: 667916 - DNA, 25 bp, Homo sapien
aatccttgtctcctgctgactgtgt

SEQ ID NO: 667917 - DNA, 25 bp, Homo sapien
gtctcctgctgactgtgtctttgct

SEQ ID NO: 667918 - DNA, 25 bp, Homo sapien
actgtctgggaagagacaacccaca

SEQ ID NO: 667919 - DNA, 25 bp, Homo sapien
aagagacaacccacaaatccctcag

SEQ ID NO: 667920 - DNA, 25 bp, Homo sapien
cctcagcaggtggactgtggctttc

SEQ ID NO: 667921 - DNA, 25 bp, Homo sapien
ccccttctccaaatgtgttgcttat

SEQ ID NO: 667922 - DNA, 25 bp, Homo sapien
gtgttgcttatacccaatgtgacaa

SEQ ID NO: 667923 - DNA, 25 bp, Homo sapien
tacagcctctgctcaggcaagaagt

SEQ ID NO: 667924 - DNA, 25 bp, Homo sapien
atttcttctatataatttctccagg

SEQ ID NO: 667925 - DNA, 25 bp, Homo sapien
atataatttctccaggtgttacaaa

SEQ ID NO: 667926 - DNA, 25 bp, Homo sapien
gatatatcgtcaagagttggtctaa

SEQ ID NO: 667927 - DNA, 25 bp, Homo sapien
gttggtctaagacacaaactacaat

SEQ ID NO: 667928 - DNA, 25 bp, Homo sapien
ctttttcctggtacctagagaatat

SEQ ID NO: 667929 - DNA, 25 bp, Homo sapien
atatatcctgattctcaaattccac

SEQ ID NO: 667930 - DNA, 25 bp, Homo sapien
tccacgtcactatttctcattggga

SEQ ID NO: 667931 - DNA, 25 bp, Homo sapien
gaatcagtgtctagataacatggct

SEQ ID NO: 667932 - DNA, 25 bp, Homo sapien
ggaatttttaattgccatggtatgg

SEQ ID NO: 667933 - DNA, 25 bp, Homo sapien
gggtaatcaggttttctcttatact

SEQ ID NO: 667934 - DNA, 25 bp, Homo sapien
tcaggttttctcttatactgccaac

SEQ ID NO: 667935 - DNA, 25 bp, Homo sapien
gtagctgcttatggtctaggataca

SEQ ID NO: 667936 - DNA, 25 bp, Homo sapien
tagctgcttatggtctaggatacac

SEQ ID NO: 667937 - DNA, 25 bp, Homo sapien
agctgcttatggtctaggatacacc

SEQ ID NO: 667938 - DNA, 25 bp, Homo sapien
gctgcttatggtctaggatacacct

SEQ ID NO: 667939 - DNA, 25 bp, Homo sapien
ctgcttatggtctaggatacaccta

SEQ ID NO: 667940 - DNA, 25 bp, Homo sapien
tgcttatggtctaggatacacctaa

SEQ ID NO: 667941 - DNA, 25 bp, Homo sapien
gcttatggtctaggatacacctaaa

SEQ ID NO: 667942 - DNA, 25 bp, Homo sapien
cttatggtctaggatacacctaaaa

SEQ ID NO: 667943 - DNA, 25 bp, Homo sapien
ttatggtctaggatacacctaaaat

SEQ ID NO: 667944 - DNA, 25 bp, Homo sapien
atggtctaggatacacctaaaatag

SEQ ID NO: 667945 - DNA, 25 bp, Homo sapien
ggtctaggatacacctaaaatagga

SEQ ID NO: 667946 - DNA, 25 bp, Homo sapien
taactatcttttaaattcgtggttg

SEQ ID NO: 667947 - DNA, 25 bp, Homo sapien
tcttttaaattcgtggttgatgtaa

SEQ ID NO: 667948 - DNA, 25 bp, Homo sapien
aaattcgtggttgatgtaagtaata

SEQ ID NO: 667949 - DNA, 25 bp, Homo sapien
ataagagagattatttctgtggtct

SEQ ID NO: 667950 - DNA, 25 bp, Homo sapien
aagccaacaacctgttaccaattat

SEQ ID NO: 667951 - DNA, 25 bp, Homo sapien
aaatgtatctttcaactgtttagtt

SEQ ID NO: 667952 - DNA, 25 bp, Homo sapien
atctttcaactgtttagttacccag

SEQ ID NO: 667953 - DNA, 25 bp, Homo sapien
ttcaactgtttagttacccagctgt

SEQ ID NO: 667954 - DNA, 25 bp, Homo sapien
caactgtttagttacccagctgttt

SEQ ID NO: 667955 - DNA, 25 bp, Homo sapien
agttacccagctgtttaatattcca

SEQ ID NO: 667956 - DNA, 25 bp, Homo sapien
ttacccagctgtttaatattccagt

SEQ ID NO: 667957 - DNA, 25 bp, Homo sapien
ctgtgttctgtcatgagttgcctca

SEQ ID NO: 667958 - DNA, 25 bp, Homo sapien
gttgcctcatgaattaggtgacttt

SEQ ID NO: 667959 - DNA, 25 bp, Homo sapien
taggtgactttgctgttctactaaa

SEQ ID NO: 667960 - DNA, 25 bp, Homo sapien
ctactaaaggctggcatgaccgtta

SEQ ID NO: 667961 - DNA, 25 bp, Homo sapien
tgaccgttaagcaggctgtccttta

SEQ ID NO: 667962 - DNA, 25 bp, Homo sapien
gtcctttataatgcattgtcagcca

SEQ ID NO: 667963 - DNA, 25 bp, Homo sapien
tgcattgtcagccatgctggcgtat

SEQ ID NO: 667964 - DNA, 25 bp, Homo sapien
gctggcgtatcttggaatggcaaca

SEQ ID NO: 667965 - DNA, 25 bp, Homo sapien
ggaattttcattggtcattatgctg

SEQ ID NO: 667966 - DNA, 25 bp, Homo sapien
tgcacttactgctggcttattcatg

SEQ ID NO: 667967 - DNA, 25 bp, Homo sapien
ttcatgtatgttgctctggttgata

SEQ ID NO: 667968 - DNA, 25 bp, Homo sapien
aggaacagtgctgtatggcccgacc

SEQ ID NO: 667969 - DNA, 25 bp, Homo sapien
tatggcccgaccctgaggtctttga

SEQ ID NO: 667970 - DNA, 25 bp, Homo sapien
tgaggtctttgactctctgcgcttt

SEQ ID NO: 667971 - DNA, 25 bp, Homo sapien
tctgcgcttttccactgagaatgca

SEQ ID NO: 667972 - DNA, 25 bp, Homo sapien
tgagaatgcatccaaacgccatccc

SEQ ID NO: 667973 - DNA, 25 bp, Homo sapien
aaacgccatccctttgcctttatgc

SEQ ID NO: 667974 - DNA, 25 bp, Homo sapien
cagcagtttgccatgagtgagatga

SEQ ID NO: 667975 - DNA, 25 bp, Homo sapien
gaaggtggtcacagccatgtgcttg

SEQ ID NO: 667976 - DNA, 25 bp, Homo sapien
catgtgcttgctccgctttgagttc

SEQ ID NO: 667977 - DNA, 25 bp, Homo sapien
atcaagatgccccagcttgtcctgc

SEQ ID NO: 667978 - DNA, 25 bp, Homo sapien
tgtcctgcgctccaagaatggcttt

SEQ ID NO: 667979 - DNA, 25 bp, Homo sapien
aacttatatatgttagctttcttat

SEQ ID NO: 667980 - DNA, 25 bp, Homo sapien
agctttcttatataagtcacctgtt

SEQ ID NO: 667981 - DNA, 25 bp, Homo sapien
atacattcatatctctttatcacat

SEQ ID NO: 667982 - DNA, 25 bp, Homo sapien
atatctctttatcacatttcgtaca

SEQ ID NO: 667983 - DNA, 25 bp, Homo sapien
tcacatttcgtacatcagatttaga

SEQ ID NO: 667984 - DNA, 25 bp, Homo sapien
tagatttaaacatttcacctagaaa

SEQ ID NO: 667985 - DNA, 25 bp, Homo sapien
ttgtgtgtgttatgatgccagtgcc

SEQ ID NO: 667986 - DNA, 25 bp, Homo sapien
gtgtgttatgatgccagtgcctgct

SEQ ID NO: 667987 - DNA, 25 bp, Homo sapien
cagtgcctgcttgtcaacagtttta

SEQ ID NO: 667988 - DNA, 25 bp, Homo sapien
gcctgcttgtcaacagttttatttg

SEQ ID NO: 667989 - DNA, 25 bp, Homo sapien
tttgagcagctataaacatggtgat

SEQ ID NO: 667990 - DNA, 25 bp, Homo sapien
gtttacatattctttgcacctgggc

SEQ ID NO: 667991 - DNA, 25 bp, Homo sapien
aggactcccaccagattaggcctgg

SEQ ID NO: 667992 - DNA, 25 bp, Homo sapien
ggcctgggacatgacagagcctgtc

SEQ ID NO: 667993 - DNA, 25 bp, Homo sapien
agagcctgtcaggtccacgtttgct

SEQ ID NO: 667994 - DNA, 25 bp, Homo sapien
tgcttccagtctagctgtggcctga

SEQ ID NO: 667995 - DNA, 25 bp, Homo sapien
tagctgtggcctgactccaagtcca

SEQ ID NO: 667996 - DNA, 25 bp, Homo sapien
ctccaagtccagtgtaagatttttt

SEQ ID NO: 667997 - DNA, 25 bp, Homo sapien
ataaggaatcggttcattcacctgt

SEQ ID NO: 667998 - DNA, 25 bp, Homo sapien
attcacctgtacgaaaaccagtggg

SEQ ID NO: 667999 - DNA, 25 bp, Homo sapien
aaaccagtgggaggatcatgcataa

SEQ ID NO: 668000 - DNA, 25 bp, Homo sapien
atgcataaggctcatatccttgctg

SEQ ID NO: 668001 - DNA, 25 bp, Homo sapien
gatttctgagaccacgtataccagt

SEQ ID NO: 668002 - DNA, 25 bp, Homo sapien
tgagaccacgtataccagtgaaaat

SEQ ID NO: 668003 - DNA, 25 bp, Homo sapien
accagtgaaaattagcttctgagta

SEQ ID NO: 668004 - DNA, 25 bp, Homo sapien
aaatttctaatttatgccctgcttt

SEQ ID NO: 668005 - DNA, 25 bp, Homo sapien
ttatgccctgctttatttagcctcg

SEQ ID NO: 668006 - DNA, 25 bp, Homo sapien
ttagcctcgctatatgtaacacatg

SEQ ID NO: 668007 - DNA, 25 bp, Homo sapien
tcctagattaaaaccagcatatgct

SEQ ID NO: 668008 - DNA, 25 bp, Homo sapien
ttctgtttcctcctgtgatctttct

SEQ ID NO: 668009 - DNA, 25 bp, Homo sapien
gtgatctttctgaaccaataataaa

SEQ ID NO: 668010 - DNA, 25 bp, Homo sapien
aacagtcaactgtgatgctttttag

SEQ ID NO: 668011 - DNA, 25 bp, Homo sapien
aactgtgatgctttttagtatgaac

SEQ ID NO: 668012 - DNA, 25 bp, Homo sapien
aacagaagaaatatccttgtcatga

SEQ ID NO: 668013 - DNA, 25 bp, Homo sapien
gtcatgaaacacaactactcgcaag

SEQ ID NO: 668014 - DNA, 25 bp, Homo sapien
aactactcgcaagatgctgcagatg

SEQ ID NO: 668015 - DNA, 25 bp, Homo sapien
gatgctgcagatgcctgtgacatag

SEQ ID NO: 668016 - DNA, 25 bp, Homo sapien
aatcgaagaggtgccgaccaccagt

SEQ ID NO: 668017 - DNA, 25 bp, Homo sapien
gaccaccagtcacaggctgtccaga

SEQ ID NO: 668018 - DNA, 25 bp, Homo sapien
gctgtccagacacgataaagccgtc

SEQ ID NO: 668019 - DNA, 25 bp, Homo sapien
acgataaagccgtccagcggttctg

SEQ ID NO: 668020 - DNA, 25 bp, Homo sapien
ggttctgcctcattgggtctctaag

SEQ ID NO: 668021 - DNA, 25 bp, Homo sapien
gggtctctaagcaaacatgaatctg

SEQ ID NO: 668022 - DNA, 25 bp, Homo sapien
gaatacaacacaactagggtctaga

SEQ ID NO: 668023 - DNA, 25 bp, Homo sapien
tgaatccatttacctccagaggaca

SEQ ID NO: 668024 - DNA, 25 bp, Homo sapien
acctccagaggacactagagactgt

SEQ ID NO: 668025 - DNA, 25 bp, Homo sapien
ctagagactgtaggtttaaagacat

SEQ ID NO: 668026 - DNA, 25 bp, Homo sapien
attatgtggcagatggccttgatta

SEQ ID NO: 668027 - DNA, 25 bp, Homo sapien
cagatggccttgattatttgtgtgg

SEQ ID NO: 668028 - DNA, 25 bp, Homo sapien
gggcagcatcttgcatctgcaagct

SEQ ID NO: 668029 - DNA, 25 bp, Homo sapien
tctttgttgccttctccagctgtga

SEQ ID NO: 668030 - DNA, 25 bp, Homo sapien
gttgccttctccagctgtgagacat

SEQ ID NO: 668031 - DNA, 25 bp, Homo sapien
gccttctccagctgtgagacattca

SEQ ID NO: 668032 - DNA, 25 bp, Homo sapien
ttctccagctgtgagacattcactg

SEQ ID NO: 668033 - DNA, 25 bp, Homo sapien
gctgtgagacattcactggaatttt

SEQ ID NO: 668034 - DNA, 25 bp, Homo sapien
aggatattcatgttcactagccaca

SEQ ID NO: 668035 - DNA, 25 bp, Homo sapien
tattcatgttcactagccacagctg

SEQ ID NO: 668036 - DNA, 25 bp, Homo sapien
tagccacagctgctatctttctctt

SEQ ID NO: 668037 - DNA, 25 bp, Homo sapien
acagctgctatctttctcttctctc

SEQ ID NO: 668038 - DNA, 25 bp, Homo sapien
cttcttcttcccatatcactattaa

SEQ ID NO: 668039 - DNA, 25 bp, Homo sapien
tcttcccatatcactattaataggc

SEQ ID NO: 668040 - DNA, 25 bp, Homo sapien
tgtttggctatcttgaaggcctcca

SEQ ID NO: 668041 - DNA, 25 bp, Homo sapien
ggctatcttgaaggcctccaggaat

SEQ ID NO: 668042 - DNA, 25 bp, Homo sapien
aggcctccaggaattaatgttaatt

SEQ ID NO: 668043 - DNA, 25 bp, Homo sapien
gttaatttagttgctctgcggactt

SEQ ID NO: 668044 - DNA, 25 bp, Homo sapien
ctctgcggacttctcacaagtataa

SEQ ID NO: 668045 - DNA, 25 bp, Homo sapien
tgtactgtttcgacccaagtactgc

SEQ ID NO: 668046 - DNA, 25 bp, Homo sapien
gtactgtttcgacccaagtactgct

SEQ ID NO: 668047 - DNA, 25 bp, Homo sapien
actgtttcgacccaagtactgctgt

SEQ ID NO: 668048 - DNA, 25 bp, Homo sapien
ctgtttcgacccaagtactgctgta

SEQ ID NO: 668049 - DNA, 25 bp, Homo sapien
tgtttcgacccaagtactgctgtat

SEQ ID NO: 668050 - DNA, 25 bp, Homo sapien
gtttcgacccaagtactgctgtatc

SEQ ID NO: 668051 - DNA, 25 bp, Homo sapien
tttcgacccaagtactgctgtatcc

SEQ ID NO: 668052 - DNA, 25 bp, Homo sapien
ttcgacccaagtactgctgtatcct

SEQ ID NO: 668053 - DNA, 25 bp, Homo sapien
cttgtctgaattaaacatttttagt

SEQ ID NO: 668054 - DNA, 25 bp, Homo sapien
aatgttaggaagcaaagtagctttg

SEQ ID NO: 668055 - DNA, 25 bp, Homo sapien
ggaagcaaagtagctttgaattttc

SEQ ID NO: 668056 - DNA, 25 bp, Homo sapien
aagagttatgacaaaaccacacaga

SEQ ID NO: 668057 - DNA, 25 bp, Homo sapien
accacacagaacgtgaaggaacctg

SEQ ID NO: 668058 - DNA, 25 bp, Homo sapien
aaggaacctggacgatacacatttg

SEQ ID NO: 668059 - DNA, 25 bp, Homo sapien
aacctggacgatacacatttgaaga

SEQ ID NO: 668060 - DNA, 25 bp, Homo sapien
gtgattcatacccacgttttataag

SEQ ID NO: 668061 - DNA, 25 bp, Homo sapien
acgttttataagatccagtgcctat

SEQ ID NO: 668062 - DNA, 25 bp, Homo sapien
agatccagtgcctatcaggagcttc

SEQ ID NO: 668063 - DNA, 25 bp, Homo sapien
cagtgcctatcaggagcttctacag

SEQ ID NO: 668064 - DNA, 25 bp, Homo sapien
gggaaatctctcacgtccaagaggt

SEQ ID NO: 668065 - DNA, 25 bp, Homo sapien
cacgtccaagaggttaacaagcctt

SEQ ID NO: 668066 - DNA, 25 bp, Homo sapien
taacaagccttgctcagtcttacta

SEQ ID NO: 668067 - DNA, 25 bp, Homo sapien
gctacggaaaaacctgcgagccctg

SEQ ID NO: 668068 - DNA, 25 bp, Homo sapien
aaaaacctgcgagccctggtggttg

SEQ ID NO: 668069 - DNA, 25 bp, Homo sapien
agccctggtggttgtccatgctaca

SEQ ID NO: 668070 - DNA, 25 bp, Homo sapien
tccatgctacatggtatgtgaaagc

SEQ ID NO: 668071 - DNA, 25 bp, Homo sapien
ttctggcactgcttcggcccttcat

SEQ ID NO: 668072 - DNA, 25 bp, Homo sapien
ttcggcccttcatcagttccaaatt

SEQ ID NO: 668073 - DNA, 25 bp, Homo sapien
ccttcatcagttccaaattcacacg

SEQ ID NO: 668074 - DNA, 25 bp, Homo sapien
gaaaaatccgttttctggacagcct

SEQ ID NO: 668075 - DNA, 25 bp, Homo sapien
gggagctggcccaactcatatccct

SEQ ID NO: 668076 - DNA, 25 bp, Homo sapien
tcatatccctggatcaagtccacat

SEQ ID NO: 668077 - DNA, 25 bp, Homo sapien
aagtccacatccctgaagctgtcag

SEQ ID NO: 668078 - DNA, 25 bp, Homo sapien
tggaagcagtgcctcttggtgcaac

SEQ ID NO: 668079 - DNA, 25 bp, Homo sapien
aagcagtgcctcttggtgcaacaag

SEQ ID NO: 668080 - DNA, 25 bp, Homo sapien
gtgcctcttggtgcaacaagaaact

SEQ ID NO: 668081 - DNA, 25 bp, Homo sapien
tcctttaccctcagatttggagatg

SEQ ID NO: 668082 - DNA, 25 bp, Homo sapien
ccctcagatttggagatggtaacca

SEQ ID NO: 668083 - DNA, 25 bp, Homo sapien
gtaggaatgagtgcacggcgacccc

SEQ ID NO: 668084 - DNA, 25 bp, Homo sapien
aggaatgagtgcacggcgaccccgt

SEQ ID NO: 668085 - DNA, 25 bp, Homo sapien
ctctgggtggcactgctttttatag

SEQ ID NO: 668086 - DNA, 25 bp, Homo sapien
gaaaaatcaacgaacactctgtcct

SEQ ID NO: 668087 - DNA, 25 bp, Homo sapien
aatcaacgaacactctgtcctctat

SEQ ID NO: 668088 - DNA, 25 bp, Homo sapien
tgtcctctatccctccaaagaatga

SEQ ID NO: 668089 - DNA, 25 bp, Homo sapien
agcagaggccctggttgacggcaag

SEQ ID NO: 668090 - DNA, 25 bp, Homo sapien
gcaggagttcaggacaaaccagatc

SEQ ID NO: 668091 - DNA, 25 bp, Homo sapien
ttcaggacaaaccagatcaagcaga

SEQ ID NO: 668092 - DNA, 25 bp, Homo sapien
aagtttgggttgaccacgtcatcct

SEQ ID NO: 668093 - DNA, 25 bp, Homo sapien
gtcatcctgcaaaagccataccttg

SEQ ID NO: 668094 - DNA, 25 bp, Homo sapien
aaatccaaactgtgggcatcccaat

SEQ ID NO: 668095 - DNA, 25 bp, Homo sapien
gtgggcatcccaatctatgtaagtt

SEQ ID NO: 668096 - DNA, 25 bp, Homo sapien
ggcatcccaatctatgtaagttttg

SEQ ID NO: 668097 - DNA, 25 bp, Homo sapien
gtaagttttgcattcatcttcccag

SEQ ID NO: 668098 - DNA, 25 bp, Homo sapien
tgcattcatcttcccagcatcttga

SEQ ID NO: 668099 - DNA, 25 bp, Homo sapien
ccccactggtctgcataaaagaaaa

SEQ ID NO: 668100 - DNA, 25 bp, Homo sapien
aatattacctattacgactccatgg

SEQ ID NO: 668101 - DNA, 25 bp, Homo sapien
ttacgactccatgggtgggataaac

SEQ ID NO: 668102 - DNA, 25 bp, Homo sapien
gaagcctgcagaatactcttgcaat

SEQ ID NO: 668103 - DNA, 25 bp, Homo sapien
gtttgacaccaatggctggcagctt

SEQ ID NO: 668104 - DNA, 25 bp, Homo sapien
ccaatggctggcagcttttcagcaa

SEQ ID NO: 668105 - DNA, 25 bp, Homo sapien
gactgtgggatgtttgcctgcaaat

SEQ ID NO: 668106 - DNA, 25 bp, Homo sapien
tgcctgcaaatatgctgactgtatt

SEQ ID NO: 668107 - DNA, 25 bp, Homo sapien
aacttcacacagcaacacatgccat

SEQ ID NO: 668108 - DNA, 25 bp, Homo sapien
acatgccatacttccggaagcggat

SEQ ID NO: 668109 - DNA, 25 bp, Homo sapien
agcggatggtctgggagatcctcca

SEQ ID NO: 668110 - DNA, 25 bp, Homo sapien
gatcctccaccgaaaactcttgtga

SEQ ID NO: 668111 - DNA, 25 bp, Homo sapien
taaacaggtgggattacattgaagt

SEQ ID NO: 668112 - DNA, 25 bp, Homo sapien
atccaaatacataaggaactcatac

SEQ ID NO: 668113 - DNA, 25 bp, Homo sapien
aggaactcatacaactcagtggcaa

SEQ ID NO: 668114 - DNA, 25 bp, Homo sapien
gaactcatacaactcagtggcaaaa

SEQ ID NO: 668115 - DNA, 25 bp, Homo sapien
ctcatacaactcagtggcaaaaacc

SEQ ID NO: 668116 - DNA, 25 bp, Homo sapien
cagagaagctctacagatggccaac

SEQ ID NO: 668117 - DNA, 25 bp, Homo sapien
gagaagctctacagatggccaacag

SEQ ID NO: 668118 - DNA, 25 bp, Homo sapien
gaagctctacagatggccaacaggt

SEQ ID NO: 668119 - DNA, 25 bp, Homo sapien
agctctacagatggccaacaggtat

SEQ ID NO: 668120 - DNA, 25 bp, Homo sapien
gccaacaggtatatgcagaggtctc

SEQ ID NO: 668121 - DNA, 25 bp, Homo sapien
caacaggtatatgcagaggtctcag

SEQ ID NO: 668122 - DNA, 25 bp, Homo sapien
ctggttgatatggtaagtttttaag

SEQ ID NO: 668123 - DNA, 25 bp, Homo sapien
tggttgatatggtaagtttttaaga

SEQ ID NO: 668124 - DNA, 25 bp, Homo sapien
gtcttattacattattgaccaacaa

SEQ ID NO: 668125 - DNA, 25 bp, Homo sapien
tcttattacattattgaccaacaat

SEQ ID NO: 668126 - DNA, 25 bp, Homo sapien
cttattacattattgaccaacaata

SEQ ID NO: 668127 - DNA, 25 bp, Homo sapien
ttattacattattgaccaacaataa

SEQ ID NO: 668128 - DNA, 25 bp, Homo sapien
attgaccaacaataaaatagagaaa

SEQ ID NO: 668129 - DNA, 25 bp, Homo sapien
ttgaccaacaataaaatagagaaaa

SEQ ID NO: 668130 - DNA, 25 bp, Homo sapien
gaaaactgtccaaataccggctcga

SEQ ID NO: 668131 - DNA, 25 bp, Homo sapien
aataccggctcgactcctgggtacg

SEQ ID NO: 668132 - DNA, 25 bp, Homo sapien
tgagactttgcacgtcagtaaccac

SEQ ID NO: 668133 - DNA, 25 bp, Homo sapien
tttgcacgtcagtaaccaccaacac

SEQ ID NO: 668134 - DNA, 25 bp, Homo sapien
tctggttcccacactgcagggatca

SEQ ID NO: 668135 - DNA, 25 bp, Homo sapien
cacactgcagggatcacctgaagta

SEQ ID NO: 668136 - DNA, 25 bp, Homo sapien
agtagaggatctcatgtaacttcat

SEQ ID NO: 668137 - DNA, 25 bp, Homo sapien
tcatgtaacttcatggctctctctg

SEQ ID NO: 668138 - DNA, 25 bp, Homo sapien
atgtaacttcatggctctctctgaa

SEQ ID NO: 668139 - DNA, 25 bp, Homo sapien
tctctctgaacttctgtttctttat

SEQ ID NO: 668140 - DNA, 25 bp, Homo sapien
gggatcagaaactctgtcttaagga

SEQ ID NO: 668141 - DNA, 25 bp, Homo sapien
gaaatagaacattctggcactccag

SEQ ID NO: 668142 - DNA, 25 bp, Homo sapien
aaatagaacattctggcactccaga

SEQ ID NO: 668143 - DNA, 25 bp, Homo sapien
atagaacattctggcactccagaag

SEQ ID NO: 668144 - DNA, 25 bp, Homo sapien
gaacattctggcactccagaagcct

SEQ ID NO: 668145 - DNA, 25 bp, Homo sapien
aacattctggcactccagaagcctc

SEQ ID NO: 668146 - DNA, 25 bp, Homo sapien
attctggcactccagaagcctccta

SEQ ID NO: 668147 - DNA, 25 bp, Homo sapien
ttctctttccccaagaagtaatgtg

SEQ ID NO: 668148 - DNA, 25 bp, Homo sapien
ctttccccaagaagtaatgtgttga

SEQ ID NO: 668149 - DNA, 25 bp, Homo sapien
ttccccaagaagtaatgtgttgact

SEQ ID NO: 668150 - DNA, 25 bp, Homo sapien
ccccaagaagtaatgtgttgacttt

SEQ ID NO: 668151 - DNA, 25 bp, Homo sapien
ccaagaagtaatgtgttgactttta

SEQ ID NO: 668152 - DNA, 25 bp, Homo sapien
tccccggcccggtcggcagaaggag

SEQ ID NO: 668153 - DNA, 25 bp, Homo sapien
ggcagaaggagctggtccgttacta

SEQ ID NO: 668154 - DNA, 25 bp, Homo sapien
cagaaggagctggtccgttactaga

SEQ ID NO: 668155 - DNA, 25 bp, Homo sapien
gaaggagctggtccgttactagaaa

SEQ ID NO: 668156 - DNA, 25 bp, Homo sapien
ggagctggtccgttactagaaaagt

SEQ ID NO: 668157 - DNA, 25 bp, Homo sapien
gagctggtccgttactagaaaagtc

SEQ ID NO: 668158 - DNA, 25 bp, Homo sapien
ctagaaaagtccagatgcaaagtcg

SEQ ID NO: 668159 - DNA, 25 bp, Homo sapien
agaaaagtccagatgcaaagtcggg

SEQ ID NO: 668160 - DNA, 25 bp, Homo sapien
aagtccagatgcaaagtcgggggtc

SEQ ID NO: 668161 - DNA, 25 bp, Homo sapien
gggccgccaccgaccgcacaggacg

SEQ ID NO: 668162 - DNA, 25 bp, Homo sapien
ttctggcccggccgagagctggtgc

SEQ ID NO: 668163 - DNA, 25 bp, Homo sapien
tcaggaaggtgcagcacgagtcttc

SEQ ID NO: 668164 - DNA, 25 bp, Homo sapien
tgctcggccatttacctagaaccaa

SEQ ID NO: 668165 - DNA, 25 bp, Homo sapien
gaaccaaacagcagccaacctcgag

SEQ ID NO: 668166 - DNA, 25 bp, Homo sapien
gccaacctcgagactgattctgaca

SEQ ID NO: 668167 - DNA, 25 bp, Homo sapien
tcgagactgattctgacagcaccag

SEQ ID NO: 668168 - DNA, 25 bp, Homo sapien
gagtaatgaagttctctaaattcga

SEQ ID NO: 668169 - DNA, 25 bp, Homo sapien
ttcctttcccataatgcccaaacga

SEQ ID NO: 668170 - DNA, 25 bp, Homo sapien
taatgcccaaacgacgctgaatcgg

SEQ ID NO: 668171 - DNA, 25 bp, Homo sapien
aacgacgctgaatcggcagcagaat

SEQ ID NO: 668172 - DNA, 25 bp, Homo sapien
acagctaattctcaggtacggaatg

SEQ ID NO: 668173 - DNA, 25 bp, Homo sapien
aattctcaggtacggaatgggctct

SEQ ID NO: 668174 - DNA, 25 bp, Homo sapien
ttcatgtttaagtttggtcaataag

SEQ ID NO: 668175 - DNA, 25 bp, Homo sapien
taaactgaaacctaactgaatgtgt

SEQ ID NO: 668176 - DNA, 25 bp, Homo sapien
gaatgtgtaaatagactgtactcat

SEQ ID NO: 668177 - DNA, 25 bp, Homo sapien
gtaaatagactgtactcatttttgt

SEQ ID NO: 668178 - DNA, 25 bp, Homo sapien
gtactcatttttgtaccaacaactg

SEQ ID NO: 668179 - DNA, 25 bp, Homo sapien
gtaccaacaactgtgttttggccaa

SEQ ID NO: 668180 - DNA, 25 bp, Homo sapien
caacaactgtgttttggccaataaa

SEQ ID NO: 668181 - DNA, 25 bp, Homo sapien
gtgttttggccaataaaaggatgtc

SEQ ID NO: 668182 - DNA, 25 bp, Homo sapien
ggatgtcaaatgttcaaaccatgtt

SEQ ID NO: 668183 - DNA, 25 bp, Homo sapien
gctgttcctgtatttcacttctatt

SEQ ID NO: 668184 - DNA, 25 bp, Homo sapien
tgttcctgtatttcacttctatttt

SEQ ID NO: 668185 - DNA, 25 bp, Homo sapien
ggatcacgcctataggtgtgggcac

SEQ ID NO: 668186 - DNA, 25 bp, Homo sapien
gtgtgggcacatgaaacgacctgga

SEQ ID NO: 668187 - DNA, 25 bp, Homo sapien
gaaacgacctggaacttgcttcaca

SEQ ID NO: 668188 - DNA, 25 bp, Homo sapien
gaacttgcttcacagccctgaggaa

SEQ ID NO: 668189 - DNA, 25 bp, Homo sapien
gcttcacagccctgaggaaggtgga

SEQ ID NO: 668190 - DNA, 25 bp, Homo sapien
gaaggtggacttacataagcagctg

SEQ ID NO: 668191 - DNA, 25 bp, Homo sapien
acataagcagctgtattccattaga

SEQ ID NO: 668192 - DNA, 25 bp, Homo sapien
agcagctgtattccattagatgagt

SEQ ID NO: 668193 - DNA, 25 bp, Homo sapien
cgattggaagagtgagcaggacaca

SEQ ID NO: 668194 - DNA, 25 bp, Homo sapien
gggcacaggagatgtagtcgttcca

SEQ ID NO: 668195 - DNA, 25 bp, Homo sapien
caggagatgtagtcgttccagggct

SEQ ID NO: 668196 - DNA, 25 bp, Homo sapien
gaagacgataaaaacattggacaat

SEQ ID NO: 668197 - DNA, 25 bp, Homo sapien
aacattggacaatcgaattcttgtt

SEQ ID NO: 668198 - DNA, 25 bp, Homo sapien
ggacaatcgaattcttgttattaca

SEQ ID NO: 668199 - DNA, 25 bp, Homo sapien
atcgaattcttgttattacatccaa

SEQ ID NO: 668200 - DNA, 25 bp, Homo sapien
gaattcttgttattacatccaaagc

SEQ ID NO: 668201 - DNA, 25 bp, Homo sapien
attcttgttattacatccaaagcag

SEQ ID NO: 668202 - DNA, 25 bp, Homo sapien
cttgttattacatccaaagcaggtg

SEQ ID NO: 668203 - DNA, 25 bp, Homo sapien
gttattacatccaaagcaggtgagg

SEQ ID NO: 668204 - DNA, 25 bp, Homo sapien
tattacatccaaagcaggtgaggtg

SEQ ID NO: 668205 - DNA, 25 bp, Homo sapien
ttacatccaaagcaggtgaggtgat

SEQ ID NO: 668206 - DNA, 25 bp, Homo sapien
tacatccaaagcaggtgaggtgata

SEQ ID NO: 668207 - DNA, 25 bp, Homo sapien
tgctgcagcaggatgcgcacggctc

SEQ ID NO: 668208 - DNA, 25 bp, Homo sapien
agcaggatgcgcacggctctgtcac

SEQ ID NO: 668209 - DNA, 25 bp, Homo sapien
acggctctgtcaccatcacagggca

SEQ ID NO: 668210 - DNA, 25 bp, Homo sapien
gtcaccatcacagggcagcctatga

SEQ ID NO: 668211 - DNA, 25 bp, Homo sapien
ccatcacagggcagcctatgacatt

SEQ ID NO: 668212 - DNA, 25 bp, Homo sapien
cagaggccctgtgggtgaccgtggg

SEQ ID NO: 668213 - DNA, 25 bp, Homo sapien
gccctggctttcgtgtgctggagaa

SEQ ID NO: 668214 - DNA, 25 bp, Homo sapien
ttcgtgtgctggagaaagatcaaac

SEQ ID NO: 668215 - DNA, 25 bp, Homo sapien
gagaaagatcaaacagagctgtgag

SEQ ID NO: 668216 - DNA, 25 bp, Homo sapien
ggagaaggctccaagacagccctgc

SEQ ID NO: 668217 - DNA, 25 bp, Homo sapien
cctctgaaacactctgacagcaaag

SEQ ID NO: 668218 - DNA, 25 bp, Homo sapien
gaacagcatagtatgtatggattta

SEQ ID NO: 668219 - DNA, 25 bp, Homo sapien
tttgtttaccctactatagagagac

SEQ ID NO: 668220 - DNA, 25 bp, Homo sapien
gtttaccctactatagagagacttg

SEQ ID NO: 668221 - DNA, 25 bp, Homo sapien
accctactatagagagacttgtgat

SEQ ID NO: 668222 - DNA, 25 bp, Homo sapien
gagagacttgtgatatgattgattt

SEQ ID NO: 668223 - DNA, 25 bp, Homo sapien
gagacttgtgatatgattgattttg

SEQ ID NO: 668224 - DNA, 25 bp, Homo sapien
tatgaattaactttactactttgag

SEQ ID NO: 668225 - DNA, 25 bp, Homo sapien
gaaattcatatttgttaagagccta

SEQ ID NO: 668226 - DNA, 25 bp, Homo sapien
attcatatttgttaagagcctataa

SEQ ID NO: 668227 - DNA, 25 bp, Homo sapien
gagcctataaaatatctgactctaa

SEQ ID NO: 668228 - DNA, 25 bp, Homo sapien
atctgactctaatatgaaataaagc

SEQ ID NO: 668229 - DNA, 25 bp, Homo sapien
atggttgttgacttattgcaatatc

SEQ ID NO: 668230 - DNA, 25 bp, Homo sapien
gttgttgacttattgcaatatcatg

SEQ ID NO: 668231 - DNA, 25 bp, Homo sapien
atcatgtgttatataatccatcttt

SEQ ID NO: 668232 - DNA, 25 bp, Homo sapien
atccatctttactgattcgttgcta

SEQ ID NO: 668233 - DNA, 25 bp, Homo sapien
atctttactgattcgttgctaattg

SEQ ID NO: 668234 - DNA, 25 bp, Homo sapien
gattcgttgctaattggtttctgga

SEQ ID NO: 668235 - DNA, 25 bp, Homo sapien
tcgttgctaattggtttctggactt

SEQ ID NO: 668236 - DNA, 25 bp, Homo sapien
tggtttctggacttttaaggctatc

SEQ ID NO: 668237 - DNA, 25 bp, Homo sapien
tttctggacttttaaggctatctga

SEQ ID NO: 668238 - DNA, 25 bp, Homo sapien
aaggctatctgatgaactgttgatc

SEQ ID NO: 668239 - DNA, 25 bp, Homo sapien
gctatctgatgaactgttgatctgg

SEQ ID NO: 668240 - DNA, 25 bp, Homo sapien
aaactttataagatcctggctatcc

SEQ ID NO: 668241 - DNA, 25 bp, Homo sapien
ctttataagatcctggctatcctgt

SEQ ID NO: 668242 - DNA, 25 bp, Homo sapien
ctggctatcctgtggatttttaggc

SEQ ID NO: 668243 - DNA, 25 bp, Homo sapien
ggctatcctgtggatttttaggccc

SEQ ID NO: 668244 - DNA, 25 bp, Homo sapien
ctatcctgtggatttttaggccctt

SEQ ID NO: 668245 - DNA, 25 bp, Homo sapien
atcctgtggatttttaggcccttgt

SEQ ID NO: 668246 - DNA, 25 bp, Homo sapien
cctgtggatttttaggcccttgtat

SEQ ID NO: 668247 - DNA, 25 bp, Homo sapien
cctggagaagtggtaggtaccctca

SEQ ID NO: 668248 - DNA, 25 bp, Homo sapien
tggagaagtggtaggtaccctcaaa

SEQ ID NO: 668249 - DNA, 25 bp, Homo sapien
gtggtaggtaccctcaaaacgtgca

SEQ ID NO: 668250 - DNA, 25 bp, Homo sapien
tggtaggtaccctcaaaacgtgcaa

SEQ ID NO: 668251 - DNA, 25 bp, Homo sapien
aactgctggtgtcccaaggagcaag

SEQ ID NO: 668252 - DNA, 25 bp, Homo sapien
gtcccaaggagcaagtatttacatt

SEQ ID NO: 668253 - DNA, 25 bp, Homo sapien
gaagaaaagacacccctgcaagtgg

SEQ ID NO: 668254 - DNA, 25 bp, Homo sapien
aggtggcctgggtttaatactcaag

SEQ ID NO: 668255 - DNA, 25 bp, Homo sapien
aaacagcttggatttattcttactt

SEQ ID NO: 668256 - DNA, 25 bp, Homo sapien
gcttggatttattcttactttgtat

SEQ ID NO: 668257 - DNA, 25 bp, Homo sapien
tattcttactttgtatgttgtgttg

SEQ ID NO: 668258 - DNA, 25 bp, Homo sapien
tgtccccagtgtcctacaaactaat

SEQ ID NO: 668259 - DNA, 25 bp, Homo sapien
atttgtgcacaagacatcatctatg

SEQ ID NO: 668260 - DNA, 25 bp, Homo sapien
ctatgaatgatgaagttttctcacc

SEQ ID NO: 668261 - DNA, 25 bp, Homo sapien
ttataaacatgttgactcttgttcc

SEQ ID NO: 668262 - DNA, 25 bp, Homo sapien
tgaattttttggtcttctcctggtt

SEQ ID NO: 668263 - DNA, 25 bp, Homo sapien
ttggtcttctcctggttttttggca

SEQ ID NO: 668264 - DNA, 25 bp, Homo sapien
gctggcccgaggatcccatggctct

SEQ ID NO: 668265 - DNA, 25 bp, Homo sapien
cacaccatgtttttgtacagaactg

SEQ ID NO: 668266 - DNA, 25 bp, Homo sapien
gtacagaactgatggttgaatcttt

SEQ ID NO: 668267 - DNA, 25 bp, Homo sapien
aactgatggttgaatctttgttctc

SEQ ID NO: 668268 - DNA, 25 bp, Homo sapien
atggttgaatctttgttctcttgaa

SEQ ID NO: 668269 - DNA, 25 bp, Homo sapien
tcctgccatggccatgaaccgcgac

SEQ ID NO: 668270 - DNA, 25 bp, Homo sapien
gcgacccccactaaatttctagatt

SEQ ID NO: 668271 - DNA, 25 bp, Homo sapien
aggcccaggaaggtctcccctgatt

SEQ ID NO: 668272 - DNA, 25 bp, Homo sapien
gcccaggaaggtctcccctgatttt

SEQ ID NO: 668273 - DNA, 25 bp, Homo sapien
tgagccccaactacgcctggtacaa

SEQ ID NO: 668274 - DNA, 25 bp, Homo sapien
tacgcctggtacaagctggcagagg

SEQ ID NO: 668275 - DNA, 25 bp, Homo sapien
ggtttctgggcgcacagaagtcact

SEQ ID NO: 668276 - DNA, 25 bp, Homo sapien
tgtgaaacagccagacagccgcctg

SEQ ID NO: 668277 - DNA, 25 bp, Homo sapien
gacagccgcctgaggctcagccaag

SEQ ID NO: 668278 - DNA, 25 bp, Homo sapien
acagctggagtgtgtggttctcaac

SEQ ID NO: 668279 - DNA, 25 bp, Homo sapien
tgtggttctcaaccgcaccagcata

SEQ ID NO: 668280 - DNA, 25 bp, Homo sapien
agcataacctcccagctcatggtgg

SEQ ID NO: 668281 - DNA, 25 bp, Homo sapien
ggaatggtttgtatggaagcccaac

SEQ ID NO: 668282 - DNA, 25 bp, Homo sapien
actgtggcccgcttgagccgtgacg

SEQ ID NO: 668283 - DNA, 25 bp, Homo sapien
tgacgccaccttccactatggagag

SEQ ID NO: 668284 - DNA, 25 bp, Homo sapien
gatgatcttgaggtaatttaatttt

SEQ ID NO: 668285 - DNA, 25 bp, Homo sapien
aaaaatgcaagtccaccttgcagat

SEQ ID NO: 668286 - DNA, 25 bp, Homo sapien
aagtccaccttgcagatacgtctgg

SEQ ID NO: 668287 - DNA, 25 bp, Homo sapien
accttgcagatacgtctggctgttt

SEQ ID NO: 668288 - DNA, 25 bp, Homo sapien
cttgcagatacgtctggctgttttt

SEQ ID NO: 668289 - DNA, 25 bp, Homo sapien
agatacgtctggctgttttttgagt

SEQ ID NO: 668290 - DNA, 25 bp, Homo sapien
atacgtctggctgttttttgagtcc

SEQ ID NO: 668291 - DNA, 25 bp, Homo sapien
acgtctggctgttttttgagtccct

SEQ ID NO: 668292 - DNA, 25 bp, Homo sapien
gtctggctgttttttgagtccctgt

SEQ ID NO: 668293 - DNA, 25 bp, Homo sapien
gctgttttttgagtccctgtggtcc

SEQ ID NO: 668294 - DNA, 25 bp, Homo sapien
tcctctgtagtggtaacccctgttt

SEQ ID NO: 668295 - DNA, 25 bp, Homo sapien
ctttccccatctttggcattcttat

SEQ ID NO: 668296 - DNA, 25 bp, Homo sapien
ccatctttggcattcttatcatcac

SEQ ID NO: 668297 - DNA, 25 bp, Homo sapien
ttatcatcaccatccttctggtgcg

SEQ ID NO: 668298 - DNA, 25 bp, Homo sapien
catccttctggtgcgtttcaagagc

SEQ ID NO: 668299 - DNA, 25 bp, Homo sapien
gtgcgtttcaagagccggaactcca

SEQ ID NO: 668300 - DNA, 25 bp, Homo sapien
ttcaagagccggaactccagcaaga

SEQ ID NO: 668301 - DNA, 25 bp, Homo sapien
ccctgttctcagtatccatccaggg

SEQ ID NO: 668302 - DNA, 25 bp, Homo sapien
gccatagactaagcgggtgatgccc

SEQ ID NO: 668303 - DNA, 25 bp, Homo sapien
actaagcgggtgatgccccagcgga

SEQ ID NO: 668304 - DNA, 25 bp, Homo sapien
atgccccagcggatgttggccacgg

SEQ ID NO: 668305 - DNA, 25 bp, Homo sapien
tgaggctctccctttctctgtgatt

SEQ ID NO: 668306 - DNA, 25 bp, Homo sapien
atcaggcctagaccacctcgaccca

SEQ ID NO: 668307 - DNA, 25 bp, Homo sapien
aggagatgaggtttgtatatgggaa

SEQ ID NO: 668308 - DNA, 25 bp, Homo sapien
atgtattgagaaagagctaactgct

SEQ ID NO: 668309 - DNA, 25 bp, Homo sapien
gagaaagagctaactgcttgagtca

SEQ ID NO: 668310 - DNA, 25 bp, Homo sapien
gaaagagctaactgcttgagtcagt

SEQ ID NO: 668311 - DNA, 25 bp, Homo sapien
aagagctaactgcttgagtcagtat

SEQ ID NO: 668312 - DNA, 25 bp, Homo sapien
gagctaactgcttgagtcagtataa

SEQ ID NO: 668313 - DNA, 25 bp, Homo sapien
gctaactgcttgagtcagtataatg

SEQ ID NO: 668314 - DNA, 25 bp, Homo sapien
gcttgagtcagtataatggaggcag

SEQ ID NO: 668315 - DNA, 25 bp, Homo sapien
gtcagtataatggaggcagggaaat

SEQ ID NO: 668316 - DNA, 25 bp, Homo sapien
aatggaggcagggaaatagtaataa

SEQ ID NO: 668317 - DNA, 25 bp, Homo sapien
gttagtaataactattgactcttgt

SEQ ID NO: 668318 - DNA, 25 bp, Homo sapien
tagtaataactattgactcttgttt

SEQ ID NO: 668319 - DNA, 25 bp, Homo sapien
gtaataactattgactcttgttttg

SEQ ID NO: 668320 - DNA, 25 bp, Homo sapien
taataactattgactcttgttttgt

SEQ ID NO: 668321 - DNA, 25 bp, Homo sapien
aataactattgactcttgttttgtt

SEQ ID NO: 668322 - DNA, 25 bp, Homo sapien
ataactattgactcttgttttgttt

SEQ ID NO: 668323 - DNA, 25 bp, Homo sapien
ttaaggaaactagcattgttaatat

SEQ ID NO: 668324 - DNA, 25 bp, Homo sapien
ggaaactagcattgttaatatatac

SEQ ID NO: 668325 - DNA, 25 bp, Homo sapien
actagcattgttaatatatactgat

SEQ ID NO: 668326 - DNA, 25 bp, Homo sapien
ctagcattgttaatatatactgatt

SEQ ID NO: 668327 - DNA, 25 bp, Homo sapien
ttcacagttgtttaattatatattt

SEQ ID NO: 668328 - DNA, 25 bp, Homo sapien
atgtggtgctcacacagattgccca

SEQ ID NO: 668329 - DNA, 25 bp, Homo sapien
agattgcccacttgcaaagaggtga

SEQ ID NO: 668330 - DNA, 25 bp, Homo sapien
gaatgttgtggctctgcgtgcagac

SEQ ID NO: 668331 - DNA, 25 bp, Homo sapien
ctctgcgtgcagacattgtccatat

SEQ ID NO: 668332 - DNA, 25 bp, Homo sapien
gcagacattgtccatatggtcaagt

SEQ ID NO: 668333 - DNA, 25 bp, Homo sapien
gtcaagtcaatgttaaagatccatc

SEQ ID NO: 668334 - DNA, 25 bp, Homo sapien
tgacaagaatttcatctctgttccc

SEQ ID NO: 668335 - DNA, 25 bp, Homo sapien
tgttccctaactgtgcttgtatttt

SEQ ID NO: 668336 - DNA, 25 bp, Homo sapien
aataaagccccaattcagaattgct

SEQ ID NO: 668337 - DNA, 25 bp, Homo sapien
attgctggattattagtacttgaac

SEQ ID NO: 668338 - DNA, 25 bp, Homo sapien
gtacttgaacactagtttaatccta

SEQ ID NO: 668339 - DNA, 25 bp, Homo sapien
cctcttttcctcacaagggatggtg

SEQ ID NO: 668340 - DNA, 25 bp, Homo sapien
gtgtggctcaggaatgtaaggacat

SEQ ID NO: 668341 - DNA, 25 bp, Homo sapien
aggaagaactggcacgtagcctctt

SEQ ID NO: 668342 - DNA, 25 bp, Homo sapien
tggcacgtagcctcttgctgtctaa

SEQ ID NO: 668343 - DNA, 25 bp, Homo sapien
tagcctcttgctgtctaaggtctcg

SEQ ID NO: 668344 - DNA, 25 bp, Homo sapien
taaggtctcgttccgtgctggagaa

SEQ ID NO: 668345 - DNA, 25 bp, Homo sapien
ctcgttccgtgctggagaatgcata

SEQ ID NO: 668346 - DNA, 25 bp, Homo sapien
cgtgctggagaatgcatatgagccc

SEQ ID NO: 668347 - DNA, 25 bp, Homo sapien
tatgagcccaagagtgtgggcctga

SEQ ID NO: 668348 - DNA, 25 bp, Homo sapien
gcctgagtggctgcttaggacgttt

SEQ ID NO: 668349 - DNA, 25 bp, Homo sapien
tggctgcttaggacgttttcgttta

SEQ ID NO: 668350 - DNA, 25 bp, Homo sapien
gaaatagaacattctggcactccag

SEQ ID NO: 668351 - DNA, 25 bp, Homo sapien
aaatagaacattctggcactccaga

SEQ ID NO: 668352 - DNA, 25 bp, Homo sapien
atagaacattctggcactccagaag

SEQ ID NO: 668353 - DNA, 25 bp, Homo sapien
gaacattctggcactccagaagcct

SEQ ID NO: 668354 - DNA, 25 bp, Homo sapien
aacattctggcactccagaagcctc

SEQ ID NO: 668355 - DNA, 25 bp, Homo sapien
attctggcactccagaagcctccta

SEQ ID NO: 668356 - DNA, 25 bp, Homo sapien
ctttccccaagaagtaatgtgttga

SEQ ID NO: 668357 - DNA, 25 bp, Homo sapien
tttccccaagaagtaatgtgttgac

SEQ ID NO: 668358 - DNA, 25 bp, Homo sapien
ttccccaagaagtaatgtgttgact

SEQ ID NO: 668359 - DNA, 25 bp, Homo sapien
ccccaagaagtaatgtgttgacttt

SEQ ID NO: 668360 - DNA, 25 bp, Homo sapien
ccaagaagtaatgtgttgactttta

SEQ ID NO: 668361 - DNA, 25 bp, Homo sapien
aaacaaccagctctggcatgaacta

SEQ ID NO: 668362 - DNA, 25 bp, Homo sapien
aaccagctctggcatgaactaacag

SEQ ID NO: 668363 - DNA, 25 bp, Homo sapien
accagctctggcatgaactaacagt

SEQ ID NO: 668364 - DNA, 25 bp, Homo sapien
cagctctggcatgaactaacagtga

SEQ ID NO: 668365 - DNA, 25 bp, Homo sapien
gctctggcatgaactaacagtgaga

SEQ ID NO: 668366 - DNA, 25 bp, Homo sapien
tctggcatgaactaacagtgagaac

SEQ ID NO: 668367 - DNA, 25 bp, Homo sapien
taccatgtggagggcaccaagctat

SEQ ID NO: 668368 - DNA, 25 bp, Homo sapien
caccaagctattcatgaggaatccg

SEQ ID NO: 668369 - DNA, 25 bp, Homo sapien
caagctattcatgaggaatccgcct

SEQ ID NO: 668370 - DNA, 25 bp, Homo sapien
gctattcatgaggaatccgcctcca

SEQ ID NO: 668371 - DNA, 25 bp, Homo sapien
tccaaaccataagagtctttatttt

SEQ ID NO: 668372 - DNA, 25 bp, Homo sapien
gccagattgtacaaaagtcacctga

SEQ ID NO: 668373 - DNA, 25 bp, Homo sapien
aagtcacctgacaaagactagatga

SEQ ID NO: 668374 - DNA, 25 bp, Homo sapien
gactagatgaagctacaactttaag

SEQ ID NO: 668375 - DNA, 25 bp, Homo sapien
gtagagttgtaatagccttcaccat

SEQ ID NO: 668376 - DNA, 25 bp, Homo sapien
gttgtaatagccttcaccatcactc

SEQ ID NO: 668377 - DNA, 25 bp, Homo sapien
gccttcaccatcactctgtatttta

SEQ ID NO: 668378 - DNA, 25 bp, Homo sapien
accatcactctgtattttacattca

SEQ ID NO: 668379 - DNA, 25 bp, Homo sapien
tcatttcgtttctgtcacttattca

SEQ ID NO: 668380 - DNA, 25 bp, Homo sapien
gtcacttattcagtatctttttatc

SEQ ID NO: 668381 - DNA, 25 bp, Homo sapien
aaagttgctatgatggtaacacaag

SEQ ID NO: 668382 - DNA, 25 bp, Homo sapien
gatggtaacacaagttcttcaaata

SEQ ID NO: 668383 - DNA, 25 bp, Homo sapien
acgggcagttctcgaagctgcagca

SEQ ID NO: 668384 - DNA, 25 bp, Homo sapien
gctgcagcagttacgaacttcaaca

SEQ ID NO: 668385 - DNA, 25 bp, Homo sapien
aagcatgaaacgctccaacaggagg

SEQ ID NO: 668386 - DNA, 25 bp, Homo sapien
caggaggaagtatggccgctgccac

SEQ ID NO: 668387 - DNA, 25 bp, Homo sapien
tgccacttctggttcacaaccaaga

SEQ ID NO: 668388 - DNA, 25 bp, Homo sapien
gatggaccaagaccacagcagcagt

SEQ ID NO: 668389 - DNA, 25 bp, Homo sapien
gcagcagtgacagttggaacaacaa

SEQ ID NO: 668390 - DNA, 25 bp, Homo sapien
ggaacaacaatgatgctgctgcctc

SEQ ID NO: 668391 - DNA, 25 bp, Homo sapien
acgaggaggacattggctccgagac

SEQ ID NO: 668392 - DNA, 25 bp, Homo sapien
gagacgagagccatctactccatcg

SEQ ID NO: 668393 - DNA, 25 bp, Homo sapien
agccatctactccatcgtgctcaag

SEQ ID NO: 668394 - DNA, 25 bp, Homo sapien
gggtctgcaccagccatttcctggg

SEQ ID NO: 668395 - DNA, 25 bp, Homo sapien
accagccatttcctgggctcgtaga

SEQ ID NO: 668396 - DNA, 25 bp, Homo sapien
tttcctgggctcgtagatctagcag

SEQ ID NO: 668397 - DNA, 25 bp, Homo sapien
tgggctcgtagatctagcaggatgt

SEQ ID NO: 668398 - DNA, 25 bp, Homo sapien
ctcgtagatctagcaggatgtgatg

SEQ ID NO: 668399 - DNA, 25 bp, Homo sapien
tgtgccatgggctagagcgtcactg

SEQ ID NO: 668400 - DNA, 25 bp, Homo sapien
gggaggcccacaccgccatcagaat

SEQ ID NO: 668401 - DNA, 25 bp, Homo sapien
tgccagtcagacagggccatggtcc

SEQ ID NO: 668402 - DNA, 25 bp, Homo sapien
tcagacagggccatggtcccaggtg

SEQ ID NO: 668403 - DNA, 25 bp, Homo sapien
gacagggccatggtcccaggtgcat

SEQ ID NO: 668404 - DNA, 25 bp, Homo sapien
gccatggtcccaggtgcatccaggg

SEQ ID NO: 668405 - DNA, 25 bp, Homo sapien
cactgcatgagtggccttgagccaa

SEQ ID NO: 668406 - DNA, 25 bp, Homo sapien
gagtggccttgagccaagtctgaaa

SEQ ID NO: 668407 - DNA, 25 bp, Homo sapien
gtctgaaagggagctaatctaactg

SEQ ID NO: 668408 - DNA, 25 bp, Homo sapien
taactggaattaggactgctgcaag

SEQ ID NO: 668409 - DNA, 25 bp, Homo sapien
gaaagttcagtgaccctgacccttt

SEQ ID NO: 668410 - DNA, 25 bp, Homo sapien
gaccctttcactttggagtgtccag

SEQ ID NO: 668411 - DNA, 25 bp, Homo sapien
agatgcaagtataatagctgtcaca

SEQ ID NO: 668412 - DNA, 25 bp, Homo sapien
aggcactcaataaatctcaactgaa

SEQ ID NO: 668413 - DNA, 25 bp, Homo sapien
cataatccagtttgtggtcatatga

SEQ ID NO: 668414 - DNA, 25 bp, Homo sapien
gatgtattgtttctgtcgtacccag

SEQ ID NO: 668415 - DNA, 25 bp, Homo sapien
aaatctgcataggaagcctctggag

SEQ ID NO: 668416 - DNA, 25 bp, Homo sapien
ttcctgtagctccaacatgactttg

SEQ ID NO: 668417 - DNA, 25 bp, Homo sapien
cctgtagctccaacatgactttgat

SEQ ID NO: 668418 - DNA, 25 bp, Homo sapien
gtagctccaacatgactttgatctg

SEQ ID NO: 668419 - DNA, 25 bp, Homo sapien
gctccaacatgactttgatctgagt

SEQ ID NO: 668420 - DNA, 25 bp, Homo sapien
caacatgactttgatctgagtaata

SEQ ID NO: 668421 - DNA, 25 bp, Homo sapien
ctgagtaatagtgttgtgaaataga

SEQ ID NO: 668422 - DNA, 25 bp, Homo sapien
gattactacatgattttcattgctt

SEQ ID NO: 668423 - DNA, 25 bp, Homo sapien
tactacatgattttcattgctttta

SEQ ID NO: 668424 - DNA, 25 bp, Homo sapien
gttgattaactttcttaagtgtcac

SEQ ID NO: 668425 - DNA, 25 bp, Homo sapien
ttaactttcttaagtgtcacataat

SEQ ID NO: 668426 - DNA, 25 bp, Homo sapien
gaaattgctgtttgccccagatatg

SEQ ID NO: 668427 - DNA, 25 bp, Homo sapien
taagccactatggtatgttttgctg

SEQ ID NO: 668428 - DNA, 25 bp, Homo sapien
atgttttgctggttctcgtagccaa

SEQ ID NO: 668429 - DNA, 25 bp, Homo sapien
ggttctcgtagccaaatacagtttt

SEQ ID NO: 668430 - DNA, 25 bp, Homo sapien
cagttttgactgctatacccatttt

SEQ ID NO: 668431 - DNA, 25 bp, Homo sapien
gttttgactgctatacccatttttt

SEQ ID NO: 668432 - DNA, 25 bp, Homo sapien
cttatggatgttcatgacttctttt

SEQ ID NO: 668433 - DNA, 25 bp, Homo sapien
gacttcttttatattgtggattgta

SEQ ID NO: 668434 - DNA, 25 bp, Homo sapien
gatattattcaatgcttgtaaggtt

SEQ ID NO: 668435 - DNA, 25 bp, Homo sapien
aaggtttttatgtttatgctgttat

SEQ ID NO: 668436 - DNA, 25 bp, Homo sapien
tgctgttatatatatccattttttc

SEQ ID NO: 668437 - DNA, 25 bp, Homo sapien
tttgaacattatcgaagaagacatc

SEQ ID NO: 668438 - DNA, 25 bp, Homo sapien
gcctttgtagacctgcctgatttaa

SEQ ID NO: 668439 - DNA, 25 bp, Homo sapien
ttaatgcagcatcttgacaacaact

SEQ ID NO: 668440 - DNA, 25 bp, Homo sapien
cgaaatgaagctgcggaacctccga

SEQ ID NO: 668441 - DNA, 25 bp, Homo sapien
tccgaccacctcctgaatagtggga

SEQ ID NO: 668442 - DNA, 25 bp, Homo sapien
atagtgggagacaccacccagagcc

SEQ ID NO: 668443 - DNA, 25 bp, Homo sapien
ccagagccctgaagctttgttcctt

SEQ ID NO: 668444 - DNA, 25 bp, Homo sapien
agctttgttccttcggtcatttgga

SEQ ID NO: 668445 - DNA, 25 bp, Homo sapien
tttggaattcctgagggcagccaga

SEQ ID NO: 668446 - DNA, 25 bp, Homo sapien
agagctccttggtcctttcagtact

SEQ ID NO: 668447 - DNA, 25 bp, Homo sapien
ggtcctttcagtactaggcagaaca

SEQ ID NO: 668448 - DNA, 25 bp, Homo sapien
ccccgatctgcatagcctgtgaaag

SEQ ID NO: 668449 - DNA, 25 bp, Homo sapien
ttgaatctcccagcttggactcggc

SEQ ID NO: 668450 - DNA, 25 bp, Homo sapien
ctcccagcttggactcggccagggt

SEQ ID NO: 668451 - DNA, 25 bp, Homo sapien
gtggagctgtctgctttggatgtat

SEQ ID NO: 668452 - DNA, 25 bp, Homo sapien
agctgtctgctttggatgtatcatc

SEQ ID NO: 668453 - DNA, 25 bp, Homo sapien
ggatgtatcatctcatggctcattt

SEQ ID NO: 668454 - DNA, 25 bp, Homo sapien
tcacagtgcgcctctgagcttggga

SEQ ID NO: 668455 - DNA, 25 bp, Homo sapien
agtgcgcctctgagcttgggaacct

SEQ ID NO: 668456 - DNA, 25 bp, Homo sapien
ctctgagcttgggaacctgcttcag

SEQ ID NO: 668457 - DNA, 25 bp, Homo sapien
ttgctgtggagaatggcccagagct

SEQ ID NO: 668458 - DNA, 25 bp, Homo sapien
gagaatggcccagagctgagcagaa

SEQ ID NO: 668459 - DNA, 25 bp, Homo sapien
cagggcgagcacacaccctggagga

SEQ ID NO: 668460 - DNA, 25 bp, Homo sapien
aacagcagcaggctgtccctgagta

SEQ ID NO: 668461 - DNA, 25 bp, Homo sapien
gtccctgagtagttttgctgccata

SEQ ID NO: 668462 - DNA, 25 bp, Homo sapien
gttttgctgccataggttaagtcct

SEQ ID NO: 668463 - DNA, 25 bp, Homo sapien
gccataggttaagtcctcatgtgta

SEQ ID NO: 668464 - DNA, 25 bp, Homo sapien
tgtggcccgcacttcagtaagttat

SEQ ID NO: 668465 - DNA, 25 bp, Homo sapien
agtaagttatcaactctcaccgctg

SEQ ID NO: 668466 - DNA, 25 bp, Homo sapien
agttatcaactctcaccgctgtgaa

SEQ ID NO: 668467 - DNA, 25 bp, Homo sapien
tgtgaacctgccaatccgctgtaac

SEQ ID NO: 668468 - DNA, 25 bp, Homo sapien
atccgctgtaacaactctgctttaa

SEQ ID NO: 668469 - DNA, 25 bp, Homo sapien
ttgccatcctatgtgcatgccgtaa

SEQ ID NO: 668470 - DNA, 25 bp, Homo sapien
gtgcatgccgtaagatcagttggat

SEQ ID NO: 668471 - DNA, 25 bp, Homo sapien
aaagccaaaaatgctgtggtgaaga

SEQ ID NO: 668472 - DNA, 25 bp, Homo sapien
cagcctcctcagacaaaatggtaca

SEQ ID NO: 668473 - DNA, 25 bp, Homo sapien
tcctcagacaaaatggtacacccca

SEQ ID NO: 668474 - DNA, 25 bp, Homo sapien
tacaccccaattaagggtcgtcttg

SEQ ID NO: 668475 - DNA, 25 bp, Homo sapien
attaagggtcgtcttgatgctctct

SEQ ID NO: 668476 - DNA, 25 bp, Homo sapien
agggtcgtcttgatgctctctgggc

SEQ ID NO: 668477 - DNA, 25 bp, Homo sapien
cttgatgctctctgggctttgttga

SEQ ID NO: 668478 - DNA, 25 bp, Homo sapien
aggcggcagtatgaccgggtttctt

SEQ ID NO: 668479 - DNA, 25 bp, Homo sapien
atgaccgggtttctttgatgcgacc

SEQ ID NO: 668480 - DNA, 25 bp, Homo sapien
ggtttctttgatgcgacctcaggaa

SEQ ID NO: 668481 - DNA, 25 bp, Homo sapien
tttgatgcgacctcaggaaggagat

SEQ ID NO: 668482 - DNA, 25 bp, Homo sapien
ctcctctgccccagggtgagtgtgg

SEQ ID NO: 668483 - DNA, 25 bp, Homo sapien
gtgagtgtggcactgaaccccagca

SEQ ID NO: 668484 - DNA, 25 bp, Homo sapien
tgtggcactgaaccccagcaccatt

SEQ ID NO: 668485 - DNA, 25 bp, Homo sapien
aatgcagggatgcccaccacggccg

SEQ ID NO: 668486 - DNA, 25 bp, Homo sapien
atctcagcctggttcctggacacag

SEQ ID NO: 668487 - DNA, 25 bp, Homo sapien
tggttcctggacacagatgccgtgg

SEQ ID NO: 668488 - DNA, 25 bp, Homo sapien
ctggacacagatgccgtggtgtgct

SEQ ID NO: 668489 - DNA, 25 bp, Homo sapien
tggagccggctcctactagctggca

SEQ ID NO: 668490 - DNA, 25 bp, Homo sapien
cctactagctggcaggagtcaatct

SEQ ID NO: 668491 - DNA, 25 bp, Homo sapien
ggcaggagtcaatctgcacatctct

SEQ ID NO: 668492 - DNA, 25 bp, Homo sapien
ctccccaaaaccatgatcagcgaaa

SEQ ID NO: 668493 - DNA, 25 bp, Homo sapien
cgcccatcgtacaatggaggatacg

SEQ ID NO: 668494 - DNA, 25 bp, Homo sapien
gtacaatggaggatacggattctct

SEQ ID NO: 668495 - DNA, 25 bp, Homo sapien
tggaggatacggattctctggcttt

SEQ ID NO: 668496 - DNA, 25 bp, Homo sapien
gagaaacctccaaatgtgtttggtc

SEQ ID NO: 668497 - DNA, 25 bp, Homo sapien
gaaacctccaaatgtgtttggtcct

SEQ ID NO: 668498 - DNA, 25 bp, Homo sapien
aacctccaaatgtgtttggtcctgt

SEQ ID NO: 668499 - DNA, 25 bp, Homo sapien
acctccaaatgtgtttggtcctgtc

SEQ ID NO: 668500 - DNA, 25 bp, Homo sapien
tccaaatgtgtttggtcctgtcccg

SEQ ID NO: 668501 - DNA, 25 bp, Homo sapien
caaatgtgtttggtcctgtcccgtg

SEQ ID NO: 668502 - DNA, 25 bp, Homo sapien
aaatgtgtttggtcctgtcccgtgc

SEQ ID NO: 668503 - DNA, 25 bp, Homo sapien
aatgtgtttggtcctgtcccgtgct

SEQ ID NO: 668504 - DNA, 25 bp, Homo sapien
gctatccgtggatacagacgcttag

SEQ ID NO: 668505 - DNA, 25 bp, Homo sapien
cgtggatacagacgcttagctctta

SEQ ID NO: 668506 - DNA, 25 bp, Homo sapien
cagacgcttagctcttaaaagattt

SEQ ID NO: 668507 - DNA, 25 bp, Homo sapien
ttgaaatagtccacttcaccttaat

SEQ ID NO: 668508 - DNA, 25 bp, Homo sapien
accttaatgggtcttgtctatcttc

SEQ ID NO: 668509 - DNA, 25 bp, Homo sapien
tgtctatcttcattagtcttcaaag

SEQ ID NO: 668510 - DNA, 25 bp, Homo sapien
gtattttgaatgtgcttctcttgtt

SEQ ID NO: 668511 - DNA, 25 bp, Homo sapien
tttgtttattagctagttcctgtaa

SEQ ID NO: 668512 - DNA, 25 bp, Homo sapien
agctagttcctgtaagcatttccac

SEQ ID NO: 668513 - DNA, 25 bp, Homo sapien
gcatttccaccagaacttgaggcaa

SEQ ID NO: 668514 - DNA, 25 bp, Homo sapien
ggcaaatcgtaaggaagctgtttct

SEQ ID NO: 668515 - DNA, 25 bp, Homo sapien
gtaggttgataattttattcccata

SEQ ID NO: 668516 - DNA, 25 bp, Homo sapien
attcccatatttgtaatcttatttc

SEQ ID NO: 668517 - DNA, 25 bp, Homo sapien
ttcactttctcaactcatcacattg

SEQ ID NO: 668518 - DNA, 25 bp, Homo sapien
aactcatcacattgactggtacttt

SEQ ID NO: 668519 - DNA, 25 bp, Homo sapien
gactggtacttttagaacaatgtta

SEQ ID NO: 668520 - DNA, 25 bp, Homo sapien
aaacatttacataattgtgctgata

SEQ ID NO: 668521 - DNA, 25 bp, Homo sapien
gtgctgatattgtacattatttgat

SEQ ID NO: 668522 - DNA, 25 bp, Homo sapien
gaagagtgtttctccaaaactataa

SEQ ID NO: 668523 - DNA, 25 bp, Homo sapien
gaattatacattcaggttatgccct

SEQ ID NO: 668524 - DNA, 25 bp, Homo sapien
aggttatgccctctatttctagttt

SEQ ID NO: 668525 - DNA, 25 bp, Homo sapien
atgccctctatttctagtttgatga

SEQ ID NO: 668526 - DNA, 25 bp, Homo sapien
tagcccgacccctgtatatattgta

SEQ ID NO: 668527 - DNA, 25 bp, Homo sapien
gtatatattgtacctctctctctgc

SEQ ID NO: 668528 - DNA, 25 bp, Homo sapien
tatattgtacctctctctctgccca

SEQ ID NO: 668529 - DNA, 25 bp, Homo sapien
tctctcttatcctgcctattcctct

SEQ ID NO: 668530 - DNA, 25 bp, Homo sapien
acacactcactcacaagcagtacag

SEQ ID NO: 668531 - DNA, 25 bp, Homo sapien
ctcactcacaagcagtacagtcact

SEQ ID NO: 668532 - DNA, 25 bp, Homo sapien
agtacagtcactaagttggctaggt

SEQ ID NO: 668533 - DNA, 25 bp, Homo sapien
cagtcactaagttggctaggtaata

SEQ ID NO: 668534 - DNA, 25 bp, Homo sapien
ctaggtaatatccaaagcattctga

SEQ ID NO: 668535 - DNA, 25 bp, Homo sapien
atccaaagcattctgattgtcctac

SEQ ID NO: 668536 - DNA, 25 bp, Homo sapien
agcattctgattgtcctactttttg

SEQ ID NO: 668537 - DNA, 25 bp, Homo sapien
tttataaggtcaaagagcagatgat

SEQ ID NO: 668538 - DNA, 25 bp, Homo sapien
atgattaacctggaagttcaaaaca

SEQ ID NO: 668539 - DNA, 25 bp, Homo sapien
gattaacctggaagttcaaaacatt

SEQ ID NO: 668540 - DNA, 25 bp, Homo sapien
ttaacctggaagttcaaaacattgt

SEQ ID NO: 668541 - DNA, 25 bp, Homo sapien
acctggaagttcaaaacattgtagc

SEQ ID NO: 668542 - DNA, 25 bp, Homo sapien
ctggaagttcaaaacattgtagcaa

SEQ ID NO: 668543 - DNA, 25 bp, Homo sapien
ggaagttcaaaacattgtagcaaga

SEQ ID NO: 668544 - DNA, 25 bp, Homo sapien
gttcaaaacattgtagcaagaatat

SEQ ID NO: 668545 - DNA, 25 bp, Homo sapien
tacaattttagattggagccaggtg

SEQ ID NO: 668546 - DNA, 25 bp, Homo sapien
caattttagattggagccaggtggt

SEQ ID NO: 668547 - DNA, 25 bp, Homo sapien
aattttagattggagccaggtggtg

SEQ ID NO: 668548 - DNA, 25 bp, Homo sapien
tgcgggacagccagcgtatgctaat

SEQ ID NO: 668549 - DNA, 25 bp, Homo sapien
gggacagccagcgtatgctaatgtt

SEQ ID NO: 668550 - DNA, 25 bp, Homo sapien
cagccagcgtatgctaatgttgcaa

SEQ ID NO: 668551 - DNA, 25 bp, Homo sapien
gcgtatgctaatgttgcaaacccat

SEQ ID NO: 668552 - DNA, 25 bp, Homo sapien
gctaatgttgcaaacccatgataat

SEQ ID NO: 668553 - DNA, 25 bp, Homo sapien
gttgcaaacccatgataatgtatgt

SEQ ID NO: 668554 - DNA, 25 bp, Homo sapien
taatgtatgtggaatatcctgccat

SEQ ID NO: 668555 - DNA, 25 bp, Homo sapien
gtatgtggaatatcctgccattggg

SEQ ID NO: 668556 - DNA, 25 bp, Homo sapien
tttacattaaaaccccagaatggct

SEQ ID NO: 668557 - DNA, 25 bp, Homo sapien
taaaaccccagaatggctgcagagg

SEQ ID NO: 668558 - DNA, 25 bp, Homo sapien
gggtgctgtgatacccctcttctac

SEQ ID NO: 668559 - DNA, 25 bp, Homo sapien
tccagggacctgagggttctttcac

SEQ ID NO: 668560 - DNA, 25 bp, Homo sapien
ctgagggttctttcacagggtgatt

SEQ ID NO: 668561 - DNA, 25 bp, Homo sapien
tctttcacagggtgattctgctggt

SEQ ID NO: 668562 - DNA, 25 bp, Homo sapien
ttctgctggtgggtacgtagtgcat

SEQ ID NO: 668563 - DNA, 25 bp, Homo sapien
gtacgtagtgcataccttatatagc

SEQ ID NO: 668564 - DNA, 25 bp, Homo sapien
ggaataacacatatctctgcacacc

SEQ ID NO: 668565 - DNA, 25 bp, Homo sapien
atcttcaccccatgtaccttattca

SEQ ID NO: 668566 - DNA, 25 bp, Homo sapien
atgtaccttattcataccctgggca

SEQ ID NO: 668567 - DNA, 25 bp, Homo sapien
accttattcataccctgggcagggc

SEQ ID NO: 668568 - DNA, 25 bp, Homo sapien
tgggcagggcttccaactcaatttc

SEQ ID NO: 668569 - DNA, 25 bp, Homo sapien
gggcttccaactcaatttctttttg

SEQ ID NO: 668570 - DNA, 25 bp, Homo sapien
gcagacttaagctgtgcatgaagtc

SEQ ID NO: 668571 - DNA, 25 bp, Homo sapien
gctgtgcatgaagtcacatgaggaa

SEQ ID NO: 668572 - DNA, 25 bp, Homo sapien
gtcagagctcttctggttctctgcc

SEQ ID NO: 668573 - DNA, 25 bp, Homo sapien
ttctggttctctgccttgggaaaga

SEQ ID NO: 668574 - DNA, 25 bp, Homo sapien
ttgggaaagagcctcagccagctct

SEQ ID NO: 668575 - DNA, 25 bp, Homo sapien
agccagctcttggactctagaggat

SEQ ID NO: 668576 - DNA, 25 bp, Homo sapien
gactctagaggatgcgaccagccca

SEQ ID NO: 668577 - DNA, 25 bp, Homo sapien
gaggatgcgaccagcccagactcag

SEQ ID NO: 668578 - DNA, 25 bp, Homo sapien
actcagggcctacagtggtctgcga

SEQ ID NO: 668579 - DNA, 25 bp, Homo sapien
ggcctacagtggtctgcgacattga

SEQ ID NO: 668580 - DNA, 25 bp, Homo sapien
acagtggtctgcgacattgaggaca

SEQ ID NO: 668581 - DNA, 25 bp, Homo sapien
tttgtaacagtgtagtcgatctgta

SEQ ID NO: 668582 - DNA, 25 bp, Homo sapien
gtaacagtgtagtcgatctgtattc

SEQ ID NO: 668583 - DNA, 25 bp, Homo sapien
aacagtgtagtcgatctgtattcaa

SEQ ID NO: 668584 - DNA, 25 bp, Homo sapien
agtgtagtcgatctgtattcaaatc

SEQ ID NO: 668585 - DNA, 25 bp, Homo sapien
gtgtagtcgatctgtattcaaatct

SEQ ID NO: 668586 - DNA, 25 bp, Homo sapien
ctgtattcaaatcttagtaagccat

SEQ ID NO: 668587 - DNA, 25 bp, Homo sapien
caaatcttagtaagccatttttaga

SEQ ID NO: 668588 - DNA, 25 bp, Homo sapien
gtatatctttaagttaacgagtgca

SEQ ID NO: 668589 - DNA, 25 bp, Homo sapien
atctttaagttaacgagtgcaattg

SEQ ID NO: 668590 - DNA, 25 bp, Homo sapien
agttaacgagtgcaattggagctca

SEQ ID NO: 668591 - DNA, 25 bp, Homo sapien
ttaacgagtgcaattggagctcagg

SEQ ID NO: 668592 - DNA, 25 bp, Homo sapien
agattagtactgtattcgctcacat

SEQ ID NO: 668593 - DNA, 25 bp, Homo sapien
gtattcgctcacataatattcgcat

SEQ ID NO: 668594 - DNA, 25 bp, Homo sapien
taatattcgcatgcattgttgttat

SEQ ID NO: 668595 - DNA, 25 bp, Homo sapien
attgttgttatttgcatagcccaga

SEQ ID NO: 668596 - DNA, 25 bp, Homo sapien
catagcccagaatgatgcatgagaa

SEQ ID NO: 668597 - DNA, 25 bp, Homo sapien
taaggtgtcaggtcctaggcattct

SEQ ID NO: 668598 - DNA, 25 bp, Homo sapien
gtgtcaggtcctaggcattctaact

SEQ ID NO: 668599 - DNA, 25 bp, Homo sapien
aggtcctaggcattctaactgcttc

SEQ ID NO: 668600 - DNA, 25 bp, Homo sapien
taggcattctaactgcttccaatct

SEQ ID NO: 668601 - DNA, 25 bp, Homo sapien
cattctaactgcttccaatcttggg

SEQ ID NO: 668602 - DNA, 25 bp, Homo sapien
ctaactgcttccaatcttgggaaaa

SEQ ID NO: 668603 - DNA, 25 bp, Homo sapien
ggaccctcaggacaggaaacttcag

SEQ ID NO: 668604 - DNA, 25 bp, Homo sapien
gaaacttcagacttagggcaggcta

SEQ ID NO: 668605 - DNA, 25 bp, Homo sapien
acttcagacttagggcaggctatgg

SEQ ID NO: 668606 - DNA, 25 bp, Homo sapien
agacttagggcaggctatgggcact

SEQ ID NO: 668607 - DNA, 25 bp, Homo sapien
gctatgggcactgcgagatgagacc

SEQ ID NO: 668608 - DNA, 25 bp, Homo sapien
gggcactgcgagatgagaccgcttt

SEQ ID NO: 668609 - DNA, 25 bp, Homo sapien
gcactgcgagatgagaccgctttgt

SEQ ID NO: 668610 - DNA, 25 bp, Homo sapien
agatgagaccgctttgtgtcaccta

SEQ ID NO: 668611 - DNA, 25 bp, Homo sapien
tgagaccgctttgtgtcacctacga

SEQ ID NO: 668612 - DNA, 25 bp, Homo sapien
accgctttgtgtcacctacgatata

SEQ ID NO: 668613 - DNA, 25 bp, Homo sapien
gctttgtgtcacctacgatatacga

SEQ ID NO: 668614 - DNA, 25 bp, Homo sapien
ttttttcagtcatggcggaaggtaa

SEQ ID NO: 668615 - DNA, 25 bp, Homo sapien
tttttcagtcatggcggaaggtaaa

SEQ ID NO: 668616 - DNA, 25 bp, Homo sapien
cggaaggtaaagaggtagcagccaa

SEQ ID NO: 668617 - DNA, 25 bp, Homo sapien
ggtaaagaggtagcagccaagtcat

SEQ ID NO: 668618 - DNA, 25 bp, Homo sapien
taaagaggtagcagccaagtcatat

SEQ ID NO: 668619 - DNA, 25 bp, Homo sapien
aaagaggtagcagccaagtcatatg

SEQ ID NO: 668620 - DNA, 25 bp, Homo sapien
agaggtagcagccaagtcatatggg

SEQ ID NO: 668621 - DNA, 25 bp, Homo sapien
agaggaggtggcaggctctaaacaa

SEQ ID NO: 668622 - DNA, 25 bp, Homo sapien
aaccagctctggcatgaactaacag

SEQ ID NO: 668623 - DNA, 25 bp, Homo sapien
atgtggagggcaccaagctattcat

SEQ ID NO: 668624 - DNA, 25 bp, Homo sapien
gctattcatgaggaatccgcctcca

SEQ ID NO: 668625 - DNA, 25 bp, Homo sapien
aaatgaagtgatgctcgcgttttta

SEQ ID NO: 668626 - DNA, 25 bp, Homo sapien
gatgctcgcgtttttaataagggaa

SEQ ID NO: 668627 - DNA, 25 bp, Homo sapien
ttcctaccagaaagctttgtctcaa

SEQ ID NO: 668628 - DNA, 25 bp, Homo sapien
tttgtctcaagcctgaccacaagag

SEQ ID NO: 668629 - DNA, 25 bp, Homo sapien
gacatgatggagtttcatggccatg

SEQ ID NO: 668630 - DNA, 25 bp, Homo sapien
catggccatgaatggtgcccttatt

SEQ ID NO: 668631 - DNA, 25 bp, Homo sapien
tggtgcccttattaacaacagtgtt

SEQ ID NO: 668632 - DNA, 25 bp, Homo sapien
cgtgaatgtcatatagtagtcttaa

SEQ ID NO: 668633 - DNA, 25 bp, Homo sapien
gtttctcttttaaagctgcatgagc

SEQ ID NO: 668634 - DNA, 25 bp, Homo sapien
gtgatactcatacttgctgtccaga

SEQ ID NO: 668635 - DNA, 25 bp, Homo sapien
cagagaacagtttgtgtgccattaa

SEQ ID NO: 668636 - DNA, 25 bp, Homo sapien
agagccatctgaaactataaacaaa

SEQ ID NO: 668637 - DNA, 25 bp, Homo sapien
taggtaattaaacagtatggcaggt

SEQ ID NO: 668638 - DNA, 25 bp, Homo sapien
cagtatggcaggtaatctaatttaa

SEQ ID NO: 668639 - DNA, 25 bp, Homo sapien
acccagctcaaactaagaaaacata

SEQ ID NO: 668640 - DNA, 25 bp, Homo sapien
taagaaaacatattcccaccctctg

SEQ ID NO: 668641 - DNA, 25 bp, Homo sapien
atattcccaccctctgcttgatttg

SEQ ID NO: 668642 - DNA, 25 bp, Homo sapien
accctctgcttgatttgctttcttt

SEQ ID NO: 668643 - DNA, 25 bp, Homo sapien
tgatttgctttctttcaagggcctt

SEQ ID NO: 668644 - DNA, 25 bp, Homo sapien
tcaagggcctttaaagcaaaacact

SEQ ID NO: 668645 - DNA, 25 bp, Homo sapien
aaagcaaaacactaaccatgaagag

SEQ ID NO: 668646 - DNA, 25 bp, Homo sapien
catgaagagttttacttttcccagg

SEQ ID NO: 668647 - DNA, 25 bp, Homo sapien
gagtcatggatgaccgaccaaggaa

SEQ ID NO: 668648 - DNA, 25 bp, Homo sapien
ggaggtgccaaagaccagtgatact

SEQ ID NO: 668649 - DNA, 25 bp, Homo sapien
ccagtgatactgctttgggttatgt

SEQ ID NO: 668650 - DNA, 25 bp, Homo sapien
ctttgggttatgtgcactgagggtt

SEQ ID NO: 668651 - DNA, 25 bp, Homo sapien
gggtttccaaccctgacggatatgg

SEQ ID NO: 668652 - DNA, 25 bp, Homo sapien
aaccctgacggatatggattctaat

SEQ ID NO: 668653 - DNA, 25 bp, Homo sapien
tagacgttcccatggcaacattttc

SEQ ID NO: 668654 - DNA, 25 bp, Homo sapien
caacattttctcagggccagctctt

SEQ ID NO: 668655 - DNA, 25 bp, Homo sapien
aaatttaatccctctgtgtgtcttc

SEQ ID NO: 668656 - DNA, 25 bp, Homo sapien
tctattttcagtggccatggagagc

SEQ ID NO: 668657 - DNA, 25 bp, Homo sapien
gagagcgtaacatctggtcagaggt

SEQ ID NO: 668658 - DNA, 25 bp, Homo sapien
ttgtagccagaattctggacaaccc

SEQ ID NO: 668659 - DNA, 25 bp, Homo sapien
gtagccagaattctggacaacccaa

SEQ ID NO: 668660 - DNA, 25 bp, Homo sapien
gccagaattctggacaacccaagtc

SEQ ID NO: 668661 - DNA, 25 bp, Homo sapien
ccagaattctggacaacccaagtct

SEQ ID NO: 668662 - DNA, 25 bp, Homo sapien
cagaattctggacaacccaagtctc

SEQ ID NO: 668663 - DNA, 25 bp, Homo sapien
agaattctggacaacccaagtctct

SEQ ID NO: 668664 - DNA, 25 bp, Homo sapien
ccctggcttgaaccttcaaagcttt

SEQ ID NO: 668665 - DNA, 25 bp, Homo sapien
cctggcttgaaccttcaaagctttt

SEQ ID NO: 668666 - DNA, 25 bp, Homo sapien
ctggcttgaaccttcaaagcttttg

SEQ ID NO: 668667 - DNA, 25 bp, Homo sapien
tggcttgaaccttcaaagcttttgt

SEQ ID NO: 668668 - DNA, 25 bp, Homo sapien
ggcttgaaccttcaaagcttttgta

SEQ ID NO: 668669 - DNA, 25 bp, Homo sapien
gctgtcatggcagccctaacagatg

SEQ ID NO: 668670 - DNA, 25 bp, Homo sapien
ggcagccctaacagatgaatccagt

SEQ ID NO: 668671 - DNA, 25 bp, Homo sapien
cagatgaatccagtggcatatgaaa

SEQ ID NO: 668672 - DNA, 25 bp, Homo sapien
gaaataactgctaagaaccatgtga

SEQ ID NO: 668673 - DNA, 25 bp, Homo sapien
ctaagaaccatgtgatagctggatg

SEQ ID NO: 668674 - DNA, 25 bp, Homo sapien
gggtttgtctgtgcacatatgcaca

SEQ ID NO: 668675 - DNA, 25 bp, Homo sapien
tgcacatacacacaagacatccaca

SEQ ID NO: 668676 - DNA, 25 bp, Homo sapien
atccacatgtgtgaaagagggtgtt

SEQ ID NO: 668677 - DNA, 25 bp, Homo sapien
gggtgttgcattccttaagagtagt

SEQ ID NO: 668678 - DNA, 25 bp, Homo sapien
gtattctgtgtaggatacttattta

SEQ ID NO: 668679 - DNA, 25 bp, Homo sapien
tatgagaaactctagcgcatgagaa

SEQ ID NO: 668680 - DNA, 25 bp, Homo sapien
gtaaaccttaccatatcatcttcct

SEQ ID NO: 668681 - DNA, 25 bp, Homo sapien
cttaccatatcatcttccttccatg

SEQ ID NO: 668682 - DNA, 25 bp, Homo sapien
cttccatgacacatcctgtaggatg

SEQ ID NO: 668683 - DNA, 25 bp, Homo sapien
atttaatcctttacatgactggctg

SEQ ID NO: 668684 - DNA, 25 bp, Homo sapien
atgactggctgtgctcagacctaga

SEQ ID NO: 668685 - DNA, 25 bp, Homo sapien
ggctgtgctcagacctagactgcct

SEQ ID NO: 668686 - DNA, 25 bp, Homo sapien
tagactgcctcacaagctcatccaa

SEQ ID NO: 668687 - DNA, 25 bp, Homo sapien
ttttttcagttcctcacacgtgctg

SEQ ID NO: 668688 - DNA, 25 bp, Homo sapien
tgtgctgttcccattgcctgaaata

SEQ ID NO: 668689 - DNA, 25 bp, Homo sapien
cattgcctgaaatactttccctcta

SEQ ID NO: 668690 - DNA, 25 bp, Homo sapien
tagctaattcttacttaactttcaa

SEQ ID NO: 668691 - DNA, 25 bp, Homo sapien
gtatgtactgtaacaatccattgtt

SEQ ID NO: 668692 - DNA, 25 bp, Homo sapien
tgttttcctcggtacctcgtaatct

SEQ ID NO: 668693 - DNA, 25 bp, Homo sapien
gtacctcgtaatctcttgtgcattt

SEQ ID NO: 668694 - DNA, 25 bp, Homo sapien
tcgtaatctcttgtgcattttctaa

SEQ ID NO: 668695 - DNA, 25 bp, Homo sapien
aagccttagaagaatcatgactgag

SEQ ID NO: 668696 - DNA, 25 bp, Homo sapien
atcatgactgagttgaccccgagtg

SEQ ID NO: 668697 - DNA, 25 bp, Homo sapien
accccgagtgcctctgtgtaaagga

SEQ ID NO: 668698 - DNA, 25 bp, Homo sapien
gtgtaaaggaggtgggcccatcatc

SEQ ID NO: 668699 - DNA, 25 bp, Homo sapien
cagtaggccagggtaaaggctctta

SEQ ID NO: 668700 - DNA, 25 bp, Homo sapien
gagaagccacagactttcttcctca

SEQ ID NO: 668701 - DNA, 25 bp, Homo sapien
tcttcctcagtaacattccaataat

SEQ ID NO: 668702 - DNA, 25 bp, Homo sapien
gaggggggtggatcacctagggtca

SEQ ID NO: 668703 - DNA, 25 bp, Homo sapien
aggggggtggatcacctagggtcag

SEQ ID NO: 668704 - DNA, 25 bp, Homo sapien
ggggggtggatcacctagggtcagg

SEQ ID NO: 668705 - DNA, 25 bp, Homo sapien
gcctggtcaacatagtgaagcccca

SEQ ID NO: 668706 - DNA, 25 bp, Homo sapien
cctggtcaacatagtgaagccccat

SEQ ID NO: 668707 - DNA, 25 bp, Homo sapien
ctggtcaacatagtgaagccccatc

SEQ ID NO: 668708 - DNA, 25 bp, Homo sapien
tggtcaacatagtgaagccccatct

SEQ ID NO: 668709 - DNA, 25 bp, Homo sapien
ggtcaacatagtgaagccccatctc

SEQ ID NO: 668710 - DNA, 25 bp, Homo sapien
gtcaacatagtgaagccccatctct

SEQ ID NO: 668711 - DNA, 25 bp, Homo sapien
tcaacatagtgaagccccatctcta

SEQ ID NO: 668712 - DNA, 25 bp, Homo sapien
gaatttggatattccttccctggtc

SEQ ID NO: 668713 - DNA, 25 bp, Homo sapien
ctcctatcttcggtcaaatgctgtt

SEQ ID NO: 668714 - DNA, 25 bp, Homo sapien
aatgctgtttttactgcttcctaag

SEQ ID NO: 668715 - DNA, 25 bp, Homo sapien
caagaaatttaacagctcggccagc

SEQ ID NO: 668716 - DNA, 25 bp, Homo sapien
gctcggccagctcagtgaaacactg

SEQ ID NO: 668717 - DNA, 25 bp, Homo sapien
tgtgctgtctcattgaaaaccgagc

SEQ ID NO: 668718 - DNA, 25 bp, Homo sapien
gaaaaccgagccagtcaaccacaag

SEQ ID NO: 668719 - DNA, 25 bp, Homo sapien
acaaggctggcagggtgtgatcctt

SEQ ID NO: 668720 - DNA, 25 bp, Homo sapien
tgtgatccttgtaacgtcttgtgtc

SEQ ID NO: 668721 - DNA, 25 bp, Homo sapien
taacgtcttgtgtctgttacctcac

SEQ ID NO: 668722 - DNA, 25 bp, Homo sapien
gtctgttacctcacggatgtcggta

SEQ ID NO: 668723 - DNA, 25 bp, Homo sapien
gtggagtgtcatggcaacacgcttt

SEQ ID NO: 668724 - DNA, 25 bp, Homo sapien
acacgcttttgccacagttcctggg

SEQ ID NO: 668725 - DNA, 25 bp, Homo sapien
gcatgtaccgcctgaccgtggatgg

SEQ ID NO: 668726 - DNA, 25 bp, Homo sapien
ggtggttaccaggaacgtgttcagc

SEQ ID NO: 668727 - DNA, 25 bp, Homo sapien
aacgtgttcagccatcggctcactg

SEQ ID NO: 668728 - DNA, 25 bp, Homo sapien
accagaattcagtgacgcgcagcgc

SEQ ID NO: 668729 - DNA, 25 bp, Homo sapien
atcaacagtgacagccagggtcggt

SEQ ID NO: 668730 - DNA, 25 bp, Homo sapien
ggtcggtgtggcacgcgtttcctca

SEQ ID NO: 668731 - DNA, 25 bp, Homo sapien
tacgaccggcgctttgtcatcaaga

SEQ ID NO: 668732 - DNA, 25 bp, Homo sapien
gtcatcaagactgtgtccagcgagg

SEQ ID NO: 668733 - DNA, 25 bp, Homo sapien
aggacgtggcggagatgcacaacat

SEQ ID NO: 668734 - DNA, 25 bp, Homo sapien
gagaggcaagagatcaatgaccaca

SEQ ID NO: 668735 - DNA, 25 bp, Homo sapien
agagggaaagaacagcctccattcc

SEQ ID NO: 668736 - DNA, 25 bp, Homo sapien
gaaagaacagcctccattcccaaca

SEQ ID NO: 668737 - DNA, 25 bp, Homo sapien
gaggcccagctatctgttatttcac

SEQ ID NO: 668738 - DNA, 25 bp, Homo sapien
cagctatctgttatttcacaaccta

SEQ ID NO: 668739 - DNA, 25 bp, Homo sapien
gtacaggatttacgatgagaccatc

SEQ ID NO: 668740 - DNA, 25 bp, Homo sapien
atgagaccatctccacttgagctgg

SEQ ID NO: 668741 - DNA, 25 bp, Homo sapien
accatctccacttgagctggcctga

SEQ ID NO: 668742 - DNA, 25 bp, Homo sapien
gctggcctgaataggtactggtcct

SEQ ID NO: 668743 - DNA, 25 bp, Homo sapien
ggtactggtcctcataaccaaaagt

SEQ ID NO: 668744 - DNA, 25 bp, Homo sapien
aaaccagagtccctagaatctagga

SEQ ID NO: 668745 - DNA, 25 bp, Homo sapien
atgtgctgtatccatttattagtat

SEQ ID NO: 668746 - DNA, 25 bp, Homo sapien
gtatgaacagttaatgacacactat

SEQ ID NO: 668747 - DNA, 25 bp, Homo sapien
atgacacactattgaatgcttctac

SEQ ID NO: 668748 - DNA, 25 bp, Homo sapien
gaatgcttctacttaattgtttcat

SEQ ID NO: 668749 - DNA, 25 bp, Homo sapien
ttaacacaaaggaggtagaggatct

SEQ ID NO: 668750 - DNA, 25 bp, Homo sapien
aaaattattatgtttcaagctgggc

SEQ ID NO: 668751 - DNA, 25 bp, Homo sapien
gcacttaattcaaatcttatcctaa

SEQ ID NO: 668752 - DNA, 25 bp, Homo sapien
tcttatcctaagtcacgcatcatta

SEQ ID NO: 668753 - DNA, 25 bp, Homo sapien
cacgcatcattagacaaaaagcctg

SEQ ID NO: 668754 - DNA, 25 bp, Homo sapien
aagcctgaggaactgaaagaaccat

SEQ ID NO: 668755 - DNA, 25 bp, Homo sapien
agattaatgggatttgatactttta

SEQ ID NO: 668756 - DNA, 25 bp, Homo sapien
caaacaagagtttctgtatgtcata

SEQ ID NO: 668757 - DNA, 25 bp, Homo sapien
ttattctttttcatggctttgtaat

SEQ ID NO: 668758 - DNA, 25 bp, Homo sapien
attctttttcatggctttgtaatta

SEQ ID NO: 668759 - DNA, 25 bp, Homo sapien
tttttcatggctttgtaattactgt

SEQ ID NO: 668760 - DNA, 25 bp, Homo sapien
aaatttttttcatggctgtgaatta

SEQ ID NO: 668761 - DNA, 25 bp, Homo sapien
tttagttattgttttgtagctgtaa

SEQ ID NO: 668762 - DNA, 25 bp, Homo sapien
tttgtagctgtaatataggcccttt

SEQ ID NO: 668763 - DNA, 25 bp, Homo sapien
gtagctgtaatataggcccttttat

SEQ ID NO: 668764 - DNA, 25 bp, Homo sapien
agctgtaatataggcccttttatat

SEQ ID NO: 668765 - DNA, 25 bp, Homo sapien
taatataggcccttttatataatag

SEQ ID NO: 668766 - DNA, 25 bp, Homo sapien
gattaaagcttactggtaatcaagg

SEQ ID NO: 668767 - DNA, 25 bp, Homo sapien
ctgtgactgcgggccagggttcaaa

SEQ ID NO: 668768 - DNA, 25 bp, Homo sapien
aaaggcagacgctgcgagctcgcct

SEQ ID NO: 668769 - DNA, 25 bp, Homo sapien
ctgcgagctcgcctgtataaaggtg

SEQ ID NO: 668770 - DNA, 25 bp, Homo sapien
tgtataaaggtgtcccgcccctgca

SEQ ID NO: 668771 - DNA, 25 bp, Homo sapien
tgcacaaggctgttctccgagacaa

SEQ ID NO: 668772 - DNA, 25 bp, Homo sapien
agggaggcgtctgtcaccacgtgta

SEQ ID NO: 668773 - DNA, 25 bp, Homo sapien
ggcgtctgtcaccacgtgtataaaa

SEQ ID NO: 668774 - DNA, 25 bp, Homo sapien
tgtcaccacgtgtataaaagagtct

SEQ ID NO: 668775 - DNA, 25 bp, Homo sapien
aaagagtctaccgagttcaccaaga

SEQ ID NO: 668776 - DNA, 25 bp, Homo sapien
acatctgcttcaaagagagctgtga

SEQ ID NO: 668777 - DNA, 25 bp, Homo sapien
agagctgtgaaagcacaagcctcaa

SEQ ID NO: 668778 - DNA, 25 bp, Homo sapien
ctaaatgttttaggcatatgaaaat

SEQ ID NO: 668779 - DNA, 25 bp, Homo sapien
aatattatagtacaacacctgtaat

SEQ ID NO: 668780 - DNA, 25 bp, Homo sapien
attatagtacaacacctgtaatttt

SEQ ID NO: 668781 - DNA, 25 bp, Homo sapien
tatagtacaacacctgtaattttta

SEQ ID NO: 668782 - DNA, 25 bp, Homo sapien
tagtacaacacctgtaatttttaag

SEQ ID NO: 668783 - DNA, 25 bp, Homo sapien
ccttataaattcacattgcaaaagt

SEQ ID NO: 668784 - DNA, 25 bp, Homo sapien
taatatggaattaacacttgtcaga

SEQ ID NO: 668785 - DNA, 25 bp, Homo sapien
atatggaattaacacttgtcagata

SEQ ID NO: 668786 - DNA, 25 bp, Homo sapien
atggaattaacacttgtcagataat

SEQ ID NO: 668787 - DNA, 25 bp, Homo sapien
ggaattaacacttgtcagataataa

SEQ ID NO: 668788 - DNA, 25 bp, Homo sapien
ttaacacttgtcagataataaaaca

SEQ ID NO: 668789 - DNA, 25 bp, Homo sapien
gcaacggcatcttatgaagctgtag

SEQ ID NO: 668790 - DNA, 25 bp, Homo sapien
cggcatcttatgaagctgtagcaga

SEQ ID NO: 668791 - DNA, 25 bp, Homo sapien
gaagctgtagcagatactgtcctgg

SEQ ID NO: 668792 - DNA, 25 bp, Homo sapien
agatactgtcctggcctcgctcatg

SEQ ID NO: 668793 - DNA, 25 bp, Homo sapien
tggcctcgctcatgtgtgtcagatg

SEQ ID NO: 668794 - DNA, 25 bp, Homo sapien
gcctcgctcatgtgtgtcagatgtg

SEQ ID NO: 668795 - DNA, 25 bp, Homo sapien
ctcgctcatgtgtgtcagatgtgtt

SEQ ID NO: 668796 - DNA, 25 bp, Homo sapien
tgtgtcagatgtgttggagtgccct

SEQ ID NO: 668797 - DNA, 25 bp, Homo sapien
tcagatgtgttggagtgccctggct

SEQ ID NO: 668798 - DNA, 25 bp, Homo sapien
ctgctctgcatgtgtagctgaggtc

SEQ ID NO: 668799 - DNA, 25 bp, Homo sapien
ctctgcatgtgtagctgaggtcctg

SEQ ID NO: 668800 - DNA, 25 bp, Homo sapien
tgcatccactggctccttgatcttg

SEQ ID NO: 668801 - DNA, 25 bp, Homo sapien
actatgagcaaatacatctctgttg

SEQ ID NO: 668802 - DNA, 25 bp, Homo sapien
tgtaagtgacccagtttacggtact

SEQ ID NO: 668803 - DNA, 25 bp, Homo sapien
cagcctgcacagactaagacaaaaa

SEQ ID NO: 668804 - DNA, 25 bp, Homo sapien
aaggattcatctttcaaggctgagt

SEQ ID NO: 668805 - DNA, 25 bp, Homo sapien
ttcaaggctgagttgagacctcaat

SEQ ID NO: 668806 - DNA, 25 bp, Homo sapien
ttgagacctcaatttcaacccacca

SEQ ID NO: 668807 - DNA, 25 bp, Homo sapien
accctcaccttatgctactgagttt

SEQ ID NO: 668808 - DNA, 25 bp, Homo sapien
atgctactgagttttgacaagctac

SEQ ID NO: 668809 - DNA, 25 bp, Homo sapien
ccaagggagggcgtgcaaatagaaa

SEQ ID NO: 668810 - DNA, 25 bp, Homo sapien
cagccacttgttaagagatcaagaa

SEQ ID NO: 668811 - DNA, 25 bp, Homo sapien
gggttttggaatagccactctcata

SEQ ID NO: 668812 - DNA, 25 bp, Homo sapien
tagccactctcatagaaggcacttc

SEQ ID NO: 668813 - DNA, 25 bp, Homo sapien
aaggcacttccttgacgttccatat

SEQ ID NO: 668814 - DNA, 25 bp, Homo sapien
gacgttccatataatttttgccttg

SEQ ID NO: 668815 - DNA, 25 bp, Homo sapien
aatttttgccttgctcaatgctttc

SEQ ID NO: 668816 - DNA, 25 bp, Homo sapien
caatgctttccagggttttttcatc

SEQ ID NO: 668817 - DNA, 25 bp, Homo sapien
ggttttttcatcctgctgtttggaa

SEQ ID NO: 668818 - DNA, 25 bp, Homo sapien
ctgctgtttggaaccattatggatc

SEQ ID NO: 668819 - DNA, 25 bp, Homo sapien
atcgagggcagctgagaatgcatca

SEQ ID NO: 668820 - DNA, 25 bp, Homo sapien
tgagaatgcatcactaggcccaacc

SEQ ID NO: 668821 - DNA, 25 bp, Homo sapien
tcactaggcccaaccaatggatcta

SEQ ID NO: 668822 - DNA, 25 bp, Homo sapien
caaagaatcttcagtgccagccaga

SEQ ID NO: 668823 - DNA, 25 bp, Homo sapien
gaaagaatgatgaactcctcgtgtc

SEQ ID NO: 668824 - DNA, 25 bp, Homo sapien
atgatgaactcctcgtgtcaaggga

SEQ ID NO: 668825 - DNA, 25 bp, Homo sapien
gaactcctcgtgtcaagggagtttg

SEQ ID NO: 668826 - DNA, 25 bp, Homo sapien
gggcaaccagtcaaaccatggcctc

SEQ ID NO: 668827 - DNA, 25 bp, Homo sapien
aaccagtcaaaccatggcctcatgg

SEQ ID NO: 668828 - DNA, 25 bp, Homo sapien
tggcctcatgggaagcagctgacta

SEQ ID NO: 668829 - DNA, 25 bp, Homo sapien
aagcagctgactaggcaatgagaga

SEQ ID NO: 668830 - DNA, 25 bp, Homo sapien
aatatgcctgaaacagggaaccaga

SEQ ID NO: 668831 - DNA, 25 bp, Homo sapien
gactcagacaaaactgctgacaagt

SEQ ID NO: 668832 - DNA, 25 bp, Homo sapien
agacaaaactgctgacaagtatggg

SEQ ID NO: 668833 - DNA, 25 bp, Homo sapien
gtttatcacgttttgcacaaagcag

SEQ ID NO: 668834 - DNA, 25 bp, Homo sapien
ttatcacgttttgcacaaagcagag

SEQ ID NO: 668835 - DNA, 25 bp, Homo sapien
atcacgttttgcacaaagcagagcc

SEQ ID NO: 668836 - DNA, 25 bp, Homo sapien
acgttttgcacaaagcagagccact

SEQ ID NO: 668837 - DNA, 25 bp, Homo sapien
gacattatactctaaaagatggtgt

SEQ ID NO: 668838 - DNA, 25 bp, Homo sapien
ggtgtatttgtgcattagatttgcc

SEQ ID NO: 668839 - DNA, 25 bp, Homo sapien
tatttgtgcattagatttgcctgaa

SEQ ID NO: 668840 - DNA, 25 bp, Homo sapien
ttatccatttccattctttatacaa

SEQ ID NO: 668841 - DNA, 25 bp, Homo sapien
ttccattctttatacaaataccatg

SEQ ID NO: 668842 - DNA, 25 bp, Homo sapien
tatacaaataccatgtaatgtgtac

SEQ ID NO: 668843 - DNA, 25 bp, Homo sapien
aatgtgtacatatttaactaaagag

SEQ ID NO: 668844 - DNA, 25 bp, Homo sapien
gtttctactggccattgttgaaaat

SEQ ID NO: 668845 - DNA, 25 bp, Homo sapien
ttgctgcatcgtcctgtggtagaag

SEQ ID NO: 668846 - DNA, 25 bp, Homo sapien
aggagtcaagagagtgccccagagt

SEQ ID NO: 668847 - DNA, 25 bp, Homo sapien
gaagtactctgggactgaccttttc

SEQ ID NO: 668848 - DNA, 25 bp, Homo sapien
tgggactgaccttttcggaaatgga

SEQ ID NO: 668849 - DNA, 25 bp, Homo sapien
atggaatcttcattggtcaggtgat

SEQ ID NO: 668850 - DNA, 25 bp, Homo sapien
cattggtcaggtgattcaacatttt

SEQ ID NO: 668851 - DNA, 25 bp, Homo sapien
tatacaatttatccatcctcatctc

SEQ ID NO: 668852 - DNA, 25 bp, Homo sapien
ccatcctcatctcttcaggatttgc

SEQ ID NO: 668853 - DNA, 25 bp, Homo sapien
caggatttgcataccttgccagttt

SEQ ID NO: 668854 - DNA, 25 bp, Homo sapien
tgcataccttgccagtttctactgg

SEQ ID NO: 668855 - DNA, 25 bp, Homo sapien
aaacataacagaggagttgcgaatt

SEQ ID NO: 668856 - DNA, 25 bp, Homo sapien
aacagaggagttgcgaattttatga

SEQ ID NO: 668857 - DNA, 25 bp, Homo sapien
agaggagttgcgaattttatgaaat

SEQ ID NO: 668858 - DNA, 25 bp, Homo sapien
tatgaaatttctgagtcttacaaac

SEQ ID NO: 668859 - DNA, 25 bp, Homo sapien
gagtcttacaaacttctctttaaga

SEQ ID NO: 668860 - DNA, 25 bp, Homo sapien
acaaacttctctttaagactatgag

SEQ ID NO: 668861 - DNA, 25 bp, Homo sapien
aaacttctctttaagactatgagga

SEQ ID NO: 668862 - DNA, 25 bp, Homo sapien
cttctctttaagactatgaggaaat

SEQ ID NO: 668863 - DNA, 25 bp, Homo sapien
ggaaatgctgacttgtattatttat

SEQ ID NO: 668864 - DNA, 25 bp, Homo sapien
aaatgctgacttgtattatttatat

SEQ ID NO: 668865 - DNA, 25 bp, Homo sapien
atcattaaatttgcttgtgtatggt

SEQ ID NO: 668866 - DNA, 25 bp, Homo sapien
tccagggcctcacttacaatagcag

SEQ ID NO: 668867 - DNA, 25 bp, Homo sapien
gggcctcacttacaatagcagtgac

SEQ ID NO: 668868 - DNA, 25 bp, Homo sapien
gaagccagaggcagccccacttctt

SEQ ID NO: 668869 - DNA, 25 bp, Homo sapien
agaggcagccccacttcttggtgat

SEQ ID NO: 668870 - DNA, 25 bp, Homo sapien
ggcagccccacttcttggtgattat

SEQ ID NO: 668871 - DNA, 25 bp, Homo sapien
agccccacttcttggtgattatcag

SEQ ID NO: 668872 - DNA, 25 bp, Homo sapien
cacttcttggtgattatcaggaccc

SEQ ID NO: 668873 - DNA, 25 bp, Homo sapien
tcttcaccaccctaaactgttgaat

SEQ ID NO: 668874 - DNA, 25 bp, Homo sapien
tcaccaccctaaactgttgaataac

SEQ ID NO: 668875 - DNA, 25 bp, Homo sapien
ctgttgaataacacttggctttcta

SEQ ID NO: 668876 - DNA, 25 bp, Homo sapien
aacacttggctttctaagagctcag

SEQ ID NO: 668877 - DNA, 25 bp, Homo sapien
gtttgccttctgctactcagctgca

SEQ ID NO: 668878 - DNA, 25 bp, Homo sapien
tgcacgctgagcaccaagagcttgt

SEQ ID NO: 668879 - DNA, 25 bp, Homo sapien
gcttgtgatcaaaattctgttggac

SEQ ID NO: 668880 - DNA, 25 bp, Homo sapien
tctgttggacttgacaatgttttct

SEQ ID NO: 668881 - DNA, 25 bp, Homo sapien
atgttttctatgatctgaacctgtc

SEQ ID NO: 668882 - DNA, 25 bp, Homo sapien
tctgaacctgtcatttgaagtacag

SEQ ID NO: 668883 - DNA, 25 bp, Homo sapien
aagactgtgtccactttgggcatga

SEQ ID NO: 668884 - DNA, 25 bp, Homo sapien
agtgtggagacttttcttccccatt

SEQ ID NO: 668885 - DNA, 25 bp, Homo sapien
cctttttcctttccatgttacatga

SEQ ID NO: 668886 - DNA, 25 bp, Homo sapien
agacatcaatcaggttctcttctct

SEQ ID NO: 668887 - DNA, 25 bp, Homo sapien
actggcctgacttaagataaccatt

SEQ ID NO: 668888 - DNA, 25 bp, Homo sapien
cactgacccaaaatggaaccgtaca

SEQ ID NO: 668889 - DNA, 25 bp, Homo sapien
tgacccaaaatggaaccgtacaaag

SEQ ID NO: 668890 - DNA, 25 bp, Homo sapien
caaaatggaaccgtacaaagcctat

SEQ ID NO: 668891 - DNA, 25 bp, Homo sapien
aatggaaccgtacaaagcctatccg

SEQ ID NO: 668892 - DNA, 25 bp, Homo sapien
atggaaccgtacaaagcctatccgt

SEQ ID NO: 668893 - DNA, 25 bp, Homo sapien
tggaaccgtacaaagcctatccgtg

SEQ ID NO: 668894 - DNA, 25 bp, Homo sapien
ggaaccgtacaaagcctatccgtgt

SEQ ID NO: 668895 - DNA, 25 bp, Homo sapien
gaaccgtacaaagcctatccgtgta

SEQ ID NO: 668896 - DNA, 25 bp, Homo sapien
accgtacaaagcctatccgtgtata

SEQ ID NO: 668897 - DNA, 25 bp, Homo sapien
ccgtacaaagcctatccgtgtatat

SEQ ID NO: 668898 - DNA, 25 bp, Homo sapien
gtacaaagcctatccgtgtatatgg

SEQ ID NO: 668899 - DNA, 25 bp, Homo sapien
ttttttcagtcatggcggaaggtaa

SEQ ID NO: 668900 - DNA, 25 bp, Homo sapien
tttttcagtcatggcggaaggtaaa

SEQ ID NO: 668901 - DNA, 25 bp, Homo sapien
cggaaggtaaagaggtagcagccaa

SEQ ID NO: 668902 - DNA, 25 bp, Homo sapien
gaaggtaaagaggtagcagccaagt

SEQ ID NO: 668903 - DNA, 25 bp, Homo sapien
aaggtaaagaggtagcagccaagtc

SEQ ID NO: 668904 - DNA, 25 bp, Homo sapien
aggtaaagaggtagcagccaagtca

SEQ ID NO: 668905 - DNA, 25 bp, Homo sapien
ggtaaagaggtagcagccaagtcat

SEQ ID NO: 668906 - DNA, 25 bp, Homo sapien
gtaaagaggtagcagccaagtcata

SEQ ID NO: 668907 - DNA, 25 bp, Homo sapien
taaagaggtagcagccaagtcatat

SEQ ID NO: 668908 - DNA, 25 bp, Homo sapien
aaagaggtagcagccaagtcatatg

SEQ ID NO: 668909 - DNA, 25 bp, Homo sapien
agaggtagcagccaagtcatatggg

SEQ ID NO: 668910 - DNA, 25 bp, Homo sapien
ttatcacccagatgtgaaagaagct

SEQ ID NO: 668911 - DNA, 25 bp, Homo sapien
gctgcctgtttactgatccattgaa

SEQ ID NO: 668912 - DNA, 25 bp, Homo sapien
actgatccattgaataaacccattt

SEQ ID NO: 668913 - DNA, 25 bp, Homo sapien
aaaagtcaataccaattcagcaaaa

SEQ ID NO: 668914 - DNA, 25 bp, Homo sapien
attctgaaatagactttacgtgttt

SEQ ID NO: 668915 - DNA, 25 bp, Homo sapien
tgcttgacggcaattatatacccaa

SEQ ID NO: 668916 - DNA, 25 bp, Homo sapien
gacggcaattatatacccaaagtga

SEQ ID NO: 668917 - DNA, 25 bp, Homo sapien
aagtgatttgcctgggtcctttaat

SEQ ID NO: 668918 - DNA, 25 bp, Homo sapien
ggtcctttaattcccattagctttg

SEQ ID NO: 668919 - DNA, 25 bp, Homo sapien
agatgagcatagctgacccagttcc

SEQ ID NO: 668920 - DNA, 25 bp, Homo sapien
tagctgacccagttcccacattctt

SEQ ID NO: 668921 - DNA, 25 bp, Homo sapien
agagattgagtcaattaatcatgcc

SEQ ID NO: 668922 - DNA, 25 bp, Homo sapien
cctgtcatgaaaccccgagagaaac

SEQ ID NO: 668923 - DNA, 25 bp, Homo sapien
aaaccccgagagaaactctggtcag

SEQ ID NO: 668924 - DNA, 25 bp, Homo sapien
cgagagaaactctggtcagtgatgc

SEQ ID NO: 668925 - DNA, 25 bp, Homo sapien
tgtgttctaggagggtgacatgtcc

SEQ ID NO: 668926 - DNA, 25 bp, Homo sapien
tctaggagggtgacatgtccctgag

SEQ ID NO: 668927 - DNA, 25 bp, Homo sapien
gggcacagaaactttgtgtttggga

SEQ ID NO: 668928 - DNA, 25 bp, Homo sapien
cctcttacaccttgctctatgtatg

SEQ ID NO: 668929 - DNA, 25 bp, Homo sapien
acaccttgctctatgtatgtcttct

SEQ ID NO: 668930 - DNA, 25 bp, Homo sapien
tatgtcttcttttggctgttctgat

SEQ ID NO: 668931 - DNA, 25 bp, Homo sapien
gtcttcttttggctgttctgatttg

SEQ ID NO: 668932 - DNA, 25 bp, Homo sapien
atgaccaaagaccaacacttcccta

SEQ ID NO: 668933 - DNA, 25 bp, Homo sapien
aacacttccctatgttggagaccca

SEQ ID NO: 668934 - DNA, 25 bp, Homo sapien
gttggagacccaatcagttcactca

SEQ ID NO: 668935 - DNA, 25 bp, Homo sapien
ccaatcagttcactcattcctggtc

SEQ ID NO: 668936 - DNA, 25 bp, Homo sapien
agtttcctccactgagaccacgctt

SEQ ID NO: 668937 - DNA, 25 bp, Homo sapien
tgagaccacgctttgatccagttgg

SEQ ID NO: 668938 - DNA, 25 bp, Homo sapien
tttgatccagttggcccacttccag

SEQ ID NO: 668939 - DNA, 25 bp, Homo sapien
ctaaccccatcttgccagggcgagg

SEQ ID NO: 668940 - DNA, 25 bp, Homo sapien
ccccaatgacagatttccctttaga

SEQ ID NO: 668941 - DNA, 25 bp, Homo sapien
agatttccctttagacccagcaggg

SEQ ID NO: 668942 - DNA, 25 bp, Homo sapien
tgatggccggctgtcattcatgtga

SEQ ID NO: 668943 - DNA, 25 bp, Homo sapien
gttagtaataactattgactcttgt

SEQ ID NO: 668944 - DNA, 25 bp, Homo sapien
gtaataactattgactcttgttttg

SEQ ID NO: 668945 - DNA, 25 bp, Homo sapien
ataactattgactcttgttttgttt

SEQ ID NO: 668946 - DNA, 25 bp, Homo sapien
ctattgactcttgttttgtttatta

SEQ ID NO: 668947 - DNA, 25 bp, Homo sapien
ttaaggaaactagcattgttaatat

SEQ ID NO: 668948 - DNA, 25 bp, Homo sapien
ggaaactagcattgttaatatatac

SEQ ID NO: 668949 - DNA, 25 bp, Homo sapien
ctagcattgttaatatatactgatt

SEQ ID NO: 668950 - DNA, 25 bp, Homo sapien
ttcacagttgtttaattatatattt

SEQ ID NO: 668951 - DNA, 25 bp, Homo sapien
agattgctttaaatgctccttataa

SEQ ID NO: 668952 - DNA, 25 bp, Homo sapien
gctccttataaattcacattgcaaa

SEQ ID NO: 668953 - DNA, 25 bp, Homo sapien
taatatggaattaacacttgtcaga

SEQ ID NO: 668954 - DNA, 25 bp, Homo sapien
gtgctgcttgaagggattacaccaa

SEQ ID NO: 668955 - DNA, 25 bp, Homo sapien
acaccaaatatacaactggaggatt

SEQ ID NO: 668956 - DNA, 25 bp, Homo sapien
tggaggattttcctacatctcctac

SEQ ID NO: 668957 - DNA, 25 bp, Homo sapien
acatctcctacaagtacagccaaac

SEQ ID NO: 668958 - DNA, 25 bp, Homo sapien
caaacaagagtttctgtatgtcata

SEQ ID NO: 668959 - DNA, 25 bp, Homo sapien
ttattctttttcatggctttgtaat

SEQ ID NO: 668960 - DNA, 25 bp, Homo sapien
tttttcatggctttgtaattactgt

SEQ ID NO: 668961 - DNA, 25 bp, Homo sapien
tttagttattgttttgtagctgtaa

SEQ ID NO: 668962 - DNA, 25 bp, Homo sapien
tttgtagctgtaatataggcccttt

SEQ ID NO: 668963 - DNA, 25 bp, Homo sapien
gtagctgtaatataggcccttttat

SEQ ID NO: 668964 - DNA, 25 bp, Homo sapien
gattaaagcttactggtaatcaagg

SEQ ID NO: 668965 - DNA, 25 bp, Homo sapien
tttacaactgtcagatattggcaca

SEQ ID NO: 668966 - DNA, 25 bp, Homo sapien
gatattggcacatatcagtgcaaag

SEQ ID NO: 668967 - DNA, 25 bp, Homo sapien
attggcacatatcagtgcaaagtga

SEQ ID NO: 668968 - DNA, 25 bp, Homo sapien
gcaaagtgaaaaaagctcctggtgt

SEQ ID NO: 668969 - DNA, 25 bp, Homo sapien
gtgaaaaaagctcctggtgttgcaa

SEQ ID NO: 668970 - DNA, 25 bp, Homo sapien
gaaaaaagctcctggtgttgcaaat

SEQ ID NO: 668971 - DNA, 25 bp, Homo sapien
aaaaagctcctggtgttgcaaataa

SEQ ID NO: 668972 - DNA, 25 bp, Homo sapien
aaagctcctggtgttgcaaataaga

SEQ ID NO: 668973 - DNA, 25 bp, Homo sapien
agctcctggtgttgcaaataagaag

SEQ ID NO: 668974 - DNA, 25 bp, Homo sapien
ctcctggtgttgcaaataagaagat

SEQ ID NO: 668975 - DNA, 25 bp, Homo sapien
aagaagattcatctggtagttcttg

SEQ ID NO: 668976 - DNA, 25 bp, Homo sapien
gctgttgctcagaacttgctagagg

SEQ ID NO: 668977 - DNA, 25 bp, Homo sapien
gctcagaacttgctagaggtcttta

SEQ ID NO: 668978 - DNA, 25 bp, Homo sapien
ggtctttagggaacctccgtgagag

SEQ ID NO: 668979 - DNA, 25 bp, Homo sapien
ggaacctccgtgagagctgcagcac

SEQ ID NO: 668980 - DNA, 25 bp, Homo sapien
tttttaattttctcggtgtcatcct

SEQ ID NO: 668981 - DNA, 25 bp, Homo sapien
ctcggtgtcatcctctgagtatgga

SEQ ID NO: 668982 - DNA, 25 bp, Homo sapien
aatgtggctcataaaccacctttta

SEQ ID NO: 668983 - DNA, 25 bp, Homo sapien
gagttctaaataagtctccaacaat

SEQ ID NO: 668984 - DNA, 25 bp, Homo sapien
taagtctccaacaatagtagttttg

SEQ ID NO: 668985 - DNA, 25 bp, Homo sapien
ggagctaaggatgtaactactttga

SEQ ID NO: 668986 - DNA, 25 bp, Homo sapien
gttcgtttagatttctacattctgt

SEQ ID NO: 668987 - DNA, 25 bp, Homo sapien
tcagagacccctaacaacccagcag

SEQ ID NO: 668988 - DNA, 25 bp, Homo sapien
ccacagagcggaacacttaaggatc

SEQ ID NO: 668989 - DNA, 25 bp, Homo sapien
gagcggaacacttaaggatccggac

SEQ ID NO: 668990 - DNA, 25 bp, Homo sapien
ggaacacttaaggatccggactcaa

SEQ ID NO: 668991 - DNA, 25 bp, Homo sapien
gaacacttaaggatccggactcaag

SEQ ID NO: 668992 - DNA, 25 bp, Homo sapien
aacacttaaggatccggactcaagc

SEQ ID NO: 668993 - DNA, 25 bp, Homo sapien
acacttaaggatccggactcaagca

SEQ ID NO: 668994 - DNA, 25 bp, Homo sapien
ttaaggatccggactcaagcaagac

SEQ ID NO: 668995 - DNA, 25 bp, Homo sapien
taaggatccggactcaagcaagacc

SEQ ID NO: 668996 - DNA, 25 bp, Homo sapien
aaggatccggactcaagcaagaccc

SEQ ID NO: 668997 - DNA, 25 bp, Homo sapien
aggatccggactcaagcaagacccc

SEQ ID NO: 668998 - DNA, 25 bp, Homo sapien
tttgtacccactcaggctgccaaga

SEQ ID NO: 668999 - DNA, 25 bp, Homo sapien
caagacctgtgtccgtccttccaag

SEQ ID NO: 669000 - DNA, 25 bp, Homo sapien
caagctcaaccttcagagttcatga

SEQ ID NO: 669001 - DNA, 25 bp, Homo sapien
ttcatgaggccccttgcccagaatg

SEQ ID NO: 669002 - DNA, 25 bp, Homo sapien
tgcccagaatgtccacagagttcat

SEQ ID NO: 669003 - DNA, 25 bp, Homo sapien
atgtccacagagttcatgaggcccc

SEQ ID NO: 669004 - DNA, 25 bp, Homo sapien
gaatgtccacatttgaaacctccca

SEQ ID NO: 669005 - DNA, 25 bp, Homo sapien
agccccatttcaagtataaccagga

SEQ ID NO: 669006 - DNA, 25 bp, Homo sapien
aacctgctttctcgaaatgggccct

SEQ ID NO: 669007 - DNA, 25 bp, Homo sapien
gacctccccggccaggatggaacgt

SEQ ID NO: 669008 - DNA, 25 bp, Homo sapien
tggaacgttccagagacccattagt

SEQ ID NO: 669009 - DNA, 25 bp, Homo sapien
aagacaccatctccatgtgaccgaa

SEQ ID NO: 669010 - DNA, 25 bp, Homo sapien
gtgaccgaacactgcagctgtctga

SEQ ID NO: 669011 - DNA, 25 bp, Homo sapien
agctgtctgaccttccaaagactaa

SEQ ID NO: 669012 - DNA, 25 bp, Homo sapien
aaagactaagactcgcggcaggttc

SEQ ID NO: 669013 - DNA, 25 bp, Homo sapien
aagactcgcggcaggttctctttga

SEQ ID NO: 669014 - DNA, 25 bp, Homo sapien
ttgagtcaatagcttgtcttcgtcc

SEQ ID NO: 669015 - DNA, 25 bp, Homo sapien
gtcttcgtccatctgttgacaaatg

SEQ ID NO: 669016 - DNA, 25 bp, Homo sapien
cccctatcagttgatttttcttatt

SEQ ID NO: 669017 - DNA, 25 bp, Homo sapien
agtcatctagaattcactgagtttt

SEQ ID NO: 669018 - DNA, 25 bp, Homo sapien
cactgagttttgtttcactttgaca

SEQ ID NO: 669019 - DNA, 25 bp, Homo sapien
gtgggcagtcgaaccatggtgaact

SEQ ID NO: 669020 - DNA, 25 bp, Homo sapien
aagtctgtgagaatatcaaccatag

SEQ ID NO: 669021 - DNA, 25 bp, Homo sapien
tatcaaccatagatagttctttcta

SEQ ID NO: 669022 - DNA, 25 bp, Homo sapien
agttctttctatattatgtttttgc

SEQ ID NO: 669023 - DNA, 25 bp, Homo sapien
actattggcatttagaagactttac

SEQ ID NO: 669024 - DNA, 25 bp, Homo sapien
gaagactttaccattatttcagtgc

SEQ ID NO: 669025 - DNA, 25 bp, Homo sapien
tttaccattatttcagtgctaggca

SEQ ID NO: 669026 - DNA, 25 bp, Homo sapien
accattatttcagtgctaggcatta

SEQ ID NO: 669027 - DNA, 25 bp, Homo sapien
tcagtgctaggcattattgattagg

SEQ ID NO: 669028 - DNA, 25 bp, Homo sapien
tattgattaggtcttggctccactg

SEQ ID NO: 669029 - DNA, 25 bp, Homo sapien
attaggtcttggctccactgtttac

SEQ ID NO: 669030 - DNA, 25 bp, Homo sapien
ggtcttggctccactgtttacctct

SEQ ID NO: 669031 - DNA, 25 bp, Homo sapien
tttgcaaaccagtatcaaacagatg

SEQ ID NO: 669032 - DNA, 25 bp, Homo sapien
gtatcaaacagatgccagtcacttg

SEQ ID NO: 669033 - DNA, 25 bp, Homo sapien
aacagatgccagtcacttgtaacat

SEQ ID NO: 669034 - DNA, 25 bp, Homo sapien
agatgccagtcacttgtaacatctg

SEQ ID NO: 669035 - DNA, 25 bp, Homo sapien
ccctaccattggaataacataatga

SEQ ID NO: 669036 - DNA, 25 bp, Homo sapien
aataacataatgagaggcctgggca

SEQ ID NO: 669037 - DNA, 25 bp, Homo sapien
gtaaatgacatcagttactaataag

SEQ ID NO: 669038 - DNA, 25 bp, Homo sapien
agttactaataagaacactgctgaa

SEQ ID NO: 669039 - DNA, 25 bp, Homo sapien
tactaattatgagagtgctgtgtat

SEQ ID NO: 669040 - DNA, 25 bp, Homo sapien
gctgtgtattattagttgtttggtc

SEQ ID NO: 669041 - DNA, 25 bp, Homo sapien
gtattattagttgtttggtcacaaa

SEQ ID NO: 669042 - DNA, 25 bp, Homo sapien
gtaaaatgttcttattctttgcacc

SEQ ID NO: 669043 - DNA, 25 bp, Homo sapien
taaaatgttcttattctttgcacct

SEQ ID NO: 669044 - DNA, 25 bp, Homo sapien
aaaatgttcttattctttgcacctc

SEQ ID NO: 669045 - DNA, 25 bp, Homo sapien
aaatgttcttattctttgcacctct

SEQ ID NO: 669046 - DNA, 25 bp, Homo sapien
aatgttcttattctttgcacctctt

SEQ ID NO: 669047 - DNA, 25 bp, Homo sapien
atgttcttattctttgcacctcttc

SEQ ID NO: 669048 - DNA, 25 bp, Homo sapien
tgttcttattctttgcacctcttcc

SEQ ID NO: 669049 - DNA, 25 bp, Homo sapien
gttcttattctttgcacctcttcct

SEQ ID NO: 669050 - DNA, 25 bp, Homo sapien
ttcttattctttgcacctcttccta

SEQ ID NO: 669051 - DNA, 25 bp, Homo sapien
tcttattctttgcacctcttcctat

SEQ ID NO: 669052 - DNA, 25 bp, Homo sapien
ttattctttgcacctcttcctattt

SEQ ID NO: 669053 - DNA, 25 bp, Homo sapien
ggcggcctgagaggtgaatttccct

SEQ ID NO: 669054 - DNA, 25 bp, Homo sapien
gtgaatttccctgggctggtgcatg

SEQ ID NO: 669055 - DNA, 25 bp, Homo sapien
tggagcctccagtgccggcactcat

SEQ ID NO: 669056 - DNA, 25 bp, Homo sapien
caggagaaagccgttgctgtgtgta

SEQ ID NO: 669057 - DNA, 25 bp, Homo sapien
tgtagcctggagagtgcgtcgtcac

SEQ ID NO: 669058 - DNA, 25 bp, Homo sapien
gagagtgcgtcgtcacgtgacagat

SEQ ID NO: 669059 - DNA, 25 bp, Homo sapien
gtgacagatgcttgtagccacccgg

SEQ ID NO: 669060 - DNA, 25 bp, Homo sapien
gtagccacccgggacctgcgaaaag

SEQ ID NO: 669061 - DNA, 25 bp, Homo sapien
gacctgcgaaaagcctgcagctggt

SEQ ID NO: 669062 - DNA, 25 bp, Homo sapien
tggaggattgctcataaattgttcc

SEQ ID NO: 669063 - DNA, 25 bp, Homo sapien
tgctcataaattgttcctgccctgt

SEQ ID NO: 669064 - DNA, 25 bp, Homo sapien
gttactgtggcccatgtcctaaaaa

SEQ ID NO: 669065 - DNA, 25 bp, Homo sapien
ataactgctaccaattttttgatga

SEQ ID NO: 669066 - DNA, 25 bp, Homo sapien
agagccaggcttcttgtatgtctca

SEQ ID NO: 669067 - DNA, 25 bp, Homo sapien
gtatgtctcaaaatgccagccttct

SEQ ID NO: 669068 - DNA, 25 bp, Homo sapien
gccagccttctgaaagtatacagca

SEQ ID NO: 669069 - DNA, 25 bp, Homo sapien
gtatacagcaaagaggaccaggatt

SEQ ID NO: 669070 - DNA, 25 bp, Homo sapien
ggatgggactagtacacattccaac

SEQ ID NO: 669071 - DNA, 25 bp, Homo sapien
aacaaatggatcttggcagtgggaa

SEQ ID NO: 669072 - DNA, 25 bp, Homo sapien
gggaagatggctccattctctcacc

SEQ ID NO: 669073 - DNA, 25 bp, Homo sapien
ctcacccaacctactaacaataatt

SEQ ID NO: 669074 - DNA, 25 bp, Homo sapien
aagggagactgtgcactctatgcct

SEQ ID NO: 669075 - DNA, 25 bp, Homo sapien
ttgatgattagaagcaattgggcct

SEQ ID NO: 669076 - DNA, 25 bp, Homo sapien
gcaattgggcctaacttataaatga

SEQ ID NO: 669077 - DNA, 25 bp, Homo sapien
ttataaatgatcattgggcctaact

SEQ ID NO: 669078 - DNA, 25 bp, Homo sapien
taaatgattgctaggcctaagcggg

SEQ ID NO: 669079 - DNA, 25 bp, Homo sapien
gtaggagatacagcatttgaaaccc

SEQ ID NO: 669080 - DNA, 25 bp, Homo sapien
ggagatacagcatttgaaaccctaa

SEQ ID NO: 669081 - DNA, 25 bp, Homo sapien
aggaattcatttgtaggccaaggtc

SEQ ID NO: 669082 - DNA, 25 bp, Homo sapien
catttgtaggccaaggtcctccagg

SEQ ID NO: 669083 - DNA, 25 bp, Homo sapien
gtcctccaggggtgtattatttata

SEQ ID NO: 669084 - DNA, 25 bp, Homo sapien
tctgtccccaacataattgtccagg

SEQ ID NO: 669085 - DNA, 25 bp, Homo sapien
gtccccaacataattgtccaggaaa

SEQ ID NO: 669086 - DNA, 25 bp, Homo sapien
aataaccatagaagagctgggcaga

SEQ ID NO: 669087 - DNA, 25 bp, Homo sapien
ataaccatagaagagctgggcagat

SEQ ID NO: 669088 - DNA, 25 bp, Homo sapien
taaccatagaagagctgggcagatg

SEQ ID NO: 669089 - DNA, 25 bp, Homo sapien
aaccatagaagagctgggcagatgg

SEQ ID NO: 669090 - DNA, 25 bp, Homo sapien
agataaaaagtgtcagcttaggcca

SEQ ID NO: 669091 - DNA, 25 bp, Homo sapien
ataaaaagtgtcagcttaggccagg

SEQ ID NO: 669092 - DNA, 25 bp, Homo sapien
taaaaagtgtcagcttaggccaggc

SEQ ID NO: 669093 - DNA, 25 bp, Homo sapien
aaaaagtgtcagcttaggccaggca

SEQ ID NO: 669094 - DNA, 25 bp, Homo sapien
aaaagtgtcagcttaggccaggcat

SEQ ID NO: 669095 - DNA, 25 bp, Homo sapien
aaagtgtcagcttaggccaggcatg

SEQ ID NO: 669096 - DNA, 25 bp, Homo sapien
agtgaactgagattccacctgtgca

SEQ ID NO: 669097 - DNA, 25 bp, Homo sapien
aaattagatagcagtgcttgcttct

SEQ ID NO: 669098 - DNA, 25 bp, Homo sapien
cagtgcttgcttctttatagataca

SEQ ID NO: 669099 - DNA, 25 bp, Homo sapien
gcttgcttctttatagatacattag

SEQ ID NO: 669100 - DNA, 25 bp, Homo sapien
tagtgttccaaataacatacttgaa

SEQ ID NO: 669101 - DNA, 25 bp, Homo sapien
tatcatctttgaagtaaacaccatg

SEQ ID NO: 669102 - DNA, 25 bp, Homo sapien
gtaaacaccatgttagactccctgg

SEQ ID NO: 669103 - DNA, 25 bp, Homo sapien
atgttagactccctggtgataccac

SEQ ID NO: 669104 - DNA, 25 bp, Homo sapien
tccctggtgataccactcttgaatt

SEQ ID NO: 669105 - DNA, 25 bp, Homo sapien
gtgataccactcttgaattggttaa

SEQ ID NO: 669106 - DNA, 25 bp, Homo sapien
gttttttattaccagttgatctctc

SEQ ID NO: 669107 - DNA, 25 bp, Homo sapien
ttattaccagttgatctctcaaatg

SEQ ID NO: 669108 - DNA, 25 bp, Homo sapien
tccgatactattatgagaaaggcat

SEQ ID NO: 669109 - DNA, 25 bp, Homo sapien
tggctggtgagcgttacgtgtacaa

SEQ ID NO: 669110 - DNA, 25 bp, Homo sapien
gagcgttacgtgtacaagtttgtgt

SEQ ID NO: 669111 - DNA, 25 bp, Homo sapien
caagtttgtgtgtgagcccgaggcc

SEQ ID NO: 669112 - DNA, 25 bp, Homo sapien
agctctcaaggctgagtttgaccgg

SEQ ID NO: 669113 - DNA, 25 bp, Homo sapien
aggctgagtttgaccggcctgtcag

SEQ ID NO: 669114 - DNA, 25 bp, Homo sapien
gtgaggaggacacagtccctttgtc

SEQ ID NO: 669115 - DNA, 25 bp, Homo sapien
gtccctttgtcccacttggatgaga

SEQ ID NO: 669116 - DNA, 25 bp, Homo sapien
ttgtcccacttggatgagagccccg

SEQ ID NO: 669117 - DNA, 25 bp, Homo sapien
atttggccccaagggtggctactct

SEQ ID NO: 669118 - DNA, 25 bp, Homo sapien
caagggtggctactcttactagccc

SEQ ID NO: 669119 - DNA, 25 bp, Homo sapien
tgacccgggtcaccaagctggagct

SEQ ID NO: 669120 - DNA, 25 bp, Homo sapien
tggagaatgccaacgcgcgggcgct

SEQ ID NO: 669121 - DNA, 25 bp, Homo sapien
cgctgctgggcaagttcatcaacgt

SEQ ID NO: 669122 - DNA, 25 bp, Homo sapien
tgggcaagttcatcaacgtgatcct

SEQ ID NO: 669123 - DNA, 25 bp, Homo sapien
tgatcctggcgctcatggccgtgct

SEQ ID NO: 669124 - DNA, 25 bp, Homo sapien
gccgtgctgctggtgttcgtgtcca

SEQ ID NO: 669125 - DNA, 25 bp, Homo sapien
tggtgttcgtgtccaccatcgccaa

SEQ ID NO: 669126 - DNA, 25 bp, Homo sapien
aacttcatcacgcccctcatgaaga

SEQ ID NO: 669127 - DNA, 25 bp, Homo sapien
ctcatgaagacacgcctgcgcatca

SEQ ID NO: 669128 - DNA, 25 bp, Homo sapien
tgaagacacgcctgcgcatcaccag

SEQ ID NO: 669129 - DNA, 25 bp, Homo sapien
ggagcacgtgttgctgcccagctga

SEQ ID NO: 669130 - DNA, 25 bp, Homo sapien
aaaggaaagatacctgcagcccgcc

SEQ ID NO: 669131 - DNA, 25 bp, Homo sapien
ctgggcgccaactgtcccttggcat

SEQ ID NO: 669132 - DNA, 25 bp, Homo sapien
cggcgcgtgcatttctttttcagaa

SEQ ID NO: 669133 - DNA, 25 bp, Homo sapien
agaagatgcacctaaatcacctgtg

SEQ ID NO: 669134 - DNA, 25 bp, Homo sapien
ctaaatcacctgtgctgctttcctc

SEQ ID NO: 669135 - DNA, 25 bp, Homo sapien
tttccgcttgaagcatactgttctg

SEQ ID NO: 669136 - DNA, 25 bp, Homo sapien
gttctgtctgtgcagttcttaattt

SEQ ID NO: 669137 - DNA, 25 bp, Homo sapien
gaatttccaccgtgccaggaggcta

SEQ ID NO: 669138 - DNA, 25 bp, Homo sapien
aggagatacggctgtgaagagtcac

SEQ ID NO: 669139 - DNA, 25 bp, Homo sapien
gtgaagagtcacaatgtcagttctg

SEQ ID NO: 669140 - DNA, 25 bp, Homo sapien
gtcagttctgtgtcccaaataaatg

SEQ ID NO: 669141 - DNA, 25 bp, Homo sapien
taacttatcaaatcttgtgggatgc

SEQ ID NO: 669142 - DNA, 25 bp, Homo sapien
tatcaaatcttgtgggatgcaggaa

SEQ ID NO: 669143 - DNA, 25 bp, Homo sapien
aaatcttgtgggatgcaggaaaagc

SEQ ID NO: 669144 - DNA, 25 bp, Homo sapien
gagggaaatttatagtattgactac

SEQ ID NO: 669145 - DNA, 25 bp, Homo sapien
atagtattgactacatagattagaa

SEQ ID NO: 669146 - DNA, 25 bp, Homo sapien
gaaagatccaaaatctacaagcttc

SEQ ID NO: 669147 - DNA, 25 bp, Homo sapien
gatccaaaatctacaagcttcaaca

SEQ ID NO: 669148 - DNA, 25 bp, Homo sapien
aaatctacaagcttcaacattagga

SEQ ID NO: 669149 - DNA, 25 bp, Homo sapien
acaagcttcaacattaggaaacgta

SEQ ID NO: 669150 - DNA, 25 bp, Homo sapien
ttttaaacatcaaaagctggttctt

SEQ ID NO: 669151 - DNA, 25 bp, Homo sapien
tagccaggctaaacaagaggaaaag

SEQ ID NO: 669152 - DNA, 25 bp, Homo sapien
atggagcagaaaaagaccaggtggt

SEQ ID NO: 669153 - DNA, 25 bp, Homo sapien
aaagaccaggtggtcgggcgcggtg

SEQ ID NO: 669154 - DNA, 25 bp, Homo sapien
ctgtcagacagctggaccgggatct

SEQ ID NO: 669155 - DNA, 25 bp, Homo sapien
tgtcagacagctggaccgggatctc

SEQ ID NO: 669156 - DNA, 25 bp, Homo sapien
gtcagacagctggaccgggatctcc

SEQ ID NO: 669157 - DNA, 25 bp, Homo sapien
cagacagctggaccgggatctccat

SEQ ID NO: 669158 - DNA, 25 bp, Homo sapien
agctggaccgggatctccatggctc

SEQ ID NO: 669159 - DNA, 25 bp, Homo sapien
tggaccgggatctccatggctcagg

SEQ ID NO: 669160 - DNA, 25 bp, Homo sapien
accgggatctccatggctcaggagg

SEQ ID NO: 669161 - DNA, 25 bp, Homo sapien
gatctccatggctcaggagggacat

SEQ ID NO: 669162 - DNA, 25 bp, Homo sapien
tctccatggctcaggagggacatag

SEQ ID NO: 669163 - DNA, 25 bp, Homo sapien
ggttgttacatgtctatttcttgat

SEQ ID NO: 669164 - DNA, 25 bp, Homo sapien
agaaggtctttgaccgacacctcca

SEQ ID NO: 669165 - DNA, 25 bp, Homo sapien
gtactgaaaaggcacagcttactga

SEQ ID NO: 669166 - DNA, 25 bp, Homo sapien
cagcttactgaaacaaatgcaggta

SEQ ID NO: 669167 - DNA, 25 bp, Homo sapien
gcaggtatcaagtgcttggactcca

SEQ ID NO: 669168 - DNA, 25 bp, Homo sapien
aagtgcttggactccatgtgctgtt

SEQ ID NO: 669169 - DNA, 25 bp, Homo sapien
catgtgctgtttcccggaaggagaa

SEQ ID NO: 669170 - DNA, 25 bp, Homo sapien
aggagaagcagcgtgtgcatctgtt

SEQ ID NO: 669171 - DNA, 25 bp, Homo sapien
gcagcgtgtgcatctgttggaagaa

SEQ ID NO: 669172 - DNA, 25 bp, Homo sapien
taggaagatgtagtccaacccacat

SEQ ID NO: 669173 - DNA, 25 bp, Homo sapien
gatgtagtccaacccacatcagcag

SEQ ID NO: 669174 - DNA, 25 bp, Homo sapien
ctcaaagaaatgttatgcacccatt

SEQ ID NO: 669175 - DNA, 25 bp, Homo sapien
caaagaaatgttatgcacccattaa

SEQ ID NO: 669176 - DNA, 25 bp, Homo sapien
gaaatgttatgcacccattaaaagt

SEQ ID NO: 669177 - DNA, 25 bp, Homo sapien
atgttatgcacccattaaaagttat

SEQ ID NO: 669178 - DNA, 25 bp, Homo sapien
gttatgcacccattaaaagttatca

SEQ ID NO: 669179 - DNA, 25 bp, Homo sapien
tgcacccattaaaagttatcattat

SEQ ID NO: 669180 - DNA, 25 bp, Homo sapien
acccattaaaagttatcattatgag

SEQ ID NO: 669181 - DNA, 25 bp, Homo sapien
tcattatgagaactatagaaacaag

SEQ ID NO: 669182 - DNA, 25 bp, Homo sapien
aaatgtatacatgtggacatattat

SEQ ID NO: 669183 - DNA, 25 bp, Homo sapien
tacatgtggacatattatacaaaaa

SEQ ID NO: 669184 - DNA, 25 bp, Homo sapien
tttgcagataaaactctgggagtgc

SEQ ID NO: 669185 - DNA, 25 bp, Homo sapien
cacaggtgatgggattaacaggaaa

SEQ ID NO: 669186 - DNA, 25 bp, Homo sapien
attagggactagatcatgtgaggcc

SEQ ID NO: 669187 - DNA, 25 bp, Homo sapien
catgtgaggcctgtatcttaatcta

SEQ ID NO: 669188 - DNA, 25 bp, Homo sapien
gaggcctgtatcttaatctaagtga

SEQ ID NO: 669189 - DNA, 25 bp, Homo sapien
aagtcacaggagaacttgagtagaa

SEQ ID NO: 669190 - DNA, 25 bp, Homo sapien
aaagtaacctttagacaatgtgata

SEQ ID NO: 669191 - DNA, 25 bp, Homo sapien
tgatatgatgattaggagcacaaat

SEQ ID NO: 669192 - DNA, 25 bp, Homo sapien
ggagcacaaatactataggattttt

SEQ ID NO: 669193 - DNA, 25 bp, Homo sapien
gataacaataggacttgcccgataa

SEQ ID NO: 669194 - DNA, 25 bp, Homo sapien
ggacttgcccgataaaagaaatgct

SEQ ID NO: 669195 - DNA, 25 bp, Homo sapien
atgctttaagtcacattttatagat

SEQ ID NO: 669196 - DNA, 25 bp, Homo sapien
ttgtgaatatacacatttttctggg

SEQ ID NO: 669197 - DNA, 25 bp, Homo sapien
agagtgccggtgttggagacttacc

SEQ ID NO: 669198 - DNA, 25 bp, Homo sapien
agtgccggtgttggagacttaccta

SEQ ID NO: 669199 - DNA, 25 bp, Homo sapien
gtgccggtgttggagacttacctag

SEQ ID NO: 669200 - DNA, 25 bp, Homo sapien
gccggtgttggagacttacctagtc

SEQ ID NO: 669201 - DNA, 25 bp, Homo sapien
ccggtgttggagacttacctagtct

SEQ ID NO: 669202 - DNA, 25 bp, Homo sapien
tgttggagacttacctagtctcccc

SEQ ID NO: 669203 - DNA, 25 bp, Homo sapien
agccaccttcaagcaatcacccctt

SEQ ID NO: 669204 - DNA, 25 bp, Homo sapien
ccagtagtttggtgcccctcagacc

SEQ ID NO: 669205 - DNA, 25 bp, Homo sapien
tcctacataaaaactgggggcctct

SEQ ID NO: 669206 - DNA, 25 bp, Homo sapien
gggcctctactagagaggactcaga

SEQ ID NO: 669207 - DNA, 25 bp, Homo sapien
tcattccacttaaaacctgaaaaca

SEQ ID NO: 669208 - DNA, 25 bp, Homo sapien
aacctgaaaacattggaccacacaa

SEQ ID NO: 669209 - DNA, 25 bp, Homo sapien
attggaccacacaaagtcttactga

SEQ ID NO: 669210 - DNA, 25 bp, Homo sapien
ggaccacacaaagtcttactgattt

SEQ ID NO: 669211 - DNA, 25 bp, Homo sapien
ggcaaggagaactgtgcagcagtta

SEQ ID NO: 669212 - DNA, 25 bp, Homo sapien
gcagcagttaagattagaagcctcc

SEQ ID NO: 669213 - DNA, 25 bp, Homo sapien
gttaagattagaagcctccattgaa

SEQ ID NO: 669214 - DNA, 25 bp, Homo sapien
aaaggtttcgaaggcatcagcggac

SEQ ID NO: 669215 - DNA, 25 bp, Homo sapien
tcgaaggcatcagcggacctcatgt

SEQ ID NO: 669216 - DNA, 25 bp, Homo sapien
ggacctcatgtcctactgtgaggaa

SEQ ID NO: 669217 - DNA, 25 bp, Homo sapien
gataggaataccaacttcagaaaac

SEQ ID NO: 669218 - DNA, 25 bp, Homo sapien
ttcacagtgatcatcaacccttcag

SEQ ID NO: 669219 - DNA, 25 bp, Homo sapien
gatgtggtacctgtatcccatcaag

SEQ ID NO: 669220 - DNA, 25 bp, Homo sapien
actgagcctagaccatggagccttg

SEQ ID NO: 669221 - DNA, 25 bp, Homo sapien
tggagccttggcatgcccagggcaa

SEQ ID NO: 669222 - DNA, 25 bp, Homo sapien
ggaggttctctgctccccaggcctg

SEQ ID NO: 669223 - DNA, 25 bp, Homo sapien
aggcctgctcggtgactgaccccat

SEQ ID NO: 669224 - DNA, 25 bp, Homo sapien
tgaccccatcatacccaaagtgcaa

SEQ ID NO: 669225 - DNA, 25 bp, Homo sapien
caaagtgcaatctcacggccaggtt

SEQ ID NO: 669226 - DNA, 25 bp, Homo sapien
aatctcacggccaggttctatgccc

SEQ ID NO: 669227 - DNA, 25 bp, Homo sapien
gttctatgccctgtccaagcgtaaa

SEQ ID NO: 669228 - DNA, 25 bp, Homo sapien
tgtccaagcgtaaaccctcttggaa

SEQ ID NO: 669229 - DNA, 25 bp, Homo sapien
aatcctgccagggagctactctggg

SEQ ID NO: 669230 - DNA, 25 bp, Homo sapien
ggagccccatcctgctgatgaatga

SEQ ID NO: 669231 - DNA, 25 bp, Homo sapien
atcctgctgatgaatgaccgagtct

SEQ ID NO: 669232 - DNA, 25 bp, Homo sapien
gctgatgaatgaccgagtctcgcag

SEQ ID NO: 669233 - DNA, 25 bp, Homo sapien
aatgaccgagtctcgcagcgatgac

SEQ ID NO: 669234 - DNA, 25 bp, Homo sapien
agtctcgcagcgatgacggaacctg

SEQ ID NO: 669235 - DNA, 25 bp, Homo sapien
cagcgatgacggaacctgcaggtcc

SEQ ID NO: 669236 - DNA, 25 bp, Homo sapien
gatgacggaacctgcaggtcccagg

SEQ ID NO: 669237 - DNA, 25 bp, Homo sapien
cggaacctgcaggtcccaggcttgg

SEQ ID NO: 669238 - DNA, 25 bp, Homo sapien
ggcccaggtctgtctttctccaggg

SEQ ID NO: 669239 - DNA, 25 bp, Homo sapien
gaacaggttcaaaatccatttgctg

SEQ ID NO: 669240 - DNA, 25 bp, Homo sapien
gttcctcgacttaggatgcggttat

SEQ ID NO: 669241 - DNA, 25 bp, Homo sapien
cactttcgacttacgatgtttccca

SEQ ID NO: 669242 - DNA, 25 bp, Homo sapien
gatgtttcccactcacgatgggttt

SEQ ID NO: 669243 - DNA, 25 bp, Homo sapien
acgatgggtttctccggatgtagcc

SEQ ID NO: 669244 - DNA, 25 bp, Homo sapien
ttctccggatgtagccccatcataa

SEQ ID NO: 669245 - DNA, 25 bp, Homo sapien
atcataagttgaggagcacctgtta

SEQ ID NO: 669246 - DNA, 25 bp, Homo sapien
gagcacctgttagttacttccaact

SEQ ID NO: 669247 - DNA, 25 bp, Homo sapien
agttacttccaactgtctcaggcaa

SEQ ID NO: 669248 - DNA, 25 bp, Homo sapien
ctcaggcaacctgggcattcaggag

SEQ ID NO: 669249 - DNA, 25 bp, Homo sapien
gacagggaagcacccatgcaaagca

SEQ ID NO: 669250 - DNA, 25 bp, Homo sapien
acattcagtatgttcctcgacttag

SEQ ID NO: 669251 - DNA, 25 bp, Homo sapien
gaaagccagtcacatacaacagcta

SEQ ID NO: 669252 - DNA, 25 bp, Homo sapien
agtcacatacaacagctagatcagg

SEQ ID NO: 669253 - DNA, 25 bp, Homo sapien
tacaacagctagatcaggttttggg

SEQ ID NO: 669254 - DNA, 25 bp, Homo sapien
tatcgcttagcaacctttattttag

SEQ ID NO: 669255 - DNA, 25 bp, Homo sapien
gcaacctttattttagactgttaca

SEQ ID NO: 669256 - DNA, 25 bp, Homo sapien
gactgttacatgagtacagctcgaa

SEQ ID NO: 669257 - DNA, 25 bp, Homo sapien
tacatgagtacagctcgaaaaagtc

SEQ ID NO: 669258 - DNA, 25 bp, Homo sapien
gacactgttttataccatccttaga

SEQ ID NO: 669259 - DNA, 25 bp, Homo sapien
ctgttttataccatccttagaagga

SEQ ID NO: 669260 - DNA, 25 bp, Homo sapien
aatcacaaaacttttctgagaggct

SEQ ID NO: 669261 - DNA, 25 bp, Homo sapien
cacaaaacttttctgagaggcttta

SEQ ID NO: 669262 - DNA, 25 bp, Homo sapien
agggccactcttacccgcagagcat

SEQ ID NO: 669263 - DNA, 25 bp, Homo sapien
actcttacccgcagagcatgcagtt

SEQ ID NO: 669264 - DNA, 25 bp, Homo sapien
tcttacccgcagagcatgcagttcc

SEQ ID NO: 669265 - DNA, 25 bp, Homo sapien
ttacccgcagagcatgcagttccca

SEQ ID NO: 669266 - DNA, 25 bp, Homo sapien
cgcagagcatgcagttcccacagag

SEQ ID NO: 669267 - DNA, 25 bp, Homo sapien
gcagagcatgcagttcccacagagc

SEQ ID NO: 669268 - DNA, 25 bp, Homo sapien
agagcatgcagttcccacagagcag

SEQ ID NO: 669269 - DNA, 25 bp, Homo sapien
gagcatgcagttcccacagagcagt

SEQ ID NO: 669270 - DNA, 25 bp, Homo sapien
gcatgcagttcccacagagcagtgt

SEQ ID NO: 669271 - DNA, 25 bp, Homo sapien
atgcagttcccacagagcagtgttc

SEQ ID NO: 669272 - DNA, 25 bp, Homo sapien
tgcagttcccacagagcagtgttct

SEQ ID NO: 669273 - DNA, 25 bp, Homo sapien
gaaaggctaaagatcctccgacagc

SEQ ID NO: 669274 - DNA, 25 bp, Homo sapien
aaagatcctccgacagcgatgtggt

SEQ ID NO: 669275 - DNA, 25 bp, Homo sapien
gacagcgatgtggtctggacaacac

SEQ ID NO: 669276 - DNA, 25 bp, Homo sapien
aaagcaagatgaccgacctcctttg

SEQ ID NO: 669277 - DNA, 25 bp, Homo sapien
atgaccgacctcctttgacctcttt

SEQ ID NO: 669278 - DNA, 25 bp, Homo sapien
ctctttgctctccaaaccagcagtt

SEQ ID NO: 669279 - DNA, 25 bp, Homo sapien
aaaccagcagttcctactgtcgcct

SEQ ID NO: 669280 - DNA, 25 bp, Homo sapien
aaactctctcagctccgggagtcac

SEQ ID NO: 669281 - DNA, 25 bp, Homo sapien
ctcagctccgggagtcacgggagca

SEQ ID NO: 669282 - DNA, 25 bp, Homo sapien
acgggagcagcaccagcattcagac

SEQ ID NO: 669283 - DNA, 25 bp, Homo sapien
tcctccacagctaacatagacgact

SEQ ID NO: 669284 - DNA, 25 bp, Homo sapien
tttatccagaagtcaactctgatta

SEQ ID NO: 669285 - DNA, 25 bp, Homo sapien
tatccagaagtcaactctgattaaa

SEQ ID NO: 669286 - DNA, 25 bp, Homo sapien
atccagaagtcaactctgattaaac

SEQ ID NO: 669287 - DNA, 25 bp, Homo sapien
tgggaaatcttttagtgttaaatca

SEQ ID NO: 669288 - DNA, 25 bp, Homo sapien
atcaactctcattgtatgtcacaga

SEQ ID NO: 669289 - DNA, 25 bp, Homo sapien
actctcattgtatgtcacagaacat

SEQ ID NO: 669290 - DNA, 25 bp, Homo sapien
ctctcattgtatgtcacagaacata

SEQ ID NO: 669291 - DNA, 25 bp, Homo sapien
ctcattgtatgtcacagaacataaa

SEQ ID NO: 669292 - DNA, 25 bp, Homo sapien
gtatgtcacagaacataaatgcata

SEQ ID NO: 669293 - DNA, 25 bp, Homo sapien
gtcacagaacataaatgcataagtt

SEQ ID NO: 669294 - DNA, 25 bp, Homo sapien
aaatgcataagttgcatgctattgt

SEQ ID NO: 669295 - DNA, 25 bp, Homo sapien
aaaacacgaatttggatgaaccttg

SEQ ID NO: 669296 - DNA, 25 bp, Homo sapien
gaaccttgtgttacatgtacattgt

SEQ ID NO: 669297 - DNA, 25 bp, Homo sapien
ttcattatatagacagcttgagaat

SEQ ID NO: 669298 - DNA, 25 bp, Homo sapien
gcttgagaatagtgcgttcctgaat

SEQ ID NO: 669299 - DNA, 25 bp, Homo sapien
tagtgcgttcctgaatgattttgaa

SEQ ID NO: 669300 - DNA, 25 bp, Homo sapien
atgattttgaacatgctacagtgaa

SEQ ID NO: 669301 - DNA, 25 bp, Homo sapien
gaaaagtgacagtgtggaccatgga

SEQ ID NO: 669302 - DNA, 25 bp, Homo sapien
gtgtggaccatggaatcaccagcta

SEQ ID NO: 669303 - DNA, 25 bp, Homo sapien
aatcaccagctagaggttatggact

SEQ ID NO: 669304 - DNA, 25 bp, Homo sapien
gttatggactatacacacctattat

SEQ ID NO: 669305 - DNA, 25 bp, Homo sapien
acacacctattattatattctgatt

SEQ ID NO: 669306 - DNA, 25 bp, Homo sapien
gttgccacagcggaatcaagcagca

SEQ ID NO: 669307 - DNA, 25 bp, Homo sapien
tgccacagcggaatcaagcagcaga

SEQ ID NO: 669308 - DNA, 25 bp, Homo sapien
aaacacaggaagttctaatccagca

SEQ ID NO: 669309 - DNA, 25 bp, Homo sapien
acacaggaagttctaatccagcagg

SEQ ID NO: 669310 - DNA, 25 bp, Homo sapien
acaggaagttctaatccagcaggat

SEQ ID NO: 669311 - DNA, 25 bp, Homo sapien
aggaagttctaatccagcaggatga

SEQ ID NO: 669312 - DNA, 25 bp, Homo sapien
gaagttctaatccagcaggatgaga

SEQ ID NO: 669313 - DNA, 25 bp, Homo sapien
gttctaatccagcaggatgagatca

SEQ ID NO: 669314 - DNA, 25 bp, Homo sapien
taatccagcaggatgagatcatgct

SEQ ID NO: 669315 - DNA, 25 bp, Homo sapien
gcaggatgagatcatgctgataata

SEQ ID NO: 669316 - DNA, 25 bp, Homo sapien
catgctgataatattgataactcat

SEQ ID NO: 669317 - DNA, 25 bp, Homo sapien
cgtcagcctgcgagcggcacgcctg

SEQ ID NO: 669318 - DNA, 25 bp, Homo sapien
gtcagcctgcgagcggcacgcctgg

SEQ ID NO: 669319 - DNA, 25 bp, Homo sapien
tcagcctgcgagcggcacgcctggt

SEQ ID NO: 669320 - DNA, 25 bp, Homo sapien
agcctgcgagcggcacgcctggtga

SEQ ID NO: 669321 - DNA, 25 bp, Homo sapien
gcctgcgagcggcacgcctggtgaa

SEQ ID NO: 669322 - DNA, 25 bp, Homo sapien
cctgcgagcggcacgcctggtgaag

SEQ ID NO: 669323 - DNA, 25 bp, Homo sapien
ctgcgagcggcacgcctggtgaagt

SEQ ID NO: 669324 - DNA, 25 bp, Homo sapien
tgcgagcggcacgcctggtgaagta

SEQ ID NO: 669325 - DNA, 25 bp, Homo sapien
gcgagcggcacgcctggtgaagtat

SEQ ID NO: 669326 - DNA, 25 bp, Homo sapien
cgagcggcacgcctggtgaagtatg

SEQ ID NO: 669327 - DNA, 25 bp, Homo sapien
gagcggcacgcctggtgaagtatga

SEQ ID NO: 669328 - DNA, 25 bp, Homo sapien
ttaagtgtggccgtataactaggtt

SEQ ID NO: 669329 - DNA, 25 bp, Homo sapien
taactaggttgtgcccaaagacaat

SEQ ID NO: 669330 - DNA, 25 bp, Homo sapien
ttttccttgttatttagagtacgag

SEQ ID NO: 669331 - DNA, 25 bp, Homo sapien
gtattatatctgtagctccagcagc

SEQ ID NO: 669332 - DNA, 25 bp, Homo sapien
gtctggagaatgtaagccatgtgca

SEQ ID NO: 669333 - DNA, 25 bp, Homo sapien
agccatgtgcagaatgatacttaca

SEQ ID NO: 669334 - DNA, 25 bp, Homo sapien
gatacttacagacaagggactgtgt

SEQ ID NO: 669335 - DNA, 25 bp, Homo sapien
gggactgtgtactttcattgaaccg

SEQ ID NO: 669336 - DNA, 25 bp, Homo sapien
cattgaaccgtaaagctgccatagt

SEQ ID NO: 669337 - DNA, 25 bp, Homo sapien
aagctgccatagttgccttggatac

SEQ ID NO: 669338 - DNA, 25 bp, Homo sapien
tgccttggatactctccttgtggac

SEQ ID NO: 669339 - DNA, 25 bp, Homo sapien
gccctattctgctgggctttggcaa

SEQ ID NO: 669340 - DNA, 25 bp, Homo sapien
attctgctgggctttggcaagcact

SEQ ID NO: 669341 - DNA, 25 bp, Homo sapien
ctgggctttggcaagcactgaatga

SEQ ID NO: 669342 - DNA, 25 bp, Homo sapien
aagcactgaatgattgccctcctag

SEQ ID NO: 669343 - DNA, 25 bp, Homo sapien
cactgaatgattgccctcctagggc

SEQ ID NO: 669344 - DNA, 25 bp, Homo sapien
ccctcctagggcagaggtactgcag

SEQ ID NO: 669345 - DNA, 25 bp, Homo sapien
gcagaggtactgcagccctggttaa

SEQ ID NO: 669346 - DNA, 25 bp, Homo sapien
gtactgcagccctggttaagcattg

SEQ ID NO: 669347 - DNA, 25 bp, Homo sapien
gcagccctggttaagcattgaaaag

SEQ ID NO: 669348 - DNA, 25 bp, Homo sapien
gatattaccaataagttgactctaa

SEQ ID NO: 669349 - DNA, 25 bp, Homo sapien
attataagtgcctcagaactttctt

SEQ ID NO: 669350 - DNA, 25 bp, Homo sapien
ttcagcgtgagcacagcaggaagga

SEQ ID NO: 669351 - DNA, 25 bp, Homo sapien
gaaggatgcacatatttaagcctgt

SEQ ID NO: 669352 - DNA, 25 bp, Homo sapien
ttaagcctgtgtctgtccaggccat

SEQ ID NO: 669353 - DNA, 25 bp, Homo sapien
aggtgcttcacaaggcctgcgaagt

SEQ ID NO: 669354 - DNA, 25 bp, Homo sapien
cacaaggcctgcgaagtggcccgga

SEQ ID NO: 669355 - DNA, 25 bp, Homo sapien
aagtggcccggaggcacaactactt

SEQ ID NO: 669356 - DNA, 25 bp, Homo sapien
gtgtagctctcatctgggctaccta

SEQ ID NO: 669357 - DNA, 25 bp, Homo sapien
gggctacctactatgagagctgcat

SEQ ID NO: 669358 - DNA, 25 bp, Homo sapien
gagagctgcatcagctccgagcaga

SEQ ID NO: 669359 - DNA, 25 bp, Homo sapien
agcagagctgcatcaacgagtggaa

SEQ ID NO: 669360 - DNA, 25 bp, Homo sapien
caacgagtggaacgccatgcaggac

SEQ ID NO: 669361 - DNA, 25 bp, Homo sapien
cctctgagataactgactgttgaat

SEQ ID NO: 669362 - DNA, 25 bp, Homo sapien
ctctgagataactgactgttgaatt

SEQ ID NO: 669363 - DNA, 25 bp, Homo sapien
tctgagataactgactgttgaatta

SEQ ID NO: 669364 - DNA, 25 bp, Homo sapien
ctgagataactgactgttgaattaa

SEQ ID NO: 669365 - DNA, 25 bp, Homo sapien
tgagataactgactgttgaattaag

SEQ ID NO: 669366 - DNA, 25 bp, Homo sapien
gagataactgactgttgaattaaga

SEQ ID NO: 669367 - DNA, 25 bp, Homo sapien
gataactgactgttgaattaagaag

SEQ ID NO: 669368 - DNA, 25 bp, Homo sapien
ataactgactgttgaattaagaaga

SEQ ID NO: 669369 - DNA, 25 bp, Homo sapien
gactgttgaattaagaagagaggcc

SEQ ID NO: 669370 - DNA, 25 bp, Homo sapien
actgttgaattaagaagagaggcct

SEQ ID NO: 669371 - DNA, 25 bp, Homo sapien
gttgaattaagaagagaggcctggc

SEQ ID NO: 669372 - DNA, 25 bp, Homo sapien
agtgtttgaccggaatacctgtagc

SEQ ID NO: 669373 - DNA, 25 bp, Homo sapien
ttgaccggaatacctgtagcatccc

SEQ ID NO: 669374 - DNA, 25 bp, Homo sapien
tgtagcatccccaagtctcagatct

SEQ ID NO: 669375 - DNA, 25 bp, Homo sapien
gtctcagatctctttcattgactac

SEQ ID NO: 669376 - DNA, 25 bp, Homo sapien
tggaagacactagatgacctaaagt

SEQ ID NO: 669377 - DNA, 25 bp, Homo sapien
aaagtgcaaaagtttgaggcttcca

SEQ ID NO: 669378 - DNA, 25 bp, Homo sapien
gtttgaggcttccatctgacagcta

SEQ ID NO: 669379 - DNA, 25 bp, Homo sapien
atctgacagctaaagccaagccaca

SEQ ID NO: 669380 - DNA, 25 bp, Homo sapien
tcttgaccgacaaaggacactgtga

SEQ ID NO: 669381 - DNA, 25 bp, Homo sapien
ctgtgaatcacagtagcgtaaacaa

SEQ ID NO: 669382 - DNA, 25 bp, Homo sapien
tagcgtaaacaagaggccttccttt

SEQ ID NO: 669383 - DNA, 25 bp, Homo sapien
cctttgctgcagatgagtatcctat

SEQ ID NO: 669384 - DNA, 25 bp, Homo sapien
tttgctgcagatgagtatcctatct

SEQ ID NO: 669385 - DNA, 25 bp, Homo sapien
tgctgcagatgagtatcctatctgg

SEQ ID NO: 669386 - DNA, 25 bp, Homo sapien
agatgagtatcctatctggaacagg

SEQ ID NO: 669387 - DNA, 25 bp, Homo sapien
gagtatcctatctggaacaggatga

SEQ ID NO: 669388 - DNA, 25 bp, Homo sapien
tggaacaggatgaacctgccgctct

SEQ ID NO: 669389 - DNA, 25 bp, Homo sapien
ggaacaggatgaacctgccgctcta

SEQ ID NO: 669390 - DNA, 25 bp, Homo sapien
gaacaggatgaacctgccgctctag

SEQ ID NO: 669391 - DNA, 25 bp, Homo sapien
aacaggatgaacctgccgctctaga

SEQ ID NO: 669392 - DNA, 25 bp, Homo sapien
caggatgaacctgccgctctagata

SEQ ID NO: 669393 - DNA, 25 bp, Homo sapien
ggatgaacctgccgctctagatacc

SEQ ID NO: 669394 - DNA, 25 bp, Homo sapien
gtagctaatagctttggataacaat

SEQ ID NO: 669395 - DNA, 25 bp, Homo sapien
ataacaatatatctttccttctcta

SEQ ID NO: 669396 - DNA, 25 bp, Homo sapien
ctttccttctctatgactagaagaa

SEQ ID NO: 669397 - DNA, 25 bp, Homo sapien
aggactccttaataacaaagtctca

SEQ ID NO: 669398 - DNA, 25 bp, Homo sapien
acaaagtctcacacttacttgctct

SEQ ID NO: 669399 - DNA, 25 bp, Homo sapien
aaagtctcacacttacttgctctgt

SEQ ID NO: 669400 - DNA, 25 bp, Homo sapien
agtctcacacttacttgctctgtta

SEQ ID NO: 669401 - DNA, 25 bp, Homo sapien
tcacacttacttgctctgttaaatg

SEQ ID NO: 669402 - DNA, 25 bp, Homo sapien
ttacttgctctgttaaatgtgtgct

SEQ ID NO: 669403 - DNA, 25 bp, Homo sapien
gctttattaaagcacaagaaggttt

SEQ ID NO: 669404 - DNA, 25 bp, Homo sapien
tttgtcggccaaaataaagctaata

SEQ ID NO: 669405 - DNA, 25 bp, Homo sapien
ccaattgatgggtagtagcactgaa

SEQ ID NO: 669406 - DNA, 25 bp, Homo sapien
gggtagtagcactgaaactatgaaa

SEQ ID NO: 669407 - DNA, 25 bp, Homo sapien
gtggatgaactcatccagaggagtt

SEQ ID NO: 669408 - DNA, 25 bp, Homo sapien
gaagactggaaaaggaacacaagga

SEQ ID NO: 669409 - DNA, 25 bp, Homo sapien
cagctgagactgaaggaaaataacg

SEQ ID NO: 669410 - DNA, 25 bp, Homo sapien
aataacgtggtattacagaggccaa

SEQ ID NO: 669411 - DNA, 25 bp, Homo sapien
cgtggtattacagaggccaaaaaat

SEQ ID NO: 669412 - DNA, 25 bp, Homo sapien
aagaagcaagtggttagtggagtta

SEQ ID NO: 669413 - DNA, 25 bp, Homo sapien
tggttagtggagttaaaagctgctg

SEQ ID NO: 669414 - DNA, 25 bp, Homo sapien
aagctgctgatacaacctaaaaaag

SEQ ID NO: 669415 - DNA, 25 bp, Homo sapien
tttattgaatctaagtacctgattg

SEQ ID NO: 669416 - DNA, 25 bp, Homo sapien
aacagtgaacacaagtgcttacttg

SEQ ID NO: 669417 - DNA, 25 bp, Homo sapien
aagtgcttacttgtggatactatct

SEQ ID NO: 669418 - DNA, 25 bp, Homo sapien
gtgcttacttgtggatactatctta

SEQ ID NO: 669419 - DNA, 25 bp, Homo sapien
gcttacttgtggatactatcttacc

SEQ ID NO: 669420 - DNA, 25 bp, Homo sapien
gtggatactatcttaccaacggatc

SEQ ID NO: 669421 - DNA, 25 bp, Homo sapien
gatactatcttaccaacggatcaca

SEQ ID NO: 669422 - DNA, 25 bp, Homo sapien
actatcttaccaacggatcacaaag

SEQ ID NO: 669423 - DNA, 25 bp, Homo sapien
ttaccaacggatcacaaagttctct

SEQ ID NO: 669424 - DNA, 25 bp, Homo sapien
tttggtgtactgttgttgacaggga

SEQ ID NO: 669425 - DNA, 25 bp, Homo sapien
ctgttgttgacagggattgtgtact

SEQ ID NO: 669426 - DNA, 25 bp, Homo sapien
tgtatcctgtgtagtactagatctg

SEQ ID NO: 669427 - DNA, 25 bp, Homo sapien
tctacttccacctggagttgcacag

SEQ ID NO: 669428 - DNA, 25 bp, Homo sapien
ttccacctggagttgcacagtctca

SEQ ID NO: 669429 - DNA, 25 bp, Homo sapien
ctggagttgcacagtctcaggctgg

SEQ ID NO: 669430 - DNA, 25 bp, Homo sapien
tcaggagaggtcacagcccctcagt

SEQ ID NO: 669431 - DNA, 25 bp, Homo sapien
aggagaggtcacagcccctcagtct

SEQ ID NO: 669432 - DNA, 25 bp, Homo sapien
caacacctcgctccatatgatagag

SEQ ID NO: 669433 - DNA, 25 bp, Homo sapien
gctccatatgatagagcgtggcagc

SEQ ID NO: 669434 - DNA, 25 bp, Homo sapien
gtggtgggcccctaaagcaatagca

SEQ ID NO: 669435 - DNA, 25 bp, Homo sapien
gggcccctaaagcaatagcaccgta

SEQ ID NO: 669436 - DNA, 25 bp, Homo sapien
ctaaagcaatagcaccgtaggcccc

SEQ ID NO: 669437 - DNA, 25 bp, Homo sapien
tcttagcacaagaggcccaggccct

SEQ ID NO: 669438 - DNA, 25 bp, Homo sapien
aaggactgtctttttgcagcccata

SEQ ID NO: 669439 - DNA, 25 bp, Homo sapien
tttgcagcccatatggatcagcatt

SEQ ID NO: 669440 - DNA, 25 bp, Homo sapien
gatcagcattccagggagaccaggg

SEQ ID NO: 669441 - DNA, 25 bp, Homo sapien
gaagattctggcattctgggtccat

SEQ ID NO: 669442 - DNA, 25 bp, Homo sapien
tctgggtccatagcgttaaattctt

SEQ ID NO: 669443 - DNA, 25 bp, Homo sapien
aaattcttatttggattacagccga

SEQ ID NO: 669444 - DNA, 25 bp, Homo sapien
gaatcagcagttctggcctgtgatc

SEQ ID NO: 669445 - DNA, 25 bp, Homo sapien
cctgtgatcagggtgcaatattctt

SEQ ID NO: 669446 - DNA, 25 bp, Homo sapien
tattcttattgttctttctcccata

SEQ ID NO: 669447 - DNA, 25 bp, Homo sapien
ggagtttaggtcaaagccttgcttt

SEQ ID NO: 669448 - DNA, 25 bp, Homo sapien
aagccttgcttttttggtatataca

SEQ ID NO: 669449 - DNA, 25 bp, Homo sapien
ttaaacgggtttgatagatataaat

SEQ ID NO: 669450 - DNA, 25 bp, Homo sapien
gatagatataaatttggacccaaga

SEQ ID NO: 669451 - DNA, 25 bp, Homo sapien
tataaatttggacccaagagccctt

SEQ ID NO: 669452 - DNA, 25 bp, Homo sapien
ttttaatcctgaggttttatgctga

SEQ ID NO: 669453 - DNA, 25 bp, Homo sapien
ttaatcctgaggttttatgctgagg

SEQ ID NO: 669454 - DNA, 25 bp, Homo sapien
aatcctgaggttttatgctgaggaa

SEQ ID NO: 669455 - DNA, 25 bp, Homo sapien
tcctgaggttttatgctgaggaaat

SEQ ID NO: 669456 - DNA, 25 bp, Homo sapien
tgaggttttatgctgaggaaatttc

SEQ ID NO: 669457 - DNA, 25 bp, Homo sapien
gttttatgctgaggaaatttctttc

SEQ ID NO: 669458 - DNA, 25 bp, Homo sapien
gaggaaatttctttcaaatctggaa

SEQ ID NO: 669459 - DNA, 25 bp, Homo sapien
atctggaaaacctcggggccaggcg

SEQ ID NO: 669460 - DNA, 25 bp, Homo sapien
ttcctgtagctccaacatgactttg

SEQ ID NO: 669461 - DNA, 25 bp, Homo sapien
cctgtagctccaacatgactttgat

SEQ ID NO: 669462 - DNA, 25 bp, Homo sapien
gtagctccaacatgactttgatctg

SEQ ID NO: 669463 - DNA, 25 bp, Homo sapien
gctccaacatgactttgatctgagt

SEQ ID NO: 669464 - DNA, 25 bp, Homo sapien
ccaacatgactttgatctgagtaat

SEQ ID NO: 669465 - DNA, 25 bp, Homo sapien
acatgactttgatctgagtaatagt

SEQ ID NO: 669466 - DNA, 25 bp, Homo sapien
ctgagtaatagtgttgtgaaataga

SEQ ID NO: 669467 - DNA, 25 bp, Homo sapien
gattactacatgattttcattgctt

SEQ ID NO: 669468 - DNA, 25 bp, Homo sapien
tactacatgattttcattgctttta

SEQ ID NO: 669469 - DNA, 25 bp, Homo sapien
gttgattaactttcttaagtgtcac

SEQ ID NO: 669470 - DNA, 25 bp, Homo sapien
ttaactttcttaagtgtcacataat

SEQ ID NO: 669471 - DNA, 25 bp, Homo sapien
cgtatcttcaccagtgttctatctt

SEQ ID NO: 669472 - DNA, 25 bp, Homo sapien
tcttcaccagtgttctatcttgttc

SEQ ID NO: 669473 - DNA, 25 bp, Homo sapien
ttcaccagtgttctatcttgttccc

SEQ ID NO: 669474 - DNA, 25 bp, Homo sapien
tggagtgacctctagtcgctcagca

SEQ ID NO: 669475 - DNA, 25 bp, Homo sapien
gtgacctctagtcgctcagcatcca

SEQ ID NO: 669476 - DNA, 25 bp, Homo sapien
tcagcatccactttgtgtctccaaa

SEQ ID NO: 669477 - DNA, 25 bp, Homo sapien
gtgtaggactctgtaatcttttgat

SEQ ID NO: 669478 - DNA, 25 bp, Homo sapien
gtaggactctgtaatcttttgatta

SEQ ID NO: 669479 - DNA, 25 bp, Homo sapien
aatcttttgattagtttctgagaaa

SEQ ID NO: 669480 - DNA, 25 bp, Homo sapien
tctgagaaaacacaatgaagcactt

SEQ ID NO: 669481 - DNA, 25 bp, Homo sapien
acacaatgaagcacttcactttttt

SEQ ID NO: 669482 - DNA, 25 bp, Homo sapien
tcttgcatggatggaggtcacagat

SEQ ID NO: 669483 - DNA, 25 bp, Homo sapien
tggatgaattgcagggtctcccaac

SEQ ID NO: 669484 - DNA, 25 bp, Homo sapien
ggtctcccaactcttcaagcagcat

SEQ ID NO: 669485 - DNA, 25 bp, Homo sapien
tcatctctactcctgaactacagtg

SEQ ID NO: 669486 - DNA, 25 bp, Homo sapien
gaactacagtgccatcttgtcattt

SEQ ID NO: 669487 - DNA, 25 bp, Homo sapien
gtcatttgtctgtttcaatgtctgt

SEQ ID NO: 669488 - DNA, 25 bp, Homo sapien
tgtctgtttcaatgtctgtttctcc

SEQ ID NO: 669489 - DNA, 25 bp, Homo sapien
tctccaactggacagtaaacccttg

SEQ ID NO: 669490 - DNA, 25 bp, Homo sapien
tcttatttaaatttggtatcctcag

SEQ ID NO: 669491 - DNA, 25 bp, Homo sapien
caggacagtgcctggtactttccag

SEQ ID NO: 669492 - DNA, 25 bp, Homo sapien
tttccaggtcctcattaaatgtttt

SEQ ID NO: 669493 - DNA, 25 bp, Homo sapien
gctggagttttaacactgtaccctt

SEQ ID NO: 669494 - DNA, 25 bp, Homo sapien
gagttttaacactgtacccttgata

SEQ ID NO: 669495 - DNA, 25 bp, Homo sapien
gtacccttgatacagcgatccatag

SEQ ID NO: 669496 - DNA, 25 bp, Homo sapien
acagcgatccatagttgcaatctaa

SEQ ID NO: 669497 - DNA, 25 bp, Homo sapien
tatttgacccattttaatgtgtaca

SEQ ID NO: 669498 - DNA, 25 bp, Homo sapien
gtatggttatgtggttacctatttt

SEQ ID NO: 669499 - DNA, 25 bp, Homo sapien
cctttacctcatatgcagctgtggt

SEQ ID NO: 669500 - DNA, 25 bp, Homo sapien
cctcatatgcagctgtggtagaaat

SEQ ID NO: 669501 - DNA, 25 bp, Homo sapien
gtcactgagtatgagaacctttcgc

SEQ ID NO: 669502 - DNA, 25 bp, Homo sapien
gagaacctttcgcagatttcacatg

SEQ ID NO: 669503 - DNA, 25 bp, Homo sapien
tttcgcagatttcacatgatctttt

SEQ ID NO: 669504 - DNA, 25 bp, Homo sapien
acagagaggttagcactggataata

SEQ ID NO: 669505 - DNA, 25 bp, Homo sapien
cagagaggttagcactggataataa

SEQ ID NO: 669506 - DNA, 25 bp, Homo sapien
agagaggttagcactggataataat

SEQ ID NO: 669507 - DNA, 25 bp, Homo sapien
gagaggttagcactggataataatt

SEQ ID NO: 669508 - DNA, 25 bp, Homo sapien
agaggttagcactggataataatta

SEQ ID NO: 669509 - DNA, 25 bp, Homo sapien
gaggttagcactggataataattag

SEQ ID NO: 669510 - DNA, 25 bp, Homo sapien
aggttagcactggataataattagt

SEQ ID NO: 669511 - DNA, 25 bp, Homo sapien
ggttagcactggataataattagta

SEQ ID NO: 669512 - DNA, 25 bp, Homo sapien
gttagcactggataataattagtaa

SEQ ID NO: 669513 - DNA, 25 bp, Homo sapien
ttagcactggataataattagtaag

SEQ ID NO: 669514 - DNA, 25 bp, Homo sapien
agcactggataataattagtaaggc

SEQ ID NO: 669515 - DNA, 25 bp, Homo sapien
gcttcctcagctggaagctttactc

SEQ ID NO: 669516 - DNA, 25 bp, Homo sapien
ttactccctcctcgacagaaagtga

SEQ ID NO: 669517 - DNA, 25 bp, Homo sapien
cagatgacatggatcaggtggagct

SEQ ID NO: 669518 - DNA, 25 bp, Homo sapien
gagctgaaggagttttgtcccaatg

SEQ ID NO: 669519 - DNA, 25 bp, Homo sapien
aaggagttttgtcccaatgagcaga

SEQ ID NO: 669520 - DNA, 25 bp, Homo sapien
gaaggaatgcccatctacaaagcac

SEQ ID NO: 669521 - DNA, 25 bp, Homo sapien
atctacaaagcacccctggaaaaag

SEQ ID NO: 669522 - DNA, 25 bp, Homo sapien
aagggattctgatcatacagttttt

SEQ ID NO: 669523 - DNA, 25 bp, Homo sapien
tacagtttttagtaatctttcctga

SEQ ID NO: 669524 - DNA, 25 bp, Homo sapien
atctttcctgaaaaacactggcttt

SEQ ID NO: 669525 - DNA, 25 bp, Homo sapien
tcctgaaaaacactggctttctctg

SEQ ID NO: 669526 - DNA, 25 bp, Homo sapien
ttttaaaaacttgcagcgcaaagct

SEQ ID NO: 669527 - DNA, 25 bp, Homo sapien
taaaaacttgcagcgcaaagctatt

SEQ ID NO: 669528 - DNA, 25 bp, Homo sapien
agcgcaaagctattggttgctgcat

SEQ ID NO: 669529 - DNA, 25 bp, Homo sapien
caaagctattggttgctgcattcaa

SEQ ID NO: 669530 - DNA, 25 bp, Homo sapien
aagctattggttgctgcattcaatc

SEQ ID NO: 669531 - DNA, 25 bp, Homo sapien
gctattggttgctgcattcaatcta

SEQ ID NO: 669532 - DNA, 25 bp, Homo sapien
ttggttgctgcattcaatctagagt

SEQ ID NO: 669533 - DNA, 25 bp, Homo sapien
gttgctgcattcaatctagagtaga

SEQ ID NO: 669534 - DNA, 25 bp, Homo sapien
gctgcattcaatctagagtagagaa

SEQ ID NO: 669535 - DNA, 25 bp, Homo sapien
gaataacccaaatgatcaacaattt

SEQ ID NO: 669536 - DNA, 25 bp, Homo sapien
tattataacatccactcaaagaaat

SEQ ID NO: 669537 - DNA, 25 bp, Homo sapien
agccgagatcgcactgctgtaccca

SEQ ID NO: 669538 - DNA, 25 bp, Homo sapien
gccgagatcgcactgctgtacccag

SEQ ID NO: 669539 - DNA, 25 bp, Homo sapien
ccgagatcgcactgctgtacccagc

SEQ ID NO: 669540 - DNA, 25 bp, Homo sapien
cgagatcgcactgctgtacccagcc

SEQ ID NO: 669541 - DNA, 25 bp, Homo sapien
gagatcgcactgctgtacccagcct

SEQ ID NO: 669542 - DNA, 25 bp, Homo sapien
agatcgcactgctgtacccagcctg

SEQ ID NO: 669543 - DNA, 25 bp, Homo sapien
atcgcactgctgtacccagcctggg

SEQ ID NO: 669544 - DNA, 25 bp, Homo sapien
tcgcactgctgtacccagcctgggc

SEQ ID NO: 669545 - DNA, 25 bp, Homo sapien
cgcactgctgtacccagcctgggcc

SEQ ID NO: 669546 - DNA, 25 bp, Homo sapien
cactgctgtacccagcctgggccac

SEQ ID NO: 669547 - DNA, 25 bp, Homo sapien
actgctgtacccagcctgggccaca

SEQ ID NO: 669548 - DNA, 25 bp, Homo sapien
ggcaggattaaaccaatttgcaact

SEQ ID NO: 669549 - DNA, 25 bp, Homo sapien
acttgagtacaaatgccaatatttc

SEQ ID NO: 669550 - DNA, 25 bp, Homo sapien
ttttaacctaatgaccaaacacctg

SEQ ID NO: 669551 - DNA, 25 bp, Homo sapien
aacctaatgaccaaacacctgacag

SEQ ID NO: 669552 - DNA, 25 bp, Homo sapien
aacacctgacaggaatggaattcac

SEQ ID NO: 669553 - DNA, 25 bp, Homo sapien
ggaatggaattcactggacttgtat

SEQ ID NO: 669554 - DNA, 25 bp, Homo sapien
tggaattcactggacttgtatctaa

SEQ ID NO: 669555 - DNA, 25 bp, Homo sapien
tttattgccattgtgacctttatcc

SEQ ID NO: 669556 - DNA, 25 bp, Homo sapien
ttgccattgtgacctttatccacac

SEQ ID NO: 669557 - DNA, 25 bp, Homo sapien
ttgtgacctttatccacacactaac

SEQ ID NO: 669558 - DNA, 25 bp, Homo sapien
ccacacactaacctggaaagtatag

SEQ ID NO: 669559 - DNA, 25 bp, Homo sapien
aaagtctcagaaagctatccaggat

SEQ ID NO: 669560 - DNA, 25 bp, Homo sapien
agctatccaggatgaaatccgttca

SEQ ID NO: 669561 - DNA, 25 bp, Homo sapien
gaaatccgttcagtgatcagacaga

SEQ ID NO: 669562 - DNA, 25 bp, Homo sapien
gatcagacagatcacagctacggtg

SEQ ID NO: 669563 - DNA, 25 bp, Homo sapien
agctacggtgacatttctgccactg

SEQ ID NO: 669564 - DNA, 25 bp, Homo sapien
ttctgccactgttggaagtttcttg

SEQ ID NO: 669565 - DNA, 25 bp, Homo sapien
gacaaagatttggttgtacctgaaa

SEQ ID NO: 669566 - DNA, 25 bp, Homo sapien
ggaagagtcgggaccacagtttatt

SEQ ID NO: 669567 - DNA, 25 bp, Homo sapien
aattctgaggaagtccgccttcgtt

SEQ ID NO: 669568 - DNA, 25 bp, Homo sapien
cgccttcgttcatttactactacaa

SEQ ID NO: 669569 - DNA, 25 bp, Homo sapien
ctacaaaattcctgtcaatgactga

SEQ ID NO: 669570 - DNA, 25 bp, Homo sapien
gttagcatactcgtgtttgttcagc

SEQ ID NO: 669571 - DNA, 25 bp, Homo sapien
gtttgttcagctgtccatcctgcat

SEQ ID NO: 669572 - DNA, 25 bp, Homo sapien
tccatcctgcatcgttactacaatg

SEQ ID NO: 669573 - DNA, 25 bp, Homo sapien
atgcctttttctgccatttaatggt

SEQ ID NO: 669574 - DNA, 25 bp, Homo sapien
ggtgtttgtatcaatgttcccatat

SEQ ID NO: 669575 - DNA, 25 bp, Homo sapien
atgttcccatatctgctgcatttta

SEQ ID NO: 669576 - DNA, 25 bp, Homo sapien
tatctgctgcattttaactccataa

SEQ ID NO: 669577 - DNA, 25 bp, Homo sapien
catacctatatgcatgtagtagtct

SEQ ID NO: 669578 - DNA, 25 bp, Homo sapien
gtagtagtctgtacaattgttcaac

SEQ ID NO: 669579 - DNA, 25 bp, Homo sapien
aaattgctggcattgttctccattt

SEQ ID NO: 669580 - DNA, 25 bp, Homo sapien
attgttctccatttcagtctggtag

SEQ ID NO: 669581 - DNA, 25 bp, Homo sapien
ggacagacaaaccagagcctctgcg

SEQ ID NO: 669582 - DNA, 25 bp, Homo sapien
gcctctgcgcctccacagggaaaag

SEQ ID NO: 669583 - DNA, 25 bp, Homo sapien
ggcttccaggccagttggcccaggc

SEQ ID NO: 669584 - DNA, 25 bp, Homo sapien
gcctgggcagagaccctgtaggatg

SEQ ID NO: 669585 - DNA, 25 bp, Homo sapien
gggttgcctgcagggacttttgctc

SEQ ID NO: 669586 - DNA, 25 bp, Homo sapien
gggacttttgctctgctgtcctgga

SEQ ID NO: 669587 - DNA, 25 bp, Homo sapien
tggaccctgtgtgcctcataagggc

SEQ ID NO: 669588 - DNA, 25 bp, Homo sapien
gtgtgcctcataagggctattcttt

SEQ ID NO: 669589 - DNA, 25 bp, Homo sapien
ggctattctttctttcacgtgcaaa

SEQ ID NO: 669590 - DNA, 25 bp, Homo sapien
ctttctttcacgtgcaaaacatttt

SEQ ID NO: 669591 - DNA, 25 bp, Homo sapien
acaacctacatgtttgctgataaaa

SEQ ID NO: 669592 - DNA, 25 bp, Homo sapien
cctccatcaaagtgactctccatgg

SEQ ID NO: 669593 - DNA, 25 bp, Homo sapien
atcaaagtgactctccatggagaag

SEQ ID NO: 669594 - DNA, 25 bp, Homo sapien
gcagatgggtggatttgagtctcat

SEQ ID NO: 669595 - DNA, 25 bp, Homo sapien
gatgggtggatttgagtctcatttc

SEQ ID NO: 669596 - DNA, 25 bp, Homo sapien
catttctgtcactatttagctttgg

SEQ ID NO: 669597 - DNA, 25 bp, Homo sapien
gtcactatttagctttggaaactta

SEQ ID NO: 669598 - DNA, 25 bp, Homo sapien
ttggaaacttaatcaccacatgtga

SEQ ID NO: 669599 - DNA, 25 bp, Homo sapien
tcaccacatgtgatccaaatgtctt

SEQ ID NO: 669600 - DNA, 25 bp, Homo sapien
catgtgatccaaatgtcttatctgt

SEQ ID NO: 669601 - DNA, 25 bp, Homo sapien
gatgaacataataatgacgacttga

SEQ ID NO: 669602 - DNA, 25 bp, Homo sapien
aatgacgacttgatacaattgtgcc

SEQ ID NO: 669603 - DNA, 25 bp, Homo sapien
gcctcattttcctagaaatctaatt

SEQ ID NO: 669604 - DNA, 25 bp, Homo sapien
gtcttcttggagctgtaggtcttga

SEQ ID NO: 669605 - DNA, 25 bp, Homo sapien
gtaggtcttgaagcagcaacgtctt

SEQ ID NO: 669606 - DNA, 25 bp, Homo sapien
cttgaagcagcaacgtctttcaggg

SEQ ID NO: 669607 - DNA, 25 bp, Homo sapien
gagacagaaacccattctccaatct

SEQ ID NO: 669608 - DNA, 25 bp, Homo sapien
ccattctccaatctcagtagttttt

SEQ ID NO: 669609 - DNA, 25 bp, Homo sapien
atctcagtagttttttcgaaaggct

SEQ ID NO: 669610 - DNA, 25 bp, Homo sapien
gttttttcgaaaggctgtgatcatt

SEQ ID NO: 669611 - DNA, 25 bp, Homo sapien
attgatcgtgatatgacttgttact

SEQ ID NO: 669612 - DNA, 25 bp, Homo sapien
atgacttgttactagggtactgaaa

SEQ ID NO: 669613 - DNA, 25 bp, Homo sapien
gtctaaggcctttacagaaacattt

SEQ ID NO: 669614 - DNA, 25 bp, Homo sapien
atgaggggccctttccagttgtctt

SEQ ID NO: 669615 - DNA, 25 bp, Homo sapien
tccagttgtcttccccacaagcgtt

SEQ ID NO: 669616 - DNA, 25 bp, Homo sapien
aagcgttttcccagggcctccgatg

SEQ ID NO: 669617 - DNA, 25 bp, Homo sapien
ccttctctgcggacatcgccaggag

SEQ ID NO: 669618 - DNA, 25 bp, Homo sapien
cttcctgcggccattgtgattttta

SEQ ID NO: 669619 - DNA, 25 bp, Homo sapien
ttcctgcggccattgtgatttttag

SEQ ID NO: 669620 - DNA, 25 bp, Homo sapien
tcctgcggccattgtgatttttagg

SEQ ID NO: 669621 - DNA, 25 bp, Homo sapien
ctgcggccattgtgatttttagggt

SEQ ID NO: 669622 - DNA, 25 bp, Homo sapien
gcggccattgtgatttttagggtca

SEQ ID NO: 669623 - DNA, 25 bp, Homo sapien
tagggtcagaaaattatttggaaat

SEQ ID NO: 669624 - DNA, 25 bp, Homo sapien
ttctatacattttttcttgagtgtt

SEQ ID NO: 669625 - DNA, 25 bp, Homo sapien
ggaaaaataccaccggagctctctg

SEQ ID NO: 669626 - DNA, 25 bp, Homo sapien
accaccggagctctctgcagctgga

SEQ ID NO: 669627 - DNA, 25 bp, Homo sapien
tctgcagctggagtggaataattct

SEQ ID NO: 669628 - DNA, 25 bp, Homo sapien
gaagtgtgtgttttgcctcctttcc

SEQ ID NO: 669629 - DNA, 25 bp, Homo sapien
tgtgttttgcctcctttcccagtgt

SEQ ID NO: 669630 - DNA, 25 bp, Homo sapien
gggttaagctctggtcgcctgctcc

SEQ ID NO: 669631 - DNA, 25 bp, Homo sapien
tggtcgcctgctcctgttgctggtc

SEQ ID NO: 669632 - DNA, 25 bp, Homo sapien
tcctgttgctggtcttgtggcacac

SEQ ID NO: 669633 - DNA, 25 bp, Homo sapien
tcttgtggcacacacgtggcaggat

SEQ ID NO: 669634 - DNA, 25 bp, Homo sapien
acacgtggcaggatgtcaccctttc

SEQ ID NO: 669635 - DNA, 25 bp, Homo sapien
atgtcaccctttccctgggttgcgt

SEQ ID NO: 669636 - DNA, 25 bp, Homo sapien
atctctaacatatgatactgatgcc

SEQ ID NO: 669637 - DNA, 25 bp, Homo sapien
ctgatgccatgtaaaggcctttaat

SEQ ID NO: 669638 - DNA, 25 bp, Homo sapien
aaggcctttaataagtcattgaaat

SEQ ID NO: 669639 - DNA, 25 bp, Homo sapien
gaaatttactgtgagactgtatgtt

SEQ ID NO: 669640 - DNA, 25 bp, Homo sapien
aactgattagtattcaggcactgag

SEQ ID NO: 669641 - DNA, 25 bp, Homo sapien
ggatacaatgtataagctactcact

SEQ ID NO: 669642 - DNA, 25 bp, Homo sapien
aagctactcacttatctgatactta

SEQ ID NO: 669643 - DNA, 25 bp, Homo sapien
atctgatacttatttacctataaaa

SEQ ID NO: 669644 - DNA, 25 bp, Homo sapien
tttttgttttccactgtgctattac

SEQ ID NO: 669645 - DNA, 25 bp, Homo sapien
tccactgtgctattacaaattttct

SEQ ID NO: 669646 - DNA, 25 bp, Homo sapien
gtaggaactcttaagcaatggtaat

SEQ ID NO: 669647 - DNA, 25 bp, Homo sapien
acctctggtcaagagaattctttgt

SEQ ID NO: 669648 - DNA, 25 bp, Homo sapien
tttgtttctttctctattatttatt

SEQ ID NO: 669649 - DNA, 25 bp, Homo sapien
taagagaactctttataaggtcaaa

SEQ ID NO: 669650 - DNA, 25 bp, Homo sapien
tttataaggtcaaagagcagatgat

SEQ ID NO: 669651 - DNA, 25 bp, Homo sapien
atgattaacctggaagttcaaaaca

SEQ ID NO: 669652 - DNA, 25 bp, Homo sapien
ttaacctggaagttcaaaacattgt

SEQ ID NO: 669653 - DNA, 25 bp, Homo sapien
acctggaagttcaaaacattgtagc

SEQ ID NO: 669654 - DNA, 25 bp, Homo sapien
ggaagttcaaaacattgtagcaaga

SEQ ID NO: 669655 - DNA, 25 bp, Homo sapien
gttcaaaacattgtagcaagaatat

SEQ ID NO: 669656 - DNA, 25 bp, Homo sapien
tacaattttagattggagccaggtg

SEQ ID NO: 669657 - DNA, 25 bp, Homo sapien
aattttagattggagccaggtggtg

SEQ ID NO: 669658 - DNA, 25 bp, Homo sapien
ttccttgagctagttattctttcct

SEQ ID NO: 669659 - DNA, 25 bp, Homo sapien
gctagttattctttcctggcttaca

SEQ ID NO: 669660 - DNA, 25 bp, Homo sapien
tttcctggcttacatgggaggcaga

SEQ ID NO: 669661 - DNA, 25 bp, Homo sapien
acatcattgtattggaaagtttccc

SEQ ID NO: 669662 - DNA, 25 bp, Homo sapien
agtttcccttaaatggctctttatg

SEQ ID NO: 669663 - DNA, 25 bp, Homo sapien
ggctctttatgtggcagatagttgt

SEQ ID NO: 669664 - DNA, 25 bp, Homo sapien
agagttttcagctttgttccattaa

SEQ ID NO: 669665 - DNA, 25 bp, Homo sapien
gttccattaacacagcattttgttg

SEQ ID NO: 669666 - DNA, 25 bp, Homo sapien
aaaagttgttggcacagtctcctct

SEQ ID NO: 669667 - DNA, 25 bp, Homo sapien
tgctgttccaactctgcttagataa

SEQ ID NO: 669668 - DNA, 25 bp, Homo sapien
actctgcttagataaaccatggaaa

SEQ ID NO: 669669 - DNA, 25 bp, Homo sapien
aagaggctatggagatccatatgga

SEQ ID NO: 669670 - DNA, 25 bp, Homo sapien
agaggctatggagatccatatggag

SEQ ID NO: 669671 - DNA, 25 bp, Homo sapien
gaggctatggagatccatatggagg

SEQ ID NO: 669672 - DNA, 25 bp, Homo sapien
atggagatccatatggaggaggtgg

SEQ ID NO: 669673 - DNA, 25 bp, Homo sapien
tggagatccatatggaggaggtggt

SEQ ID NO: 669674 - DNA, 25 bp, Homo sapien
gtggaggaggtggatatagaagata

SEQ ID NO: 669675 - DNA, 25 bp, Homo sapien
tggaggaggtggatatagaagatac

SEQ ID NO: 669676 - DNA, 25 bp, Homo sapien
ggaggaggtggatatagaagatact

SEQ ID NO: 669677 - DNA, 25 bp, Homo sapien
gaggaggtggatatagaagatacta

SEQ ID NO: 669678 - DNA, 25 bp, Homo sapien
aggaggtggatatagaagatactaa

SEQ ID NO: 669679 - DNA, 25 bp, Homo sapien
ggtggatatagaagatactaaaaac

SEQ ID NO: 669680 - DNA, 25 bp, Homo sapien
tgaataggtttcagaatgaccatgt

SEQ ID NO: 669681 - DNA, 25 bp, Homo sapien
gaataggtttcagaatgaccatgtt

SEQ ID NO: 669682 - DNA, 25 bp, Homo sapien
aataggtttcagaatgaccatgttc

SEQ ID NO: 669683 - DNA, 25 bp, Homo sapien
tttcagaatgaccatgttcaaaaag

SEQ ID NO: 669684 - DNA, 25 bp, Homo sapien
ttcagaatgaccatgttcaaaaaga

SEQ ID NO: 669685 - DNA, 25 bp, Homo sapien
atgttcaaaaagagatgtgtggctg

SEQ ID NO: 669686 - DNA, 25 bp, Homo sapien
gttcaaaaagagatgtgtggctgga

SEQ ID NO: 669687 - DNA, 25 bp, Homo sapien
tcaaaaagagatgtgtggctggatg

SEQ ID NO: 669688 - DNA, 25 bp, Homo sapien
aaaagagatgtgtggctggatgcgg

SEQ ID NO: 669689 - DNA, 25 bp, Homo sapien
tgagccctgatatcatgtcactgca

SEQ ID NO: 669690 - DNA, 25 bp, Homo sapien
gagccctgatatcatgtcactgcac

SEQ ID NO: 669691 - DNA, 25 bp, Homo sapien
ttaaacgggtttgatagatataaat

SEQ ID NO: 669692 - DNA, 25 bp, Homo sapien
gatagatataaatttggacccaaga

SEQ ID NO: 669693 - DNA, 25 bp, Homo sapien
gatataaatttggacccaagagccc

SEQ ID NO: 669694 - DNA, 25 bp, Homo sapien
tataaatttggacccaagagccctt

SEQ ID NO: 669695 - DNA, 25 bp, Homo sapien
ttttaatcctgaggttttatgctga

SEQ ID NO: 669696 - DNA, 25 bp, Homo sapien
ttaatcctgaggttttatgctgagg

SEQ ID NO: 669697 - DNA, 25 bp, Homo sapien
aatcctgaggttttatgctgaggaa

SEQ ID NO: 669698 - DNA, 25 bp, Homo sapien
atcctgaggttttatgctgaggaaa

SEQ ID NO: 669699 - DNA, 25 bp, Homo sapien
ctgaggttttatgctgaggaaattt

SEQ ID NO: 669700 - DNA, 25 bp, Homo sapien
tgaggttttatgctgaggaaatttc

SEQ ID NO: 669701 - DNA, 25 bp, Homo sapien
atctggaaaacctcggggccaggcg

SEQ ID NO: 669702 - DNA, 25 bp, Homo sapien
aatattttatagacagtgtactaat

SEQ ID NO: 669703 - DNA, 25 bp, Homo sapien
aattataaattgtacatggctgtcc

SEQ ID NO: 669704 - DNA, 25 bp, Homo sapien
atggctgtccattaaaatcaactgc

SEQ ID NO: 669705 - DNA, 25 bp, Homo sapien
gctgtccattaaaatcaactgcctt

SEQ ID NO: 669706 - DNA, 25 bp, Homo sapien
tgtccattaaaatcaactgcctttg

SEQ ID NO: 669707 - DNA, 25 bp, Homo sapien
tcaactgcctttgaatcactgacca

SEQ ID NO: 669708 - DNA, 25 bp, Homo sapien
aactgcctttgaatcactgaccaga

SEQ ID NO: 669709 - DNA, 25 bp, Homo sapien
tgcctttgaatcactgaccagaaca

SEQ ID NO: 669710 - DNA, 25 bp, Homo sapien
tttgaatcactgaccagaacagatt

SEQ ID NO: 669711 - DNA, 25 bp, Homo sapien
gaccagaacagattaacttcagaag

SEQ ID NO: 669712 - DNA, 25 bp, Homo sapien
atttcaacttagctttactatagta

SEQ ID NO: 669713 - DNA, 25 bp, Homo sapien
gtgtctgccaaggttttcatagaca

SEQ ID NO: 669714 - DNA, 25 bp, Homo sapien
caaggttttcatagacaagcagaca

SEQ ID NO: 669715 - DNA, 25 bp, Homo sapien
aagcagacaaacctgagcaagtgtt

SEQ ID NO: 669716 - DNA, 25 bp, Homo sapien
ggttttgtaagttacgacaatcctg

SEQ ID NO: 669717 - DNA, 25 bp, Homo sapien
ttacgacaatcctgtttcggcccaa

SEQ ID NO: 669718 - DNA, 25 bp, Homo sapien
tgtttcggcccaagctgccatccag

SEQ ID NO: 669719 - DNA, 25 bp, Homo sapien
ccagtccatgaacggctttcagatt

SEQ ID NO: 669720 - DNA, 25 bp, Homo sapien
ctttcagattggcatgaagcggctt

SEQ ID NO: 669721 - DNA, 25 bp, Homo sapien
gaagcggcttaaagtgcagctcaaa

SEQ ID NO: 669722 - DNA, 25 bp, Homo sapien
aagtgcagctcaaacgttcgaagaa

SEQ ID NO: 669723 - DNA, 25 bp, Homo sapien
gttcgaagaatgacagcaagcccta

SEQ ID NO: 669724 - DNA, 25 bp, Homo sapien
tcagaggttgattctcttggaatta

SEQ ID NO: 669725 - DNA, 25 bp, Homo sapien
aattatttgacctgaggccatagga

SEQ ID NO: 669726 - DNA, 25 bp, Homo sapien
ttgacctgaggccataggaaagcaa

SEQ ID NO: 669727 - DNA, 25 bp, Homo sapien
aaagtcacgtttgacatgccagcct

SEQ ID NO: 669728 - DNA, 25 bp, Homo sapien
ggagctggacattggatacccgtgt

SEQ ID NO: 669729 - DNA, 25 bp, Homo sapien
ggacattggatacccgtgtgagcct

SEQ ID NO: 669730 - DNA, 25 bp, Homo sapien
atacccgtgtgagcctcgtggaaca

SEQ ID NO: 669731 - DNA, 25 bp, Homo sapien
gagcctcgtggaacaccataatcaa

SEQ ID NO: 669732 - DNA, 25 bp, Homo sapien
tctaaactgatgcatgaggacccca

SEQ ID NO: 669733 - DNA, 25 bp, Homo sapien
atgaggaccccagtgagcaatattc

SEQ ID NO: 669734 - DNA, 25 bp, Homo sapien
gtgagcaatattccccaaggcaaat

SEQ ID NO: 669735 - DNA, 25 bp, Homo sapien
gttgttgtcataatgagtacagcat

SEQ ID NO: 669736 - DNA, 25 bp, Homo sapien
gtacagcatgaaaggcttcctctac

SEQ ID NO: 669737 - DNA, 25 bp, Homo sapien
ttcctctacaagacactagtcaaag

SEQ ID NO: 669738 - DNA, 25 bp, Homo sapien
aagagttgagagctgcggtttctaa

SEQ ID NO: 669739 - DNA, 25 bp, Homo sapien
agctgcggtttctaatctttgtcca

SEQ ID NO: 669740 - DNA, 25 bp, Homo sapien
taatctttgtccattactcccttac

SEQ ID NO: 669741 - DNA, 25 bp, Homo sapien
tcccttactccctatgagactgtgg

SEQ ID NO: 669742 - DNA, 25 bp, Homo sapien
gagactgtggacctgtcacttggcc

SEQ ID NO: 669743 - DNA, 25 bp, Homo sapien
tggcctctctggtcttcagttttct

SEQ ID NO: 669744 - DNA, 25 bp, Homo sapien
ggaacttgaaccaaatgacctctag

SEQ ID NO: 669745 - DNA, 25 bp, Homo sapien
aaatgacctctagtgttccccttgg

SEQ ID NO: 669746 - DNA, 25 bp, Homo sapien
aaagttatatgcatttatcatgtac

SEQ ID NO: 669747 - DNA, 25 bp, Homo sapien
agttatatgcatttatcatgtacaa

SEQ ID NO: 669748 - DNA, 25 bp, Homo sapien
atatgcatttatcatgtacaacatg

SEQ ID NO: 669749 - DNA, 25 bp, Homo sapien
catgtacaacatgaggttttgaaat

SEQ ID NO: 669750 - DNA, 25 bp, Homo sapien
ttgaaatatagatacattgtggaat

SEQ ID NO: 669751 - DNA, 25 bp, Homo sapien
acatatgtattacatcatatactta

SEQ ID NO: 669752 - DNA, 25 bp, Homo sapien
cttaaaatccattctcttgactatt

SEQ ID NO: 669753 - DNA, 25 bp, Homo sapien
aaaatccattctcttgactattttc

SEQ ID NO: 669754 - DNA, 25 bp, Homo sapien
atccattctcttgactattttcaag

SEQ ID NO: 669755 - DNA, 25 bp, Homo sapien
gactattttcaagaatataatgcat

SEQ ID NO: 669756 - DNA, 25 bp, Homo sapien
atataatgcattgttgttaactgta

SEQ ID NO: 669757 - DNA, 25 bp, Homo sapien
ttgtgaatatacacatttttctggg

SEQ ID NO: 669758 - DNA, 25 bp, Homo sapien
agagtgccggtgttggagacttacc

SEQ ID NO: 669759 - DNA, 25 bp, Homo sapien
agtgccggtgttggagacttaccta

SEQ ID NO: 669760 - DNA, 25 bp, Homo sapien
gccggtgttggagacttacctagtc

SEQ ID NO: 669761 - DNA, 25 bp, Homo sapien
tgttggagacttacctagtctcccc

SEQ ID NO: 669762 - DNA, 25 bp, Homo sapien
agccaccttcaagcaatcacccctt

SEQ ID NO: 669763 - DNA, 25 bp, Homo sapien
ccagtagtttggtgcccctcagacc

SEQ ID NO: 669764 - DNA, 25 bp, Homo sapien
cctcagaccttcctacataaaaact

SEQ ID NO: 669765 - DNA, 25 bp, Homo sapien
tacataaaaactgggggcctctact

SEQ ID NO: 669766 - DNA, 25 bp, Homo sapien
gggcctctactagagaggactcaga

SEQ ID NO: 669767 - DNA, 25 bp, Homo sapien
gactcagagctgtaatcatattttc

SEQ ID NO: 669768 - DNA, 25 bp, Homo sapien
cctctgagataactgactgttgaat

SEQ ID NO: 669769 - DNA, 25 bp, Homo sapien
ctctgagataactgactgttgaatt

SEQ ID NO: 669770 - DNA, 25 bp, Homo sapien
tctgagataactgactgttgaatta

SEQ ID NO: 669771 - DNA, 25 bp, Homo sapien
ctgagataactgactgttgaattaa

SEQ ID NO: 669772 - DNA, 25 bp, Homo sapien
gagataactgactgttgaattaaga

SEQ ID NO: 669773 - DNA, 25 bp, Homo sapien
gataactgactgttgaattaagaag

SEQ ID NO: 669774 - DNA, 25 bp, Homo sapien
ataactgactgttgaattaagaaga

SEQ ID NO: 669775 - DNA, 25 bp, Homo sapien
gactgttgaattaagaagagaggcc

SEQ ID NO: 669776 - DNA, 25 bp, Homo sapien
gttgaattaagaagagaggcctggc

SEQ ID NO: 669777 - DNA, 25 bp, Homo sapien
attaagaagagaggcctggccggac

SEQ ID NO: 669778 - DNA, 25 bp, Homo sapien
gaagagaggcctggccggacacagt

SEQ ID NO: 669779 - DNA, 25 bp, Homo sapien
gggctctggtaagtgactgccattg

SEQ ID NO: 669780 - DNA, 25 bp, Homo sapien
taagtgactgccattggtccctcag

SEQ ID NO: 669781 - DNA, 25 bp, Homo sapien
cacatgctctgatgcccatagacca

SEQ ID NO: 669782 - DNA, 25 bp, Homo sapien
tgctctgatgcccatagaccacatt

SEQ ID NO: 669783 - DNA, 25 bp, Homo sapien
atgactgcccgctgaacctgtctga

SEQ ID NO: 669784 - DNA, 25 bp, Homo sapien
tgcccgctgaacctgtctgattctg

SEQ ID NO: 669785 - DNA, 25 bp, Homo sapien
tgattctggaactacctccccatac

SEQ ID NO: 669786 - DNA, 25 bp, Homo sapien
ttgattttaactgattcctctcctg

SEQ ID NO: 669787 - DNA, 25 bp, Homo sapien
aataaaccctttggcggagactgag

SEQ ID NO: 669788 - DNA, 25 bp, Homo sapien
aaccctttggcggagactgagataa

SEQ ID NO: 669789 - DNA, 25 bp, Homo sapien
tttggcggagactgagataacccac

SEQ ID NO: 669790 - DNA, 25 bp, Homo sapien
acaaaagttatatgcatttatcatg

SEQ ID NO: 669791 - DNA, 25 bp, Homo sapien
caaaagttatatgcatttatcatgt

SEQ ID NO: 669792 - DNA, 25 bp, Homo sapien
aaaagttatatgcatttatcatgta

SEQ ID NO: 669793 - DNA, 25 bp, Homo sapien
aaagttatatgcatttatcatgtac

SEQ ID NO: 669794 - DNA, 25 bp, Homo sapien
aagttatatgcatttatcatgtaca

SEQ ID NO: 669795 - DNA, 25 bp, Homo sapien
agttatatgcatttatcatgtacaa

SEQ ID NO: 669796 - DNA, 25 bp, Homo sapien
ttgaaatatagatacattgtggaat

SEQ ID NO: 669797 - DNA, 25 bp, Homo sapien
acatatgtattacatcatatactta

SEQ ID NO: 669798 - DNA, 25 bp, Homo sapien
catatgtattacatcatatacttat

SEQ ID NO: 669799 - DNA, 25 bp, Homo sapien
atatgtattacatcatatacttatt

SEQ ID NO: 669800 - DNA, 25 bp, Homo sapien
atataatgcattgttgttaactgta

SEQ ID NO: 669801 - DNA, 25 bp, Homo sapien
atatctgaatacttgccttcttggc

SEQ ID NO: 669802 - DNA, 25 bp, Homo sapien
gccttcttggcatttatacattcaa

SEQ ID NO: 669803 - DNA, 25 bp, Homo sapien
tttatacattcaaagctcagtgcta

SEQ ID NO: 669804 - DNA, 25 bp, Homo sapien
ctcagtgctagattagagctattat

SEQ ID NO: 669805 - DNA, 25 bp, Homo sapien
gagctattatttgcatagtcttttg

SEQ ID NO: 669806 - DNA, 25 bp, Homo sapien
agtcttttggtattgcccacttttg

SEQ ID NO: 669807 - DNA, 25 bp, Homo sapien
gcccacttttggcattaccatatta

SEQ ID NO: 669808 - DNA, 25 bp, Homo sapien
atgttgacttcaagggttccatttg

SEQ ID NO: 669809 - DNA, 25 bp, Homo sapien
ggttccatttgaactattatgggca

SEQ ID NO: 669810 - DNA, 25 bp, Homo sapien
agcatttgttgcctcgatcttccac

SEQ ID NO: 669811 - DNA, 25 bp, Homo sapien
tgcctcgatcttccactttagaaaa

SEQ ID NO: 669812 - DNA, 25 bp, Homo sapien
tagccccagcttctactgcttgagg

SEQ ID NO: 669813 - DNA, 25 bp, Homo sapien
gcttctactgcttgaggctctcttt

SEQ ID NO: 669814 - DNA, 25 bp, Homo sapien
ttggcatctccacacatcatcctta

SEQ ID NO: 669815 - DNA, 25 bp, Homo sapien
atcatccttagcagcccagactgca

SEQ ID NO: 669816 - DNA, 25 bp, Homo sapien
agcagcccagactgcatttctgtag

SEQ ID NO: 669817 - DNA, 25 bp, Homo sapien
gactgcatttctgtagcagcctctt

SEQ ID NO: 669818 - DNA, 25 bp, Homo sapien
tggtctcttctttcagtctctctgc

SEQ ID NO: 669819 - DNA, 25 bp, Homo sapien
tctgcctctaatccagtggctttaa

SEQ ID NO: 669820 - DNA, 25 bp, Homo sapien
agaattttttggctgtgacttccag

SEQ ID NO: 669821 - DNA, 25 bp, Homo sapien
tttttggctgtgacttccagtaaga

SEQ ID NO: 669822 - DNA, 25 bp, Homo sapien
attgtgacctagtaaatatgtgtgt

SEQ ID NO: 669823 - DNA, 25 bp, Homo sapien
catcagagctggatctagaaatgga

SEQ ID NO: 669824 - DNA, 25 bp, Homo sapien
ctggatctagaaatggaagctctta

SEQ ID NO: 669825 - DNA, 25 bp, Homo sapien
tggaagctcttaaaaccgtgtataa

SEQ ID NO: 669826 - DNA, 25 bp, Homo sapien
gtcaggggaaacgattgtggtcacc

SEQ ID NO: 669827 - DNA, 25 bp, Homo sapien
ttgtggtcacctgtgctgtttttaa

SEQ ID NO: 669828 - DNA, 25 bp, Homo sapien
ggtcacctgtgctgtttttaacaat

SEQ ID NO: 669829 - DNA, 25 bp, Homo sapien
acctgtgctgtttttaacaatgagg

SEQ ID NO: 669830 - DNA, 25 bp, Homo sapien
aacaatgaggtggttgaccttcaat

SEQ ID NO: 669831 - DNA, 25 bp, Homo sapien
gttgaccttcaatggacttaccctg

SEQ ID NO: 669832 - DNA, 25 bp, Homo sapien
gaccttcaatggacttaccctggag

SEQ ID NO: 669833 - DNA, 25 bp, Homo sapien
tcaatggacttaccctggagaagtg

SEQ ID NO: 669834 - DNA, 25 bp, Homo sapien
attgctcctcatattactggtttta

SEQ ID NO: 669835 - DNA, 25 bp, Homo sapien
gctcctcatattactggttttacat

SEQ ID NO: 669836 - DNA, 25 bp, Homo sapien
atattactggttttacatggacaca

SEQ ID NO: 669837 - DNA, 25 bp, Homo sapien
catggacacagaaactaggcacttt

SEQ ID NO: 669838 - DNA, 25 bp, Homo sapien
aggcactttagaggtgcacttgcat

SEQ ID NO: 669839 - DNA, 25 bp, Homo sapien
tagaggtgcacttgcatggcaggct

SEQ ID NO: 669840 - DNA, 25 bp, Homo sapien
ggtacttaaaatcactggttcactt

SEQ ID NO: 669841 - DNA, 25 bp, Homo sapien
aaatgttaaactctactaatgtaca

SEQ ID NO: 669842 - DNA, 25 bp, Homo sapien
gctgaaaagttgcattttatgtgta

SEQ ID NO: 669843 - DNA, 25 bp, Homo sapien
ttttttgccatagcaggtactgtat

SEQ ID NO: 669844 - DNA, 25 bp, Homo sapien
catagcaggtactgtatttctcatg

SEQ ID NO: 669845 - DNA, 25 bp, Homo sapien
ggcacagagcatggcctccagagga

SEQ ID NO: 669846 - DNA, 25 bp, Homo sapien
tccttctcctcttgtagccagaatt

SEQ ID NO: 669847 - DNA, 25 bp, Homo sapien
aggtactcagtgcaccaactgccag

SEQ ID NO: 669848 - DNA, 25 bp, Homo sapien
actcagtgcaccaactgccagacga

SEQ ID NO: 669849 - DNA, 25 bp, Homo sapien
agacgaccaccacgacactgtggcg

SEQ ID NO: 669850 - DNA, 25 bp, Homo sapien
accaccacgacactgtggcggagaa

SEQ ID NO: 669851 - DNA, 25 bp, Homo sapien
gacactgtggcggagaaatgccagt

SEQ ID NO: 669852 - DNA, 25 bp, Homo sapien
agtggggatcccgtgtgcaatgcct

SEQ ID NO: 669853 - DNA, 25 bp, Homo sapien
agcactactgtggtggctccgctca

SEQ ID NO: 669854 - DNA, 25 bp, Homo sapien
actgtggtggctccgctcagctcat

SEQ ID NO: 669855 - DNA, 25 bp, Homo sapien
ctcagctcatgagggcacagagcat

SEQ ID NO: 669856 - DNA, 25 bp, Homo sapien
ggcccaaggtcacttgctgaaaagt

SEQ ID NO: 669857 - DNA, 25 bp, Homo sapien
aggattcactgcctctggttcactg

SEQ ID NO: 669858 - DNA, 25 bp, Homo sapien
ttctttaactttctccacagtatca

SEQ ID NO: 669859 - DNA, 25 bp, Homo sapien
ttctccacagtatcattggtccgat

SEQ ID NO: 669860 - DNA, 25 bp, Homo sapien
cattggtccgataaatgagaggcaa

SEQ ID NO: 669861 - DNA, 25 bp, Homo sapien
gatgtatgtataaacttaggcaagc

SEQ ID NO: 669862 - DNA, 25 bp, Homo sapien
aacttaggcaagcatggagagccat

SEQ ID NO: 669863 - DNA, 25 bp, Homo sapien
gagagccatggtgatctggttaagt

SEQ ID NO: 669864 - DNA, 25 bp, Homo sapien
tcttgagctgaattgcactggttag

SEQ ID NO: 669865 - DNA, 25 bp, Homo sapien
gcactggttagtgtcctggattttg

SEQ ID NO: 669866 - DNA, 25 bp, Homo sapien
cctggattttgaatgtactaaccct

SEQ ID NO: 669867 - DNA, 25 bp, Homo sapien
tgaagttccccatgggtctccagga

SEQ ID NO: 669868 - DNA, 25 bp, Homo sapien
gaagttccccatgggtctccaggaa

SEQ ID NO: 669869 - DNA, 25 bp, Homo sapien
agttccccatgggtctccaggaagt

SEQ ID NO: 669870 - DNA, 25 bp, Homo sapien
ttccccatgggtctccaggaagtga

SEQ ID NO: 669871 - DNA, 25 bp, Homo sapien
tccccatgggtctccaggaagtgac

SEQ ID NO: 669872 - DNA, 25 bp, Homo sapien
ccccatgggtctccaggaagtgacc

SEQ ID NO: 669873 - DNA, 25 bp, Homo sapien
tgctggagccaccttgctacctggg

SEQ ID NO: 669874 - DNA, 25 bp, Homo sapien
agccaccttgctacctggggagggt

SEQ ID NO: 669875 - DNA, 25 bp, Homo sapien
ctggactgtgctggttcatttagaa

SEQ ID NO: 669876 - DNA, 25 bp, Homo sapien
tggactgtgctggttcatttagaaa

SEQ ID NO: 669877 - DNA, 25 bp, Homo sapien
ggactgtgctggttcatttagaaat

SEQ ID NO: 669878 - DNA, 25 bp, Homo sapien
tgtccctcttctttgatcgtaattc

SEQ ID NO: 669879 - DNA, 25 bp, Homo sapien
gatcgtaattcaattttcctcttat

SEQ ID NO: 669880 - DNA, 25 bp, Homo sapien
tttcctcttattcattcagttcccg

SEQ ID NO: 669881 - DNA, 25 bp, Homo sapien
attcagttcccgtgtatttcttgtg

SEQ ID NO: 669882 - DNA, 25 bp, Homo sapien
ttcccgtgtatttcttgtgcttcta

SEQ ID NO: 669883 - DNA, 25 bp, Homo sapien
atttcttgtgcttctactttgtacc

SEQ ID NO: 669884 - DNA, 25 bp, Homo sapien
gtgcttctactttgtaccaaacttt

SEQ ID NO: 669885 - DNA, 25 bp, Homo sapien
gataaatatgcctgagctcccatgt

SEQ ID NO: 669886 - DNA, 25 bp, Homo sapien
atatgcctgagctcccatgtccaaa

SEQ ID NO: 669887 - DNA, 25 bp, Homo sapien
tcctgaagggctgtagtagagataa

SEQ ID NO: 669888 - DNA, 25 bp, Homo sapien
gatagtttttgagctggatcttaaa

SEQ ID NO: 669889 - DNA, 25 bp, Homo sapien
tgctgctgttcaggaaacgatggca

SEQ ID NO: 669890 - DNA, 25 bp, Homo sapien
tgctgttcaggaaacgatggcagaa

SEQ ID NO: 669891 - DNA, 25 bp, Homo sapien
gaaacgatggcagaacgagaagctc

SEQ ID NO: 669892 - DNA, 25 bp, Homo sapien
cgagaagctcgggttggatgccggg

SEQ ID NO: 669893 - DNA, 25 bp, Homo sapien
ctggacgactgctccatgtatgagg

SEQ ID NO: 669894 - DNA, 25 bp, Homo sapien
gacgactgctccatgtatgaggaca

SEQ ID NO: 669895 - DNA, 25 bp, Homo sapien
gactgctccatgtatgaggacatct

SEQ ID NO: 669896 - DNA, 25 bp, Homo sapien
gctccatgtatgaggacatctcccg

SEQ ID NO: 669897 - DNA, 25 bp, Homo sapien
tccatgtatgaggacatctcccggg

SEQ ID NO: 669898 - DNA, 25 bp, Homo sapien
tccagggcacctaccaggatgtggg

SEQ ID NO: 669899 - DNA, 25 bp, Homo sapien
gggcacctaccaggatgtgggcagc

SEQ ID NO: 669900 - DNA, 25 bp, Homo sapien
gatcctatccgaagctaggataaat

SEQ ID NO: 669901 - DNA, 25 bp, Homo sapien
aaattgattacaagttctctgctgt

SEQ ID NO: 669902 - DNA, 25 bp, Homo sapien
aagtccccgcaatgtctcacgttgt

SEQ ID NO: 669903 - DNA, 25 bp, Homo sapien
aatgtctcacgttgtctttgaccag

SEQ ID NO: 669904 - DNA, 25 bp, Homo sapien
tctcacgttgtctttgaccagtggt

SEQ ID NO: 669905 - DNA, 25 bp, Homo sapien
gttgtctttgaccagtggtccccag

SEQ ID NO: 669906 - DNA, 25 bp, Homo sapien
ttgaccagtggtccccagtaccagg

SEQ ID NO: 669907 - DNA, 25 bp, Homo sapien
tggaaaagtctcatgcacctggatt

SEQ ID NO: 669908 - DNA, 25 bp, Homo sapien
aaaagtctcatgcacctggattaac

SEQ ID NO: 669909 - DNA, 25 bp, Homo sapien
gtctcatgcacctggattaactcag

SEQ ID NO: 669910 - DNA, 25 bp, Homo sapien
atgcacctggattaactcagaaaaa

SEQ ID NO: 669911 - DNA, 25 bp, Homo sapien
cctgggcaacatgattaaatctggt

SEQ ID NO: 669912 - DNA, 25 bp, Homo sapien
gggcaacatgattaaatctggtctc

SEQ ID NO: 669913 - DNA, 25 bp, Homo sapien
agatcgcacaactgctctctgtcct

SEQ ID NO: 669914 - DNA, 25 bp, Homo sapien
atcgcacaactgctctctgtcctag

SEQ ID NO: 669915 - DNA, 25 bp, Homo sapien
gcacaactgctctctgtcctaggtg

SEQ ID NO: 669916 - DNA, 25 bp, Homo sapien
cacaactgctctctgtcctaggtga

SEQ ID NO: 669917 - DNA, 25 bp, Homo sapien
acaactgctctctgtcctaggtgac

SEQ ID NO: 669918 - DNA, 25 bp, Homo sapien
caactgctctctgtcctaggtgaca

SEQ ID NO: 669919 - DNA, 25 bp, Homo sapien
aactgctctctgtcctaggtgacag

SEQ ID NO: 669920 - DNA, 25 bp, Homo sapien
actgctctctgtcctaggtgacaga

SEQ ID NO: 669921 - DNA, 25 bp, Homo sapien
ctgctctctgtcctaggtgacagag

SEQ ID NO: 669922 - DNA, 25 bp, Homo sapien
ttgcttctctgtccattcgctgatg

SEQ ID NO: 669923 - DNA, 25 bp, Homo sapien
tctgtccattcgctgatgggcactt

SEQ ID NO: 669924 - DNA, 25 bp, Homo sapien
tgatgggcacttgggctccttccac

SEQ ID NO: 669925 - DNA, 25 bp, Homo sapien
atatctgttcacattgagatctctc

SEQ ID NO: 669926 - DNA, 25 bp, Homo sapien
gttcacattgagatctctctccttt

SEQ ID NO: 669927 - DNA, 25 bp, Homo sapien
tttcctgatttattgtgactcaaaa

SEQ ID NO: 669928 - DNA, 25 bp, Homo sapien
tattgtgactcaaaatttcccaaac

SEQ ID NO: 669929 - DNA, 25 bp, Homo sapien
aaatatgttaggtgatttcccttcg

SEQ ID NO: 669930 - DNA, 25 bp, Homo sapien
atgttaggtgatttcccttcgtaag

SEQ ID NO: 669931 - DNA, 25 bp, Homo sapien
ggtgatttcccttcgtaagaatata

SEQ ID NO: 669932 - DNA, 25 bp, Homo sapien
tacattttgcttctctgtccattcg

SEQ ID NO: 669933 - DNA, 25 bp, Homo sapien
cagacaacctgactctgccccggtg

SEQ ID NO: 669934 - DNA, 25 bp, Homo sapien
gtggtccccagccatcatctcttaa

SEQ ID NO: 669935 - DNA, 25 bp, Homo sapien
agccatcatctcttaactacggagg

SEQ ID NO: 669936 - DNA, 25 bp, Homo sapien
atcatctcttaactacggaggcccg

SEQ ID NO: 669937 - DNA, 25 bp, Homo sapien
atctcttaactacggaggcccgccg

SEQ ID NO: 669938 - DNA, 25 bp, Homo sapien
tctcctttagtttgagaaaagacag

SEQ ID NO: 669939 - DNA, 25 bp, Homo sapien
gctgcctggatgagcgcccatgcag

SEQ ID NO: 669940 - DNA, 25 bp, Homo sapien
ggatgagcgcccatgcagcaaggct

SEQ ID NO: 669941 - DNA, 25 bp, Homo sapien
atgagcgcccatgcagcaaggcttg

SEQ ID NO: 669942 - DNA, 25 bp, Homo sapien
ggcttggaggaagcgtcagtgccct

SEQ ID NO: 669943 - DNA, 25 bp, Homo sapien
tcagtgccctggagatcccagctcg

SEQ ID NO: 669944 - DNA, 25 bp, Homo sapien
tgcttggtatttattgcctaattaa

SEQ ID NO: 669945 - DNA, 25 bp, Homo sapien
ataatctcaacataacagtgaagtc

SEQ ID NO: 669946 - DNA, 25 bp, Homo sapien
aacagtgaagtcaaaggctttcctt

SEQ ID NO: 669947 - DNA, 25 bp, Homo sapien
tgaagtcaaaggctttccttttctt

SEQ ID NO: 669948 - DNA, 25 bp, Homo sapien
ttttccagttggttatttgaggctt

SEQ ID NO: 669949 - DNA, 25 bp, Homo sapien
tccagttggttatttgaggctttga

SEQ ID NO: 669950 - DNA, 25 bp, Homo sapien
gaggctttgaggtatttataaacac

SEQ ID NO: 669951 - DNA, 25 bp, Homo sapien
cacaaaaggctgtatttctgctccc

SEQ ID NO: 669952 - DNA, 25 bp, Homo sapien
aaaaggctgtatttctgctccccta

SEQ ID NO: 669953 - DNA, 25 bp, Homo sapien
cttatgtctgtaatgaagttttgaa

SEQ ID NO: 669954 - DNA, 25 bp, Homo sapien
atgagtcatgatttttaagtttctt

SEQ ID NO: 669955 - DNA, 25 bp, Homo sapien
tctcccggctggcagtctctcgggt

SEQ ID NO: 669956 - DNA, 25 bp, Homo sapien
gctggcagtctctcgggtccagcca

SEQ ID NO: 669957 - DNA, 25 bp, Homo sapien
cgatctcaatcactggaatggtgct

SEQ ID NO: 669958 - DNA, 25 bp, Homo sapien
atcactggaatggtgctgggctgtc

SEQ ID NO: 669959 - DNA, 25 bp, Homo sapien
tcgggaactaactgtggagaccttc

SEQ ID NO: 669960 - DNA, 25 bp, Homo sapien
tgtggagaccttcacggcacttcac

SEQ ID NO: 669961 - DNA, 25 bp, Homo sapien
gaccttcacggcacttcactctggg

SEQ ID NO: 669962 - DNA, 25 bp, Homo sapien
ccgcattattccacaagcctgtggg

SEQ ID NO: 669963 - DNA, 25 bp, Homo sapien
aagcagcagcgacccccgaggaatt

SEQ ID NO: 669964 - DNA, 25 bp, Homo sapien
atctcccattaacgcttttctttct

SEQ ID NO: 669965 - DNA, 25 bp, Homo sapien
tttctttctgttgaccacctgggtg

SEQ ID NO: 669966 - DNA, 25 bp, Homo sapien
cacacgtgctgcactcttgattctg

SEQ ID NO: 669967 - DNA, 25 bp, Homo sapien
acacgtgctgcactcttgattctgg

SEQ ID NO: 669968 - DNA, 25 bp, Homo sapien
cacgtgctgcactcttgattctggc

SEQ ID NO: 669969 - DNA, 25 bp, Homo sapien
acgtgctgcactcttgattctggct

SEQ ID NO: 669970 - DNA, 25 bp, Homo sapien
cgtgctgcactcttgattctggctt

SEQ ID NO: 669971 - DNA, 25 bp, Homo sapien
gtgctgcactcttgattctggcttt

SEQ ID NO: 669972 - DNA, 25 bp, Homo sapien
tgctgcactcttgattctggctttt

SEQ ID NO: 669973 - DNA, 25 bp, Homo sapien
gctgcactcttgattctggcttttt

SEQ ID NO: 669974 - DNA, 25 bp, Homo sapien
ctgcactcttgattctggctttttt

SEQ ID NO: 669975 - DNA, 25 bp, Homo sapien
tgcactcttgattctggcttttttg

SEQ ID NO: 669976 - DNA, 25 bp, Homo sapien
gcactcttgattctggcttttttgc

SEQ ID NO: 669977 - DNA, 25 bp, Homo sapien
tgtgctgtgattctccctgagtcat

SEQ ID NO: 669978 - DNA, 25 bp, Homo sapien
cttttcatttcctgggcttgtgttg

SEQ ID NO: 669979 - DNA, 25 bp, Homo sapien
ctgggcttgtgttgctacgttagaa

SEQ ID NO: 669980 - DNA, 25 bp, Homo sapien
gttgctacgttagaagtctgtctgt

SEQ ID NO: 669981 - DNA, 25 bp, Homo sapien
agtccactgtggtaaggcttgtatt

SEQ ID NO: 669982 - DNA, 25 bp, Homo sapien
ccactgtggtaaggcttgtatttta

SEQ ID NO: 669983 - DNA, 25 bp, Homo sapien
ttgtattttactttctccgtcgtca

SEQ ID NO: 669984 - DNA, 25 bp, Homo sapien
ttctccgtcgtcacatgataaatac

SEQ ID NO: 669985 - DNA, 25 bp, Homo sapien
gtcgtcacatgataaatacttcttg

SEQ ID NO: 669986 - DNA, 25 bp, Homo sapien
aaaagattactggagggaatgtcat

SEQ ID NO: 669987 - DNA, 25 bp, Homo sapien
gggaatgtcatctgtctattgtaat

SEQ ID NO: 669988 - DNA, 25 bp, Homo sapien
accccttggagtcagtcagtagtag

SEQ ID NO: 669989 - DNA, 25 bp, Homo sapien
gtcagtcagtagtagagcccttgct

SEQ ID NO: 669990 - DNA, 25 bp, Homo sapien
gtcagtagtagagcccttgctgctg

SEQ ID NO: 669991 - DNA, 25 bp, Homo sapien
gagcccttgctgctggctgcaaata

SEQ ID NO: 669992 - DNA, 25 bp, Homo sapien
ctgctggctgcaaataccccatcag

SEQ ID NO: 669993 - DNA, 25 bp, Homo sapien
tcttggacctggtttcaatttcttt

SEQ ID NO: 669994 - DNA, 25 bp, Homo sapien
ttcaatttcttttctgccagtcagc

SEQ ID NO: 669995 - DNA, 25 bp, Homo sapien
ttcttttctgccagtcagcagttgt

SEQ ID NO: 669996 - DNA, 25 bp, Homo sapien
gtcagcagttgtgcttgactcacaa

SEQ ID NO: 669997 - DNA, 25 bp, Homo sapien
actcacaatttgttgccatctcttg

SEQ ID NO: 669998 - DNA, 25 bp, Homo sapien
tgccatctcttgaattaaactcagg

SEQ ID NO: 669999 - DNA, 25 bp, Homo sapien
gtaagaaacaatgggcagaaagctg

SEQ ID NO: 670000 - DNA, 25 bp, Homo sapien
tgggacgaaagcacagcaggcttct

SEQ ID NO: 670001 - DNA, 25 bp, Homo sapien
tggagatcctttctctcaagggcag

SEQ ID NO: 670002 - DNA, 25 bp, Homo sapien
tcctttctctcaagggcaggattat

SEQ ID NO: 670003 - DNA, 25 bp, Homo sapien
aggattattcccacctgccacagtt

SEQ ID NO: 670004 - DNA, 25 bp, Homo sapien
tgccacagttcacatgccacaaata

SEQ ID NO: 670005 - DNA, 25 bp, Homo sapien
aaataacatctcaccttcagtcaag

SEQ ID NO: 670006 - DNA, 25 bp, Homo sapien
aacatctcaccttcagtcaagaaaa

SEQ ID NO: 670007 - DNA, 25 bp, Homo sapien
gccaatgtatccctgaggaaaagtc

SEQ ID NO: 670008 - DNA, 25 bp, Homo sapien
gtatccctgaggaaaagtccacaag

SEQ ID NO: 670009 - DNA, 25 bp, Homo sapien
gtccacaagaacaattcaagaaact

SEQ ID NO: 670010 - DNA, 25 bp, Homo sapien
gaccatagtaagctgttcccatact

SEQ ID NO: 670011 - DNA, 25 bp, Homo sapien
tcccatactcaaatatttcctgtcc

SEQ ID NO: 670012 - DNA, 25 bp, Homo sapien
tttcctgtcctgtaattgcatttta

SEQ ID NO: 670013 - DNA, 25 bp, Homo sapien
tcctttatgtagaacttgcgtcctt

SEQ ID NO: 670014 - DNA, 25 bp, Homo sapien
agaacttgcgtccttcttacgaagt

SEQ ID NO: 670015 - DNA, 25 bp, Homo sapien
gtttattcctaagcagtttatcgtt

SEQ ID NO: 670016 - DNA, 25 bp, Homo sapien
gtttatcgtttttgttgctgcaata

SEQ ID NO: 670017 - DNA, 25 bp, Homo sapien
aaatggacgtatttcttccttgatg

SEQ ID NO: 670018 - DNA, 25 bp, Homo sapien
tgtcctccacctaagattgtctgta

SEQ ID NO: 670019 - DNA, 25 bp, Homo sapien
gtgtattacatttaatcctgccact

SEQ ID NO: 670020 - DNA, 25 bp, Homo sapien
ctgccactgtaatctcttctaattt

SEQ ID NO: 670021 - DNA, 25 bp, Homo sapien
tcaaagtggaatcccggtgactccc

SEQ ID NO: 670022 - DNA, 25 bp, Homo sapien
tggaatcccggtgactccccaggaa

SEQ ID NO: 670023 - DNA, 25 bp, Homo sapien
cccaggaaaccagggactcagggct

SEQ ID NO: 670024 - DNA, 25 bp, Homo sapien
ggactcagggctggagtaacctcca

SEQ ID NO: 670025 - DNA, 25 bp, Homo sapien
ctcagggctggagtaacctccataa

SEQ ID NO: 670026 - DNA, 25 bp, Homo sapien
tagatggtttttccatccttgcatc

SEQ ID NO: 670027 - DNA, 25 bp, Homo sapien
caaaacacaaaactcaccaccatat

SEQ ID NO: 670028 - DNA, 25 bp, Homo sapien
accaccatatcctttcctaaagcga

SEQ ID NO: 670029 - DNA, 25 bp, Homo sapien
ttcctaaagcgatcagttggcccat

SEQ ID NO: 670030 - DNA, 25 bp, Homo sapien
taaagcgatcagttggcccatattc

SEQ ID NO: 670031 - DNA, 25 bp, Homo sapien
atcagttggcccatattctgtctct

SEQ ID NO: 670032 - DNA, 25 bp, Homo sapien
aactgaagacaagccttgcgactaa

SEQ ID NO: 670033 - DNA, 25 bp, Homo sapien
ccgactcacaggtgcaataccatgc

SEQ ID NO: 670034 - DNA, 25 bp, Homo sapien
aataccatgcaccagggtcccagag

SEQ ID NO: 670035 - DNA, 25 bp, Homo sapien
agggtcccagagttgctgcaagcag

SEQ ID NO: 670036 - DNA, 25 bp, Homo sapien
gtgaataaaattccctgctgatgaa

SEQ ID NO: 670037 - DNA, 25 bp, Homo sapien
tgatgaagagctacggccagcgtct

SEQ ID NO: 670038 - DNA, 25 bp, Homo sapien
gcgtctggcccataggaattgccca

SEQ ID NO: 670039 - DNA, 25 bp, Homo sapien
gaattgcccagcagacgttgggtga

SEQ ID NO: 670040 - DNA, 25 bp, Homo sapien
gggtgagtctgcaccggcaaagcca

SEQ ID NO: 670041 - DNA, 25 bp, Homo sapien
agctctccagagtcaccattaacgt

SEQ ID NO: 670042 - DNA, 25 bp, Homo sapien
attaacgtggtcactttctcacggc

SEQ ID NO: 670043 - DNA, 25 bp, Homo sapien
gaaacagataactacatgtggcatg

SEQ ID NO: 670044 - DNA, 25 bp, Homo sapien
atgtggcatgttaactcctgtcaaa

SEQ ID NO: 670045 - DNA, 25 bp, Homo sapien
actcctgtcaaagacatgttcactg

SEQ ID NO: 670046 - DNA, 25 bp, Homo sapien
atgttcactgaagactctcctgagc

SEQ ID NO: 670047 - DNA, 25 bp, Homo sapien
gagcttttccaggatgtatgtccag

SEQ ID NO: 670048 - DNA, 25 bp, Homo sapien
caggagatcctgttggcacatccaa

SEQ ID NO: 670049 - DNA, 25 bp, Homo sapien
atttccccttgtgactgcacataag

SEQ ID NO: 670050 - DNA, 25 bp, Homo sapien
tgcacataagcatggtcacctgaca

SEQ ID NO: 670051 - DNA, 25 bp, Homo sapien
ggtcacctgacagggatcaggccca

SEQ ID NO: 670052 - DNA, 25 bp, Homo sapien
gcccactctcctttagagggtggaa

SEQ ID NO: 670053 - DNA, 25 bp, Homo sapien
cacagttgtcattacccagtggtca

SEQ ID NO: 670054 - DNA, 25 bp, Homo sapien
ctcgttcccaaaggcttgtaccagg

SEQ ID NO: 670055 - DNA, 25 bp, Homo sapien
ttcccaaaggcttgtaccaggacct

SEQ ID NO: 670056 - DNA, 25 bp, Homo sapien
caaaggcttgtaccaggacctggag

SEQ ID NO: 670057 - DNA, 25 bp, Homo sapien
tctaccgcctgtccacagaggagaa

SEQ ID NO: 670058 - DNA, 25 bp, Homo sapien
accgcctgtccacagaggagaagta

SEQ ID NO: 670059 - DNA, 25 bp, Homo sapien
tgagggtgtctctgtgaggctccac

SEQ ID NO: 670060 - DNA, 25 bp, Homo sapien
agggtgtctctgtgaggctccactg

SEQ ID NO: 670061 - DNA, 25 bp, Homo sapien
tctgtgaggctccactgcggtctgt

SEQ ID NO: 670062 - DNA, 25 bp, Homo sapien
actctctgtttccaatttcagaatc

SEQ ID NO: 670063 - DNA, 25 bp, Homo sapien
atttcagaatcctaactgttgcata

SEQ ID NO: 670064 - DNA, 25 bp, Homo sapien
gaatcctaactgttgcataaaatac

SEQ ID NO: 670065 - DNA, 25 bp, Homo sapien
acagaaatccatgttgggagatgtt

SEQ ID NO: 670066 - DNA, 25 bp, Homo sapien
ggcatcaaccaagaattgagagcac

SEQ ID NO: 670067 - DNA, 25 bp, Homo sapien
aagaattgagagcactacacccaaa

SEQ ID NO: 670068 - DNA, 25 bp, Homo sapien
gagcactacacccaaaaaggactga

SEQ ID NO: 670069 - DNA, 25 bp, Homo sapien
ggactgaagcctgttgttttctgga

SEQ ID NO: 670070 - DNA, 25 bp, Homo sapien
ctgaagcctgttgttttctggaggt

SEQ ID NO: 670071 - DNA, 25 bp, Homo sapien
atttttctcacagggatttttattg

SEQ ID NO: 670072 - DNA, 25 bp, Homo sapien
ttcaaggagatctgtgaacgtccaa

SEQ ID NO: 670073 - DNA, 25 bp, Homo sapien
agatctgtgaacgtccaaatggctc

SEQ ID NO: 670074 - DNA, 25 bp, Homo sapien
tgtgaacgtccaaatggctcctgtc

SEQ ID NO: 670075 - DNA, 25 bp, Homo sapien
gaacgtccaaatggctcctgtcggg

SEQ ID NO: 670076 - DNA, 25 bp, Homo sapien
tgccgatggaaaggcatctgccata

SEQ ID NO: 670077 - DNA, 25 bp, Homo sapien
aaggcatctgccataaaagaaaagc

SEQ ID NO: 670078 - DNA, 25 bp, Homo sapien
gcaaaagataaaaagcccaaccgat

SEQ ID NO: 670079 - DNA, 25 bp, Homo sapien
cagtcaggcttgaggagctggcgct

SEQ ID NO: 670080 - DNA, 25 bp, Homo sapien
gagctggcgcttgtaatgtttatcc

SEQ ID NO: 670081 - DNA, 25 bp, Homo sapien
tccgtttaaacatttcgtcctcctg

SEQ ID NO: 670082 - DNA, 25 bp, Homo sapien
ttaaacatttcgtcctcctggtaca

SEQ ID NO: 670083 - DNA, 25 bp, Homo sapien
tcgtcctcctggtacacgaagggaa

SEQ ID NO: 670084 - DNA, 25 bp, Homo sapien
gagaagcatctgatgcctttttctt

SEQ ID NO: 670085 - DNA, 25 bp, Homo sapien
tgtttaaggtcaactccaccaaata

SEQ ID NO: 670086 - DNA, 25 bp, Homo sapien
ggtcaactccaccaaatacagcaac

SEQ ID NO: 670087 - DNA, 25 bp, Homo sapien
ctactcaacaggctgaggttgggag

SEQ ID NO: 670088 - DNA, 25 bp, Homo sapien
tactcaacaggctgaggttgggagg

SEQ ID NO: 670089 - DNA, 25 bp, Homo sapien
actcaacaggctgaggttgggagga

SEQ ID NO: 670090 - DNA, 25 bp, Homo sapien
ctcaacaggctgaggttgggaggat

SEQ ID NO: 670091 - DNA, 25 bp, Homo sapien
tcaacaggctgaggttgggaggatc

SEQ ID NO: 670092 - DNA, 25 bp, Homo sapien
caacaggctgaggttgggaggatca

SEQ ID NO: 670093 - DNA, 25 bp, Homo sapien
gcccaaggaggtcaaggctgtagtg

SEQ ID NO: 670094 - DNA, 25 bp, Homo sapien
cccaaggaggtcaaggctgtagtga

SEQ ID NO: 670095 - DNA, 25 bp, Homo sapien
actccaatctgggtgacagaataag

SEQ ID NO: 670096 - DNA, 25 bp, Homo sapien
ctccaatctgggtgacagaataaga

SEQ ID NO: 670097 - DNA, 25 bp, Homo sapien
ccaatctgggtgacagaataagacc

SEQ ID NO: 670098 - DNA, 25 bp, Homo sapien
gcagaggtagaaagagtgactatac

SEQ ID NO: 670099 - DNA, 25 bp, Homo sapien
gaaagagtgactatacacctagcat

SEQ ID NO: 670100 - DNA, 25 bp, Homo sapien
aagagtgactatacacctagcatgc

SEQ ID NO: 670101 - DNA, 25 bp, Homo sapien
agagtgactatacacctagcatgct

SEQ ID NO: 670102 - DNA, 25 bp, Homo sapien
tgactatacacctagcatgctggct

SEQ ID NO: 670103 - DNA, 25 bp, Homo sapien
ctgaggttggaggactattgatgtc

SEQ ID NO: 670104 - DNA, 25 bp, Homo sapien
gttggaggactattgatgtcaggaa

SEQ ID NO: 670105 - DNA, 25 bp, Homo sapien
tgagcaatgcagtgagacgtcccca

SEQ ID NO: 670106 - DNA, 25 bp, Homo sapien
gtgagacgtccccatgtatataaga

SEQ ID NO: 670107 - DNA, 25 bp, Homo sapien
atcaaccttgcatggtgattggcac

SEQ ID NO: 670108 - DNA, 25 bp, Homo sapien
tgtagtcccatctaattcagaaggt

SEQ ID NO: 670109 - DNA, 25 bp, Homo sapien
agaaaaattaactctgctgtttgct

SEQ ID NO: 670110 - DNA, 25 bp, Homo sapien
tctgctgtttgctgcatgctgcatg

SEQ ID NO: 670111 - DNA, 25 bp, Homo sapien
gacccagggtcctgtaatccatggc

SEQ ID NO: 670112 - DNA, 25 bp, Homo sapien
acccagggtcctgtaatccatggct

SEQ ID NO: 670113 - DNA, 25 bp, Homo sapien
cccagggtcctgtaatccatggctg

SEQ ID NO: 670114 - DNA, 25 bp, Homo sapien
ccagggtcctgtaatccatggctgt

SEQ ID NO: 670115 - DNA, 25 bp, Homo sapien
ttaagccgagctttttttaatcttg

SEQ ID NO: 670116 - DNA, 25 bp, Homo sapien
gccgagctttttttaatcttgtctt

SEQ ID NO: 670117 - DNA, 25 bp, Homo sapien
tttttaatcttgtcttcagcagctg

SEQ ID NO: 670118 - DNA, 25 bp, Homo sapien
tttaatcttgtcttcagcagctgca

SEQ ID NO: 670119 - DNA, 25 bp, Homo sapien
ttaatcttgtcttcagcagctgcac

SEQ ID NO: 670120 - DNA, 25 bp, Homo sapien
ctaatatttctgtcacacagagaaa

SEQ ID NO: 670121 - DNA, 25 bp, Homo sapien
tgataatgcagtacaaggttgatat

SEQ ID NO: 670122 - DNA, 25 bp, Homo sapien
tgcagtacaaggttgatattttaag

SEQ ID NO: 670123 - DNA, 25 bp, Homo sapien
ggtagagatttttagcttgagcatt

SEQ ID NO: 670124 - DNA, 25 bp, Homo sapien
gagatttttagcttgagcatttagc

SEQ ID NO: 670125 - DNA, 25 bp, Homo sapien
tttttagcttgagcatttagcatcc

SEQ ID NO: 670126 - DNA, 25 bp, Homo sapien
agcatttagcatccatttgttcttt

SEQ ID NO: 670127 - DNA, 25 bp, Homo sapien
gcatttagcatccatttgttctttt

SEQ ID NO: 670128 - DNA, 25 bp, Homo sapien
tttagcatccatttgttcttttaat

SEQ ID NO: 670129 - DNA, 25 bp, Homo sapien
gttcttttaatgtaaatgtcaaaca

SEQ ID NO: 670130 - DNA, 25 bp, Homo sapien
aaatttataattcactcaatagagt

SEQ ID NO: 670131 - DNA, 25 bp, Homo sapien
gctgttacaagccagaggcacccgg

SEQ ID NO: 670132 - DNA, 25 bp, Homo sapien
gttacaagccagaggcacccggatg

SEQ ID NO: 670133 - DNA, 25 bp, Homo sapien
caagccagaggcacccggatgtgag

SEQ ID NO: 670134 - DNA, 25 bp, Homo sapien
agaggcacccggatgtgaggcccca

SEQ ID NO: 670135 - DNA, 25 bp, Homo sapien
ggcacccggatgtgaggccccagat

SEQ ID NO: 670136 - DNA, 25 bp, Homo sapien
cacccggatgtgaggccccagatca

SEQ ID NO: 670137 - DNA, 25 bp, Homo sapien
cccagatcacctccagggacttggg

SEQ ID NO: 670138 - DNA, 25 bp, Homo sapien
ggacttggggttcccatctgaaatc

SEQ ID NO: 670139 - DNA, 25 bp, Homo sapien
ggatgggtccttgcttctcagctgt

SEQ ID NO: 670140 - DNA, 25 bp, Homo sapien
gtccttgcttctcagctgtgtccga

SEQ ID NO: 670141 - DNA, 25 bp, Homo sapien
tgtccgaccccaccatgtaataaaa

SEQ ID NO: 670142 - DNA, 25 bp, Homo sapien
gggattttgataggtatagtattga

SEQ ID NO: 670143 - DNA, 25 bp, Homo sapien
gtatctttcaattcatgaatgtggt

SEQ ID NO: 670144 - DNA, 25 bp, Homo sapien
tcaattcatgaatgtggtatgtttt

SEQ ID NO: 670145 - DNA, 25 bp, Homo sapien
gaatgtggtatgtttttccatggag

SEQ ID NO: 670146 - DNA, 25 bp, Homo sapien
ttccatggagatctttagccctctc

SEQ ID NO: 670147 - DNA, 25 bp, Homo sapien
ccatggagatctttagccctctcaa

SEQ ID NO: 670148 - DNA, 25 bp, Homo sapien
gatctttagccctctcaaaaatgtt

SEQ ID NO: 670149 - DNA, 25 bp, Homo sapien
ctttagccctctcaaaaatgttttg

SEQ ID NO: 670150 - DNA, 25 bp, Homo sapien
atgttgttatgaattgggactgtta

SEQ ID NO: 670151 - DNA, 25 bp, Homo sapien
ttgggactgttaattttatcttggg

SEQ ID NO: 670152 - DNA, 25 bp, Homo sapien
gggattggtcattgttaatatacag

SEQ ID NO: 670153 - DNA, 25 bp, Homo sapien
gaggatgtgtctccttttgtgcccc

SEQ ID NO: 670154 - DNA, 25 bp, Homo sapien
taacggtgcctcagtccctctcata

SEQ ID NO: 670155 - DNA, 25 bp, Homo sapien
ccccactagttgtgaagtcaaaaat

SEQ ID NO: 670156 - DNA, 25 bp, Homo sapien
agacattgccaaacgtgccctggag

SEQ ID NO: 670157 - DNA, 25 bp, Homo sapien
aacgtgccctggaggacaaaagtgc

SEQ ID NO: 670158 - DNA, 25 bp, Homo sapien
aagtgcccctggctggaaaccatgg

SEQ ID NO: 670159 - DNA, 25 bp, Homo sapien
atgcccatgtagcaactcctagaga

SEQ ID NO: 670160 - DNA, 25 bp, Homo sapien
gcaactcctagagatctttgaacca

SEQ ID NO: 670161 - DNA, 25 bp, Homo sapien
accagcttctggttttgaactactg

SEQ ID NO: 670162 - DNA, 25 bp, Homo sapien
aactactgctccctctattgtcttt

SEQ ID NO: 670163 - DNA, 25 bp, Homo sapien
ttgtcttttccatccctgctcttga

SEQ ID NO: 670164 - DNA, 25 bp, Homo sapien
gggattttgataggtatagtattga

SEQ ID NO: 670165 - DNA, 25 bp, Homo sapien
gtatctttcaattcatgaatgtggt

SEQ ID NO: 670166 - DNA, 25 bp, Homo sapien
tcaattcatgaatgtggtatgtttt

SEQ ID NO: 670167 - DNA, 25 bp, Homo sapien
ttccatggagatctttagccctctc

SEQ ID NO: 670168 - DNA, 25 bp, Homo sapien
tccatggagatctttagccctctca

SEQ ID NO: 670169 - DNA, 25 bp, Homo sapien
ccatggagatctttagccctctcaa

SEQ ID NO: 670170 - DNA, 25 bp, Homo sapien
ctttttatgttgttatgaattggga

SEQ ID NO: 670171 - DNA, 25 bp, Homo sapien
atgttgttatgaattgggactgtta

SEQ ID NO: 670172 - DNA, 25 bp, Homo sapien
ttgggactgttaattttatcttggg

SEQ ID NO: 670173 - DNA, 25 bp, Homo sapien
gggattggtcattgttaatatacag

SEQ ID NO: 670174 - DNA, 25 bp, Homo sapien
gattggtcattgttaatatacagaa

SEQ ID NO: 670175 - DNA, 25 bp, Homo sapien
tttgattttaacgacacaattttat

SEQ ID NO: 670176 - DNA, 25 bp, Homo sapien
ttatttactgtgatatgtttggaaa

SEQ ID NO: 670177 - DNA, 25 bp, Homo sapien
aaacatgctgattctttactactgg

SEQ ID NO: 670178 - DNA, 25 bp, Homo sapien
catgctgattctttactactggtat

SEQ ID NO: 670179 - DNA, 25 bp, Homo sapien
tctttactactggtattagattgct

SEQ ID NO: 670180 - DNA, 25 bp, Homo sapien
ataaataccatcagattcgtagcat

SEQ ID NO: 670181 - DNA, 25 bp, Homo sapien
ccatcagattcgtagcatttaggga

SEQ ID NO: 670182 - DNA, 25 bp, Homo sapien
tagggatttacattagtgcttcttg

SEQ ID NO: 670183 - DNA, 25 bp, Homo sapien
ttacattagtgcttcttgtttttta

SEQ ID NO: 670184 - DNA, 25 bp, Homo sapien
gtagtgatgacaagtgatacctcaa

SEQ ID NO: 670185 - DNA, 25 bp, Homo sapien
tgacaagtgatacctcaaactccta

SEQ ID NO: 670186 - DNA, 25 bp, Homo sapien
tcactatatattatgagcatttccc

SEQ ID NO: 670187 - DNA, 25 bp, Homo sapien
cactatatattatgagcatttccct

SEQ ID NO: 670188 - DNA, 25 bp, Homo sapien
actatatattatgagcatttcccta

SEQ ID NO: 670189 - DNA, 25 bp, Homo sapien
ctatatattatgagcatttccctat

SEQ ID NO: 670190 - DNA, 25 bp, Homo sapien
tatatattatgagcatttccctata

SEQ ID NO: 670191 - DNA, 25 bp, Homo sapien
atatattatgagcatttccctataa

SEQ ID NO: 670192 - DNA, 25 bp, Homo sapien
tatattatgagcatttccctataat

SEQ ID NO: 670193 - DNA, 25 bp, Homo sapien
atattatgagcatttccctataata

SEQ ID NO: 670194 - DNA, 25 bp, Homo sapien
tattatgagcatttccctataatat

SEQ ID NO: 670195 - DNA, 25 bp, Homo sapien
attatgagcatttccctataatata

SEQ ID NO: 670196 - DNA, 25 bp, Homo sapien
ttatgagcatttccctataatatac

SEQ ID NO: 670197 - DNA, 25 bp, Homo sapien
tgttctcagtttctcggtttatgtg

SEQ ID NO: 670198 - DNA, 25 bp, Homo sapien
tcagtttctcggtttatgtgctctt

SEQ ID NO: 670199 - DNA, 25 bp, Homo sapien
ttctcggtttatgtgctcttccagg

SEQ ID NO: 670200 - DNA, 25 bp, Homo sapien
agagctgtggtatacaagacatatt

SEQ ID NO: 670201 - DNA, 25 bp, Homo sapien
atatagagtcccaaaccttctggat

SEQ ID NO: 670202 - DNA, 25 bp, Homo sapien
gagtcccaaaccttctggatctcta

SEQ ID NO: 670203 - DNA, 25 bp, Homo sapien
aaaccttctggatctctaccagcaa

SEQ ID NO: 670204 - DNA, 25 bp, Homo sapien
tggatctctaccagcaatgtggaat

SEQ ID NO: 670205 - DNA, 25 bp, Homo sapien
gcaatgtggaattatcacccatcat

SEQ ID NO: 670206 - DNA, 25 bp, Homo sapien
acccatcatcatccaatcgcagatg

SEQ ID NO: 670207 - DNA, 25 bp, Homo sapien
atcatccaatcgcagatggagggac

SEQ ID NO: 670208 - DNA, 25 bp, Homo sapien
gtatcaacctaaatgcttcttttat

SEQ ID NO: 670209 - DNA, 25 bp, Homo sapien
tatcaacctaaatgcttcttttatt

SEQ ID NO: 670210 - DNA, 25 bp, Homo sapien
tttctttttcagttatttgaatata

SEQ ID NO: 670211 - DNA, 25 bp, Homo sapien
tttctatgaccatgttacagtttaa

SEQ ID NO: 670212 - DNA, 25 bp, Homo sapien
ttctatgaccatgttacagtttaaa

SEQ ID NO: 670213 - DNA, 25 bp, Homo sapien
tctatgaccatgttacagtttaaat

SEQ ID NO: 670214 - DNA, 25 bp, Homo sapien
tatgaccatgttacagtttaaatat

SEQ ID NO: 670215 - DNA, 25 bp, Homo sapien
tccttaattttgtaagccatagaaa

SEQ ID NO: 670216 - DNA, 25 bp, Homo sapien
tttgtaagccatagaaattttaata

SEQ ID NO: 670217 - DNA, 25 bp, Homo sapien
tccctactaacggagccaacaaata

SEQ ID NO: 670218 - DNA, 25 bp, Homo sapien
ctactaacggagccaacaaataaat

SEQ ID NO: 670219 - DNA, 25 bp, Homo sapien
atctggcttgatgagtatttttaag

SEQ ID NO: 670220 - DNA, 25 bp, Homo sapien
tctggcttgatgagtatttttaagt

SEQ ID NO: 670221 - DNA, 25 bp, Homo sapien
ctggcttgatgagtatttttaagtg

SEQ ID NO: 670222 - DNA, 25 bp, Homo sapien
tggcttgatgagtatttttaagtgg

SEQ ID NO: 670223 - DNA, 25 bp, Homo sapien
ttttaagtggatacatttacttcct

SEQ ID NO: 670224 - DNA, 25 bp, Homo sapien
tttaagtggatacatttacttccta

SEQ ID NO: 670225 - DNA, 25 bp, Homo sapien
ttaagtggatacatttacttcctaa

SEQ ID NO: 670226 - DNA, 25 bp, Homo sapien
taagtggatacatttacttcctaaa

SEQ ID NO: 670227 - DNA, 25 bp, Homo sapien
ttgtacaacaaccatatctagaaat

SEQ ID NO: 670228 - DNA, 25 bp, Homo sapien
atctagaaatagctgtttgtcaagt

SEQ ID NO: 670229 - DNA, 25 bp, Homo sapien
tagctgtttgtcaagtgtatgtaac

SEQ ID NO: 670230 - DNA, 25 bp, Homo sapien
aaagcccattagagttcttcaattc

SEQ ID NO: 670231 - DNA, 25 bp, Homo sapien
gagttcttcaattcaatgcacgttc

SEQ ID NO: 670232 - DNA, 25 bp, Homo sapien
aattcaatgcacgttcaccctagag

SEQ ID NO: 670233 - DNA, 25 bp, Homo sapien
cgttcaccctagagcttttaacatc

SEQ ID NO: 670234 - DNA, 25 bp, Homo sapien
gagcttttaacatctttgctagttt

SEQ ID NO: 670235 - DNA, 25 bp, Homo sapien
ttcaacagccatttagagtgccatc

SEQ ID NO: 670236 - DNA, 25 bp, Homo sapien
cagccatttagagtgccatcaagat

SEQ ID NO: 670237 - DNA, 25 bp, Homo sapien
gatttgtagtcaggtatcttttgta

SEQ ID NO: 670238 - DNA, 25 bp, Homo sapien
agttataaatctttctctgggccgg

SEQ ID NO: 670239 - DNA, 25 bp, Homo sapien
gttataaatctttctctgggccggg

SEQ ID NO: 670240 - DNA, 25 bp, Homo sapien
ttataaatctttctctgggccgggc

SEQ ID NO: 670241 - DNA, 25 bp, Homo sapien
tataaatctttctctgggccgggcg

SEQ ID NO: 670242 - DNA, 25 bp, Homo sapien
ataaatctttctctgggccgggcgt

SEQ ID NO: 670243 - DNA, 25 bp, Homo sapien
taaatctttctctgggccgggcgtg

SEQ ID NO: 670244 - DNA, 25 bp, Homo sapien
aaatctttctctgggccgggcgtgg

SEQ ID NO: 670245 - DNA, 25 bp, Homo sapien
tgtgtggcgggcgccagctactcag

SEQ ID NO: 670246 - DNA, 25 bp, Homo sapien
gtgtggcgggcgccagctactcagg

SEQ ID NO: 670247 - DNA, 25 bp, Homo sapien
tgtggcgggcgccagctactcagga

SEQ ID NO: 670248 - DNA, 25 bp, Homo sapien
gtggcgggcgccagctactcaggag

SEQ ID NO: 670249 - DNA, 25 bp, Homo sapien
gcagaggtagaaagagtgactatac

SEQ ID NO: 670250 - DNA, 25 bp, Homo sapien
ggtagaaagagtgactatacaccta

SEQ ID NO: 670251 - DNA, 25 bp, Homo sapien
gtagaaagagtgactatacacctag

SEQ ID NO: 670252 - DNA, 25 bp, Homo sapien
tagaaagagtgactatacacctagc

SEQ ID NO: 670253 - DNA, 25 bp, Homo sapien
gaaagagtgactatacacctagcat

SEQ ID NO: 670254 - DNA, 25 bp, Homo sapien
aaagagtgactatacacctagcatg

SEQ ID NO: 670255 - DNA, 25 bp, Homo sapien
aagagtgactatacacctagcatgc

SEQ ID NO: 670256 - DNA, 25 bp, Homo sapien
agagtgactatacacctagcatgct

SEQ ID NO: 670257 - DNA, 25 bp, Homo sapien
ctgaggttggaggactattgatgtc

SEQ ID NO: 670258 - DNA, 25 bp, Homo sapien
tgaggttggaggactattgatgtca

SEQ ID NO: 670259 - DNA, 25 bp, Homo sapien
gttggaggactattgatgtcaggaa

SEQ ID NO: 670260 - DNA, 25 bp, Homo sapien
agagaactgacccatacctgtctag

SEQ ID NO: 670261 - DNA, 25 bp, Homo sapien
agaactgacccatacctgtctagcc

SEQ ID NO: 670262 - DNA, 25 bp, Homo sapien
tagagctgggccttgaggctcttca

SEQ ID NO: 670263 - DNA, 25 bp, Homo sapien
tgggccttgaggctcttcacttctt

SEQ ID NO: 670264 - DNA, 25 bp, Homo sapien
ttgaggctcttcacttctttcaaca

SEQ ID NO: 670265 - DNA, 25 bp, Homo sapien
cagatatttaatatgtacctactaa

SEQ ID NO: 670266 - DNA, 25 bp, Homo sapien
aaggtatagagagccatccttgctc

SEQ ID NO: 670267 - DNA, 25 bp, Homo sapien
cttaaaagccagatagcaaatactt

SEQ ID NO: 670268 - DNA, 25 bp, Homo sapien
gatagcaaatactttaagctttgta

SEQ ID NO: 670269 - DNA, 25 bp, Homo sapien
atactttaagctttgtaaactacat

SEQ ID NO: 670270 - DNA, 25 bp, Homo sapien
aaatattttctaacattgactaata

SEQ ID NO: 670271 - DNA, 25 bp, Homo sapien
gaagcacttggtaggcagagttact

SEQ ID NO: 670272 - DNA, 25 bp, Homo sapien
ggcagagttactcgtgtactaatag

SEQ ID NO: 670273 - DNA, 25 bp, Homo sapien
gttcctctgtgtgctaaactgaagt

SEQ ID NO: 670274 - DNA, 25 bp, Homo sapien
aactgaagtctgcactagaagtaca

SEQ ID NO: 670275 - DNA, 25 bp, Homo sapien
gagaatggccagaaatccgccaaat

SEQ ID NO: 670276 - DNA, 25 bp, Homo sapien
tagagaatccttgttcattgaagca

SEQ ID NO: 670277 - DNA, 25 bp, Homo sapien
cattgaagcatttgtgtcggttaaa

SEQ ID NO: 670278 - DNA, 25 bp, Homo sapien
attcgaaggcttatgggtctccaga

SEQ ID NO: 670279 - DNA, 25 bp, Homo sapien
agcctcagtggagaagcttcctcta

SEQ ID NO: 670280 - DNA, 25 bp, Homo sapien
tcctctaccaccagctattcaaaga

SEQ ID NO: 670281 - DNA, 25 bp, Homo sapien
gtgagtttattacagttccttggat

SEQ ID NO: 670282 - DNA, 25 bp, Homo sapien
gagaggtctaacaccaacataaggt

SEQ ID NO: 670283 - DNA, 25 bp, Homo sapien
caccaacataaggtactagcagtgt

SEQ ID NO: 670284 - DNA, 25 bp, Homo sapien
actagcagtgtttcccgtattgaca

SEQ ID NO: 670285 - DNA, 25 bp, Homo sapien
gtgtttcccgtattgacaggaatac

SEQ ID NO: 670286 - DNA, 25 bp, Homo sapien
gacaggaatacttaactcaataatt

SEQ ID NO: 670287 - DNA, 25 bp, Homo sapien
ttttccatttagtaacagttgtgat

SEQ ID NO: 670288 - DNA, 25 bp, Homo sapien
acagttgtgatgactatgtttctat

SEQ ID NO: 670289 - DNA, 25 bp, Homo sapien
gtgatgactatgtttctattctaag

SEQ ID NO: 670290 - DNA, 25 bp, Homo sapien
gtttctattctaagtaattcctgta

SEQ ID NO: 670291 - DNA, 25 bp, Homo sapien
taagtaattcctgtattctacagca

SEQ ID NO: 670292 - DNA, 25 bp, Homo sapien
tctacagcagatactttgtcagcaa

SEQ ID NO: 670293 - DNA, 25 bp, Homo sapien
agctgcctgagcctaaagtttggag

SEQ ID NO: 670294 - DNA, 25 bp, Homo sapien
gcctaaagtttggagtgtcactgaa

SEQ ID NO: 670295 - DNA, 25 bp, Homo sapien
gtcactgaaatcctgcagacacctg

SEQ ID NO: 670296 - DNA, 25 bp, Homo sapien
agacacctgcttgaaaatgcgaaga

SEQ ID NO: 670297 - DNA, 25 bp, Homo sapien
ttttcacattggcagtggctgtcct

SEQ ID NO: 670298 - DNA, 25 bp, Homo sapien
aggcctatgctcagtccatcgcaga

SEQ ID NO: 670299 - DNA, 25 bp, Homo sapien
agacgcccggctcgtgtttgaaatg

SEQ ID NO: 670300 - DNA, 25 bp, Homo sapien
aatgggcaccgagctgggtcacaag

SEQ ID NO: 670301 - DNA, 25 bp, Homo sapien
gagctgggtcacaagatgcacgttc

SEQ ID NO: 670302 - DNA, 25 bp, Homo sapien
aagatgcacgttctggaccttggtg

SEQ ID NO: 670303 - DNA, 25 bp, Homo sapien
gaccttggtggtggcttccctggca

SEQ ID NO: 670304 - DNA, 25 bp, Homo sapien
gcttttctctcactaaatatagcag

SEQ ID NO: 670305 - DNA, 25 bp, Homo sapien
atatagcagttaatatccagtcatt

SEQ ID NO: 670306 - DNA, 25 bp, Homo sapien
tccagtcattaaggagttgtcactc

SEQ ID NO: 670307 - DNA, 25 bp, Homo sapien
gtcactcttcatcagagtcaccgga

SEQ ID NO: 670308 - DNA, 25 bp, Homo sapien
gagtcaccggacctatgcaattaca

SEQ ID NO: 670309 - DNA, 25 bp, Homo sapien
atctctaccatagccatgtggtgca

SEQ ID NO: 670310 - DNA, 25 bp, Homo sapien
catagccatgtggtgcaatgcaaac

SEQ ID NO: 670311 - DNA, 25 bp, Homo sapien
gtggtgcaatgcaaactgctgtaat

SEQ ID NO: 670312 - DNA, 25 bp, Homo sapien
aaactgctgtaattcaagagaggaa

SEQ ID NO: 670313 - DNA, 25 bp, Homo sapien
gagaggaaatttcctcacctcccaa

SEQ ID NO: 670314 - DNA, 25 bp, Homo sapien
ttcctcacctcccaattctgtgtaa

SEQ ID NO: 670315 - DNA, 25 bp, Homo sapien
tgagcctttgtaggaacgagaaacc

SEQ ID NO: 670316 - DNA, 25 bp, Homo sapien
gagaaaccgcatccagcagcagaaa

SEQ ID NO: 670317 - DNA, 25 bp, Homo sapien
agaaacctcacccagcagcgtcttt

SEQ ID NO: 670318 - DNA, 25 bp, Homo sapien
tcttttccggtctcattcaccagcg

SEQ ID NO: 670319 - DNA, 25 bp, Homo sapien
tcaaccaatccctggccaaaagaat

SEQ ID NO: 670320 - DNA, 25 bp, Homo sapien
aggatggactcctagacctctgtta

SEQ ID NO: 670321 - DNA, 25 bp, Homo sapien
agacctctgttaccagcagtgacta

SEQ ID NO: 670322 - DNA, 25 bp, Homo sapien
agcagtgactacctctgtctgggtg

SEQ ID NO: 670323 - DNA, 25 bp, Homo sapien
cctctgtctgggtggttggaacatg

SEQ ID NO: 670324 - DNA, 25 bp, Homo sapien
gaattttattctaagtactgtctac

SEQ ID NO: 670325 - DNA, 25 bp, Homo sapien
attctaagtactgtctacaagttct

SEQ ID NO: 670326 - DNA, 25 bp, Homo sapien
tgatctcgtgatctgtgtgccttgg

SEQ ID NO: 670327 - DNA, 25 bp, Homo sapien
tcatttgtgcatggtttagtctttc

SEQ ID NO: 670328 - DNA, 25 bp, Homo sapien
catttgtgcatggtttagtctttct

SEQ ID NO: 670329 - DNA, 25 bp, Homo sapien
atttgtgcatggtttagtctttctt

SEQ ID NO: 670330 - DNA, 25 bp, Homo sapien
tttgtgcatggtttagtctttcttt

SEQ ID NO: 670331 - DNA, 25 bp, Homo sapien
ttgtgcatggtttagtctttctttt

SEQ ID NO: 670332 - DNA, 25 bp, Homo sapien
catggtttagtctttcttttgaatg

SEQ ID NO: 670333 - DNA, 25 bp, Homo sapien
atggtttagtctttcttttgaatgt

SEQ ID NO: 670334 - DNA, 25 bp, Homo sapien
ggtttagtctttcttttgaatgtgg

SEQ ID NO: 670335 - DNA, 25 bp, Homo sapien
tcttttgaatgtggaagtttttctt

SEQ ID NO: 670336 - DNA, 25 bp, Homo sapien
tttttcttcttatttgtgtgtctaa

SEQ ID NO: 670337 - DNA, 25 bp, Homo sapien
aggaccacaccccatttcagggaag

SEQ ID NO: 670338 - DNA, 25 bp, Homo sapien
accacaccccatttcagggaagcag

SEQ ID NO: 670339 - DNA, 25 bp, Homo sapien
caccccatttcagggaagcaggaaa

SEQ ID NO: 670340 - DNA, 25 bp, Homo sapien
gaagcaggaaagtgcaagctcacca

SEQ ID NO: 670341 - DNA, 25 bp, Homo sapien
agcaggaaagtgcaagctcaccaga

SEQ ID NO: 670342 - DNA, 25 bp, Homo sapien
aggaaagtgcaagctcaccagagtt

SEQ ID NO: 670343 - DNA, 25 bp, Homo sapien
agctcaccagagttcagaaggagga

SEQ ID NO: 670344 - DNA, 25 bp, Homo sapien
agagaattttcaaacaacacaatgt

SEQ ID NO: 670345 - DNA, 25 bp, Homo sapien
caacacaatgtgactatcataatta

SEQ ID NO: 670346 - DNA, 25 bp, Homo sapien
gtgactatcataattatactactag

SEQ ID NO: 670347 - DNA, 25 bp, Homo sapien
tatcataattatactactagacatc

SEQ ID NO: 670348 - DNA, 25 bp, Homo sapien
cagggatgtttcctcagaagggaca

SEQ ID NO: 670349 - DNA, 25 bp, Homo sapien
gaagggacagtctatcaaagcacca

SEQ ID NO: 670350 - DNA, 25 bp, Homo sapien
gacagtctatcaaagcaccaacagc

SEQ ID NO: 670351 - DNA, 25 bp, Homo sapien
caagtgcatcagcaacctcggacac

SEQ ID NO: 670352 - DNA, 25 bp, Homo sapien
agcaacctcggacacccaggctggg

SEQ ID NO: 670353 - DNA, 25 bp, Homo sapien
aagacctggcaatcaggacccactg

SEQ ID NO: 670354 - DNA, 25 bp, Homo sapien
ggccaaagggccaagaggaaccaga

SEQ ID NO: 670355 - DNA, 25 bp, Homo sapien
aagaggaaccagaggtctccgtccg

SEQ ID NO: 670356 - DNA, 25 bp, Homo sapien
gaaccagaggtctccgtccgtgcag

SEQ ID NO: 670357 - DNA, 25 bp, Homo sapien
acgcagctccaggatgtagcgaaga

SEQ ID NO: 670358 - DNA, 25 bp, Homo sapien
tgggtctggaagtgtctgcctcgca

SEQ ID NO: 670359 - DNA, 25 bp, Homo sapien
gaacaccatgatagactgtgcccat

SEQ ID NO: 670360 - DNA, 25 bp, Homo sapien
gactgtgcccatttatacaagttgt

SEQ ID NO: 670361 - DNA, 25 bp, Homo sapien
atattggtctgatttcccttaaggt

SEQ ID NO: 670362 - DNA, 25 bp, Homo sapien
tcccttaaggtttcagttgtagaat

SEQ ID NO: 670363 - DNA, 25 bp, Homo sapien
aacggaaactagacttcatctgcaa

SEQ ID NO: 670364 - DNA, 25 bp, Homo sapien
ctagacttcatctgcaatgttgtaa

SEQ ID NO: 670365 - DNA, 25 bp, Homo sapien
atgttgtaaatcttaatgcccatta

SEQ ID NO: 670366 - DNA, 25 bp, Homo sapien
gactgtgtgcagcttagattcaaat

SEQ ID NO: 670367 - DNA, 25 bp, Homo sapien
attggcaaataaccaggaccagttt

SEQ ID NO: 670368 - DNA, 25 bp, Homo sapien
acaggtcttgggaattgataatgct

SEQ ID NO: 670369 - DNA, 25 bp, Homo sapien
taatgctcaaccaatccacacagat

SEQ ID NO: 670370 - DNA, 25 bp, Homo sapien
gtgaccaaccgtttggtttcacttg

SEQ ID NO: 670371 - DNA, 25 bp, Homo sapien
gtttggtttcacttgagccttaggg

SEQ ID NO: 670372 - DNA, 25 bp, Homo sapien
cacttgagccttagggtgaaaacaa

SEQ ID NO: 670373 - DNA, 25 bp, Homo sapien
gatcatagggtgataccaatcaaca

SEQ ID NO: 670374 - DNA, 25 bp, Homo sapien
gttttctttaggattagcactacac

SEQ ID NO: 670375 - DNA, 25 bp, Homo sapien
taggattagcactacactagatggt

SEQ ID NO: 670376 - DNA, 25 bp, Homo sapien
gatggtgtaggattttcaagtctct

SEQ ID NO: 670377 - DNA, 25 bp, Homo sapien
aggattttcaagtctcttaagagga

SEQ ID NO: 670378 - DNA, 25 bp, Homo sapien
aaaggctaaactctatggtataggt

SEQ ID NO: 670379 - DNA, 25 bp, Homo sapien
ctatggtataggtttacaagtgcta

SEQ ID NO: 670380 - DNA, 25 bp, Homo sapien
caagtgctaagtaagtttcaaggta

SEQ ID NO: 670381 - DNA, 25 bp, Homo sapien
gaaaagtgggttcataggattataa

SEQ ID NO: 670382 - DNA, 25 bp, Homo sapien
aagactaattgcgataacatgcaga

SEQ ID NO: 670383 - DNA, 25 bp, Homo sapien
aattgcgataacatgcagagtgcat

SEQ ID NO: 670384 - DNA, 25 bp, Homo sapien
gtgcatggcatgatatttggtgcct

SEQ ID NO: 670385 - DNA, 25 bp, Homo sapien
atttggtgccttgtcaaagcttgat

SEQ ID NO: 670386 - DNA, 25 bp, Homo sapien
gtcaaagcttgataaacagggtcca

SEQ ID NO: 670387 - DNA, 25 bp, Homo sapien
aaacagggtccagtctaagaaacat

SEQ ID NO: 670388 - DNA, 25 bp, Homo sapien
acagggtccagtctaagaaacatta

SEQ ID NO: 670389 - DNA, 25 bp, Homo sapien
agaaacattagggagacctcttctc

SEQ ID NO: 670390 - DNA, 25 bp, Homo sapien
aacattagggagacctcttctctac

SEQ ID NO: 670391 - DNA, 25 bp, Homo sapien
ttattagctgagtctgatggcacat

SEQ ID NO: 670392 - DNA, 25 bp, Homo sapien
tctggctgatatgatggagttttgc

SEQ ID NO: 670393 - DNA, 25 bp, Homo sapien
ctgccgcttgggttgaagcgattat

SEQ ID NO: 670394 - DNA, 25 bp, Homo sapien
ttgggttgaagcgattatcctgtct

SEQ ID NO: 670395 - DNA, 25 bp, Homo sapien
gggttgaagcgattatcctgtctaa

SEQ ID NO: 670396 - DNA, 25 bp, Homo sapien
gaagcgattatcctgtctaagcctc

SEQ ID NO: 670397 - DNA, 25 bp, Homo sapien
atattttagctttttcacttttcag

SEQ ID NO: 670398 - DNA, 25 bp, Homo sapien
gctttttcacttttcagtatctcct

SEQ ID NO: 670399 - DNA, 25 bp, Homo sapien
ttcacttttcagtatctcctgaggc

SEQ ID NO: 670400 - DNA, 25 bp, Homo sapien
acttttcagtatctcctgaggcttt

SEQ ID NO: 670401 - DNA, 25 bp, Homo sapien
tttcagtatctcctgaggcttttct

SEQ ID NO: 670402 - DNA, 25 bp, Homo sapien
agtatctcctgaggcttttctcatg

SEQ ID NO: 670403 - DNA, 25 bp, Homo sapien
aagcatttgcttcttagattttaaa

SEQ ID NO: 670404 - DNA, 25 bp, Homo sapien
gtagtcttattatgctgaggaaaat

SEQ ID NO: 670405 - DNA, 25 bp, Homo sapien
gctgaggaaaatctttagttgaaag

SEQ ID NO: 670406 - DNA, 25 bp, Homo sapien
ttacagatttttgatgaagggaaga

SEQ ID NO: 670407 - DNA, 25 bp, Homo sapien
attatgttgctggaagactgtctac

SEQ ID NO: 670408 - DNA, 25 bp, Homo sapien
tggaagactgtctacaaataatcaa

SEQ ID NO: 670409 - DNA, 25 bp, Homo sapien
gttactgaatgttatctgaagatgt

SEQ ID NO: 670410 - DNA, 25 bp, Homo sapien
gtgtagtcaagtaaaaagttggcgt

SEQ ID NO: 670411 - DNA, 25 bp, Homo sapien
aagttggcgtatactttcttgggct

SEQ ID NO: 670412 - DNA, 25 bp, Homo sapien
ggcgtatactttcttgggctgcata

SEQ ID NO: 670413 - DNA, 25 bp, Homo sapien
gggctgcatatccaatttaattaaa

SEQ ID NO: 670414 - DNA, 25 bp, Homo sapien
agaaggctcctggaccatgagcttc

SEQ ID NO: 670415 - DNA, 25 bp, Homo sapien
gaggttggacccctctcactgacta

SEQ ID NO: 670416 - DNA, 25 bp, Homo sapien
tggacccctctcactgactagctgt

SEQ ID NO: 670417 - DNA, 25 bp, Homo sapien
ctctcactgactagctgtctggtag

SEQ ID NO: 670418 - DNA, 25 bp, Homo sapien
ctcactgactagctgtctggtaggg

SEQ ID NO: 670419 - DNA, 25 bp, Homo sapien
gtgctaggaccagcctcgcctgtgg

SEQ ID NO: 670420 - DNA, 25 bp, Homo sapien
gttgagctgtttgaggacaaactcc

SEQ ID NO: 670421 - DNA, 25 bp, Homo sapien
gagctgtttgaggacaaactccaag

SEQ ID NO: 670422 - DNA, 25 bp, Homo sapien
tgaggacaaactccaaggtccctta

SEQ ID NO: 670423 - DNA, 25 bp, Homo sapien
aaaagtgccttttagaggctgggca

SEQ ID NO: 670424 - DNA, 25 bp, Homo sapien
aagtgccttttagaggctgggcatg

SEQ ID NO: 670425 - DNA, 25 bp, Homo sapien
gaaagaagaagatctcttgcgtgaa

SEQ ID NO: 670426 - DNA, 25 bp, Homo sapien
gatctcttgcgtgaaaacagcgtgt

SEQ ID NO: 670427 - DNA, 25 bp, Homo sapien
ctcttgcgtgaaaacagcgtgttgc

SEQ ID NO: 670428 - DNA, 25 bp, Homo sapien
gtgaaaacagcgtgttgcaggaaga

SEQ ID NO: 670429 - DNA, 25 bp, Homo sapien
ctaagactggaactagatgaaacaa

SEQ ID NO: 670430 - DNA, 25 bp, Homo sapien
acaaaacatcagaaccagctaaggg

SEQ ID NO: 670431 - DNA, 25 bp, Homo sapien
agactgataaacttctaagggctat

SEQ ID NO: 670432 - DNA, 25 bp, Homo sapien
gataaacttctaagggctatgcaat

SEQ ID NO: 670433 - DNA, 25 bp, Homo sapien
acttctaagggctatgcaattgaat

SEQ ID NO: 670434 - DNA, 25 bp, Homo sapien
ctaagggctatgcaattgaatgaag

SEQ ID NO: 670435 - DNA, 25 bp, Homo sapien
gaagcattaacgaaaaccaatattt

SEQ ID NO: 670436 - DNA, 25 bp, Homo sapien
gctgaagaatcctatgagcatgtat

SEQ ID NO: 670437 - DNA, 25 bp, Homo sapien
gagcatgtatgtttctgctgtaaaa

SEQ ID NO: 670438 - DNA, 25 bp, Homo sapien
aaacgtagttactgtatggcactca

SEQ ID NO: 670439 - DNA, 25 bp, Homo sapien
gtatggcactcaaaaactatgttaa

SEQ ID NO: 670440 - DNA, 25 bp, Homo sapien
tgtatgtaactaggtagggttcctt

SEQ ID NO: 670441 - DNA, 25 bp, Homo sapien
gtagggttcctttcttagatctaga

SEQ ID NO: 670442 - DNA, 25 bp, Homo sapien
gatctagaggaagtacagccaccca

SEQ ID NO: 670443 - DNA, 25 bp, Homo sapien
acagccacccactgacatctgaatt

SEQ ID NO: 670444 - DNA, 25 bp, Homo sapien
catctgaatttatatacctgttgag

SEQ ID NO: 670445 - DNA, 25 bp, Homo sapien
acctgttgagttttgagtgcaccca

SEQ ID NO: 670446 - DNA, 25 bp, Homo sapien
tttagcttccatgttctacttcagc

SEQ ID NO: 670447 - DNA, 25 bp, Homo sapien
tcaaaggttggtgggattttctgat

SEQ ID NO: 670448 - DNA, 25 bp, Homo sapien
tttctgattttactctaggccggca

SEQ ID NO: 670449 - DNA, 25 bp, Homo sapien
ggccggcagattcttaatgccctta

SEQ ID NO: 670450 - DNA, 25 bp, Homo sapien
aagacacatggctattgatttaggt

SEQ ID NO: 670451 - DNA, 25 bp, Homo sapien
aaagagggatgtatctcacttcatt

SEQ ID NO: 670452 - DNA, 25 bp, Homo sapien
atctcacttcatttcttggagttaa

SEQ ID NO: 670453 - DNA, 25 bp, Homo sapien
gagttaagtctctagttgtacaata

SEQ ID NO: 670454 - DNA, 25 bp, Homo sapien
gttgtacaataaactctaactggtt

SEQ ID NO: 670455 - DNA, 25 bp, Homo sapien
taactggtttctaaagatgtcctgg

SEQ ID NO: 670456 - DNA, 25 bp, Homo sapien
gtcctggaaatatctgttaatgtgc

SEQ ID NO: 670457 - DNA, 25 bp, Homo sapien
tctgttaatgtgcatttcttgttct

SEQ ID NO: 670458 - DNA, 25 bp, Homo sapien
ttttgcatgtctgacacccatgact

SEQ ID NO: 670459 - DNA, 25 bp, Homo sapien
acccagaagcaattcagcccaacag

SEQ ID NO: 670460 - DNA, 25 bp, Homo sapien
attcagcccaacaggaggacagctt

SEQ ID NO: 670461 - DNA, 25 bp, Homo sapien
gaggacagcttcaacccattacgat

SEQ ID NO: 670462 - DNA, 25 bp, Homo sapien
tcaacccattacgatttcatctctg

SEQ ID NO: 670463 - DNA, 25 bp, Homo sapien
attacgatttcatctctgccccaac

SEQ ID NO: 670464 - DNA, 25 bp, Homo sapien
agcagcaagcacctgttacctgtcc

SEQ ID NO: 670465 - DNA, 25 bp, Homo sapien
gcctttgaaaaatccctaacctatg

SEQ ID NO: 670466 - DNA, 25 bp, Homo sapien
aaatccctaacctatgagctttgaa

SEQ ID NO: 670467 - DNA, 25 bp, Homo sapien
ccctaacctatgagctttgaataag

SEQ ID NO: 670468 - DNA, 25 bp, Homo sapien
agatgagtacgaacttcatcgccca

SEQ ID NO: 670469 - DNA, 25 bp, Homo sapien
gtgcatgagtcacagcatggatcca

SEQ ID NO: 670470 - DNA, 25 bp, Homo sapien
catgagtcacagcatggatccagga

SEQ ID NO: 670471 - DNA, 25 bp, Homo sapien
tcacagcatggatccaggatgaatc

SEQ ID NO: 670472 - DNA, 25 bp, Homo sapien
agctattgggagctgccctaagcgt

SEQ ID NO: 670473 - DNA, 25 bp, Homo sapien
ctattgggagctgccctaagcgttg

SEQ ID NO: 670474 - DNA, 25 bp, Homo sapien
attgggagctgccctaagcgttgcc

SEQ ID NO: 670475 - DNA, 25 bp, Homo sapien
tgccccccatttgtctgtgaggaaa

SEQ ID NO: 670476 - DNA, 25 bp, Homo sapien
ccccatttgtctgtgaggaaaggcc

SEQ ID NO: 670477 - DNA, 25 bp, Homo sapien
cccatttgtctgtgaggaaaggcca

SEQ ID NO: 670478 - DNA, 25 bp, Homo sapien
ccatttgtctgtgaggaaaggccag

SEQ ID NO: 670479 - DNA, 25 bp, Homo sapien
gcactgacccctcttagatctactt

SEQ ID NO: 670480 - DNA, 25 bp, Homo sapien
gaaggaaccttcagataattttgct

SEQ ID NO: 670481 - DNA, 25 bp, Homo sapien
attttgcttcccagacttcaagtct

SEQ ID NO: 670482 - DNA, 25 bp, Homo sapien
gcttcccagacttcaagtctttcag

SEQ ID NO: 670483 - DNA, 25 bp, Homo sapien
ccagacttcaagtctttcagctggg

SEQ ID NO: 670484 - DNA, 25 bp, Homo sapien
gggtccaagacatcacaaggcagag

SEQ ID NO: 670485 - DNA, 25 bp, Homo sapien
aaggcagagacaagccctcctggaa

SEQ ID NO: 670486 - DNA, 25 bp, Homo sapien
agagacaagccctcctggaattccc

SEQ ID NO: 670487 - DNA, 25 bp, Homo sapien
ccacccaccgtgagcataagaaaac

SEQ ID NO: 670488 - DNA, 25 bp, Homo sapien
ccaccgtgagcataagaaaacttga

SEQ ID NO: 670489 - DNA, 25 bp, Homo sapien
aggagcagtaacacgtgccacttcc

SEQ ID NO: 670490 - DNA, 25 bp, Homo sapien
agcagtaacacgtgccacttccatc

SEQ ID NO: 670491 - DNA, 25 bp, Homo sapien
ctgacttcggcgacatcgctgtgag

SEQ ID NO: 670492 - DNA, 25 bp, Homo sapien
gcgacatcgctgtgagccacgtcgg

SEQ ID NO: 670493 - DNA, 25 bp, Homo sapien
acggcttctcgtccttcaagttcat

SEQ ID NO: 670494 - DNA, 25 bp, Homo sapien
accgacgaccagatcattgtggccc

SEQ ID NO: 670495 - DNA, 25 bp, Homo sapien
gaccagatcattgtggccctcaaat

SEQ ID NO: 670496 - DNA, 25 bp, Homo sapien
gtggccctcaaatccgaggaggaca

SEQ ID NO: 670497 - DNA, 25 bp, Homo sapien
ctcaaatccgaggaggacagcggca

SEQ ID NO: 670498 - DNA, 25 bp, Homo sapien
ggcagagtcgcctcctacatcatgg

SEQ ID NO: 670499 - DNA, 25 bp, Homo sapien
ggcgcttcctgttgccggagaccaa

SEQ ID NO: 670500 - DNA, 25 bp, Homo sapien
tacgaaggcatcgagttcatttaac

SEQ ID NO: 670501 - DNA, 25 bp, Homo sapien
tcatttaactcaaaacggaaacact

SEQ ID NO: 670502 - DNA, 25 bp, Homo sapien
taggaaatgtgaatcctccaacctt

SEQ ID NO: 670503 - DNA, 25 bp, Homo sapien
aaatgtgaatcctccaaccttgttc

SEQ ID NO: 670504 - DNA, 25 bp, Homo sapien
tgaatcctccaaccttgttcttttt

SEQ ID NO: 670505 - DNA, 25 bp, Homo sapien
ttgttctttttcaagcttgattggc

SEQ ID NO: 670506 - DNA, 25 bp, Homo sapien
ctttttcaagcttgattggctattc

SEQ ID NO: 670507 - DNA, 25 bp, Homo sapien
tttcaagcttgattggctattctgg

SEQ ID NO: 670508 - DNA, 25 bp, Homo sapien
tcaagcttgattggctattctgggt

SEQ ID NO: 670509 - DNA, 25 bp, Homo sapien
ggctattctgggtctcttgcacttc

SEQ ID NO: 670510 - DNA, 25 bp, Homo sapien
tattctgggtctcttgcacttccat

SEQ ID NO: 670511 - DNA, 25 bp, Homo sapien
attctgggtctcttgcacttccata

SEQ ID NO: 670512 - DNA, 25 bp, Homo sapien
ttctgggtctcttgcacttccatat

SEQ ID NO: 670513 - DNA, 25 bp, Homo sapien
aacagtgtgacaagagtgatgccat

SEQ ID NO: 670514 - DNA, 25 bp, Homo sapien
gagtgatgccatcttaaaaccgcca

SEQ ID NO: 670515 - DNA, 25 bp, Homo sapien
gatgccatcttaaaaccgccatatg

SEQ ID NO: 670516 - DNA, 25 bp, Homo sapien
aaaaccgccatatgatgatgaatgt

SEQ ID NO: 670517 - DNA, 25 bp, Homo sapien
tgatgaatgtttcacccccatatac

SEQ ID NO: 670518 - DNA, 25 bp, Homo sapien
ccatataccaagctgctctgcagta

SEQ ID NO: 670519 - DNA, 25 bp, Homo sapien
taccaagctgctctgcagtaagctc

SEQ ID NO: 670520 - DNA, 25 bp, Homo sapien
gctgctctgcagtaagctctttaaa

SEQ ID NO: 670521 - DNA, 25 bp, Homo sapien
ctctgcagtaagctctttaaacaat

SEQ ID NO: 670522 - DNA, 25 bp, Homo sapien
ttaaacaatgcctgtaccatacata

SEQ ID NO: 670523 - DNA, 25 bp, Homo sapien
caatgcctgtaccatacataaccct

SEQ ID NO: 670524 - DNA, 25 bp, Homo sapien
agagagatactgagaaggctgttgc

SEQ ID NO: 670525 - DNA, 25 bp, Homo sapien
ggctgttgcattgacagtatctctc

SEQ ID NO: 670526 - DNA, 25 bp, Homo sapien
gttgcattgacagtatctctctgct

SEQ ID NO: 670527 - DNA, 25 bp, Homo sapien
gcattgacagtatctctctgctact

SEQ ID NO: 670528 - DNA, 25 bp, Homo sapien
tgacagtatctctctgctactcaaa

SEQ ID NO: 670529 - DNA, 25 bp, Homo sapien
agtatctctctgctactcaaaggct

SEQ ID NO: 670530 - DNA, 25 bp, Homo sapien
atctctctgctactcaaaggctgac

SEQ ID NO: 670531 - DNA, 25 bp, Homo sapien
tctgctactcaaaggctgactctct

SEQ ID NO: 670532 - DNA, 25 bp, Homo sapien
tactcaaaggctgactctctgctac

SEQ ID NO: 670533 - DNA, 25 bp, Homo sapien
tcaaaggctgactctctgctactca

SEQ ID NO: 670534 - DNA, 25 bp, Homo sapien
tgactctctgctactcagcattggg

SEQ ID NO: 670535 - DNA, 25 bp, Homo sapien
agcccaaatgtccagcaacaaaaga

SEQ ID NO: 670536 - DNA, 25 bp, Homo sapien
gtatatttactacctagcagttgaa

SEQ ID NO: 670537 - DNA, 25 bp, Homo sapien
atttactacctagcagttgaaagaa

SEQ ID NO: 670538 - DNA, 25 bp, Homo sapien
gaaataaacctctgacacacacaag

SEQ ID NO: 670539 - DNA, 25 bp, Homo sapien
ataaacctctgacacacacaagctg

SEQ ID NO: 670540 - DNA, 25 bp, Homo sapien
agaagtcagaccatgctccctaaga

SEQ ID NO: 670541 - DNA, 25 bp, Homo sapien
gtcagaccatgctccctaagagtat

SEQ ID NO: 670542 - DNA, 25 bp, Homo sapien
gaccatgctccctaagagtatatac

SEQ ID NO: 670543 - DNA, 25 bp, Homo sapien
gctccctaagagtatatacttcatg

SEQ ID NO: 670544 - DNA, 25 bp, Homo sapien
atacttcatgattcaatttctgtac

SEQ ID NO: 670545 - DNA, 25 bp, Homo sapien
gattcaatttctgtacaattctata

SEQ ID NO: 670546 - DNA, 25 bp, Homo sapien
gaaaggtcaatgctagtgagtatga

SEQ ID NO: 670547 - DNA, 25 bp, Homo sapien
gtgagtatgaatgaacacatagcaa

SEQ ID NO: 670548 - DNA, 25 bp, Homo sapien
aatttcaggtagaacagccatgcca

SEQ ID NO: 670549 - DNA, 25 bp, Homo sapien
gtgggacaggtgaggccgagtgaat

SEQ ID NO: 670550 - DNA, 25 bp, Homo sapien
aagaagtagccccagagacactcaa

SEQ ID NO: 670551 - DNA, 25 bp, Homo sapien
gtagccccagagacactcaaggtgg

SEQ ID NO: 670552 - DNA, 25 bp, Homo sapien
gacactcaaggtggttccagctgct

SEQ ID NO: 670553 - DNA, 25 bp, Homo sapien
ttctttctaagaggtggctgggctt

SEQ ID NO: 670554 - DNA, 25 bp, Homo sapien
ggcttggtttcagcgtattccaatt

SEQ ID NO: 670555 - DNA, 25 bp, Homo sapien
ggtttcagcgtattccaatttggga

SEQ ID NO: 670556 - DNA, 25 bp, Homo sapien
cagcgtattccaatttgggactcat

SEQ ID NO: 670557 - DNA, 25 bp, Homo sapien
gacagtgacaaagcaatggataaag

SEQ ID NO: 670558 - DNA, 25 bp, Homo sapien
aaggaattatgggtaccagtgagat

SEQ ID NO: 670559 - DNA, 25 bp, Homo sapien
gatttggagtcctagggacaaagat

SEQ ID NO: 670560 - DNA, 25 bp, Homo sapien
aactgtgattggtgatgtcaagatc

SEQ ID NO: 670561 - DNA, 25 bp, Homo sapien
agatcaagagtactgtcttacaggg

SEQ ID NO: 670562 - DNA, 25 bp, Homo sapien
ggaaccagtgacagaggtcaagaag

SEQ ID NO: 670563 - DNA, 25 bp, Homo sapien
gatgagaccactgcaatggtaattt

SEQ ID NO: 670564 - DNA, 25 bp, Homo sapien
ccactgcaatggtaatttcatgaca

SEQ ID NO: 670565 - DNA, 25 bp, Homo sapien
tttcatgacatgtacaggtgttgat

SEQ ID NO: 670566 - DNA, 25 bp, Homo sapien
ggtgttgataattcctttgtgctgg

SEQ ID NO: 670567 - DNA, 25 bp, Homo sapien
taattcctttgtgctggacaaggta

SEQ ID NO: 670568 - DNA, 25 bp, Homo sapien
ggataaaaatagcacttgccagccg

SEQ ID NO: 670569 - DNA, 25 bp, Homo sapien
gataaaaatagcacttgccagccgg

SEQ ID NO: 670570 - DNA, 25 bp, Homo sapien
ataaaaatagcacttgccagccggg

SEQ ID NO: 670571 - DNA, 25 bp, Homo sapien
taaaaatagcacttgccagccgggc

SEQ ID NO: 670572 - DNA, 25 bp, Homo sapien
aaaaatagcacttgccagccgggcg

SEQ ID NO: 670573 - DNA, 25 bp, Homo sapien
aaaatagcacttgccagccgggcgt

SEQ ID NO: 670574 - DNA, 25 bp, Homo sapien
aaatagcacttgccagccgggcgtg

SEQ ID NO: 670575 - DNA, 25 bp, Homo sapien
aatagcacttgccagccgggcgtgg

SEQ ID NO: 670576 - DNA, 25 bp, Homo sapien
gctgttttctattaagccagaaact

SEQ ID NO: 670577 - DNA, 25 bp, Homo sapien
agccagaaactaaaaagatttgcaa

SEQ ID NO: 670578 - DNA, 25 bp, Homo sapien
taaatcgtattctttttgttaacat

SEQ ID NO: 670579 - DNA, 25 bp, Homo sapien
gtgttacttgccgtttttcactctc

SEQ ID NO: 670580 - DNA, 25 bp, Homo sapien
tgttacttgccgtttttcactctca

SEQ ID NO: 670581 - DNA, 25 bp, Homo sapien
gttacttgccgtttttcactctcat

SEQ ID NO: 670582 - DNA, 25 bp, Homo sapien
ttacttgccgtttttcactctcatt

SEQ ID NO: 670583 - DNA, 25 bp, Homo sapien
tcactctcattctcttgtgagtgta

SEQ ID NO: 670584 - DNA, 25 bp, Homo sapien
ggaattttccagatatgtaatattg

SEQ ID NO: 670585 - DNA, 25 bp, Homo sapien
gtaatattggagttgattgaatgca

SEQ ID NO: 670586 - DNA, 25 bp, Homo sapien
tattggagttgattgaatgcaggag

SEQ ID NO: 670587 - DNA, 25 bp, Homo sapien
actttctcttcacggctgtaccaga

SEQ ID NO: 670588 - DNA, 25 bp, Homo sapien
cggctgtaccagaaaatccctaaga

SEQ ID NO: 670589 - DNA, 25 bp, Homo sapien
aatccctaagacagatcttgccgtg

SEQ ID NO: 670590 - DNA, 25 bp, Homo sapien
aagacagatcttgccgtggactagc

SEQ ID NO: 670591 - DNA, 25 bp, Homo sapien
gtggactagcaatacctgcaagtgc

SEQ ID NO: 670592 - DNA, 25 bp, Homo sapien
gaactcaatttattcctgggaacct

SEQ ID NO: 670593 - DNA, 25 bp, Homo sapien
gaacctaacgaggagagcccaggcc

SEQ ID NO: 670594 - DNA, 25 bp, Homo sapien
taggcaggaggcctggaaccctctt

SEQ ID NO: 670595 - DNA, 25 bp, Homo sapien
gaaccctcttggctaaggtgctgtt

SEQ ID NO: 670596 - DNA, 25 bp, Homo sapien
gaaatggtgaaggaaccagcccaat

SEQ ID NO: 670597 - DNA, 25 bp, Homo sapien
ggaaccagcccaatagaagtacaga

SEQ ID NO: 670598 - DNA, 25 bp, Homo sapien
taccactgacaaacaggcctggctg

SEQ ID NO: 670599 - DNA, 25 bp, Homo sapien
cctggctgcaaggtgtgcgtgtcac

SEQ ID NO: 670600 - DNA, 25 bp, Homo sapien
aaggtgtgcgtgtcaccaggacctg

SEQ ID NO: 670601 - DNA, 25 bp, Homo sapien
acctggccaccagagggcgacagag

SEQ ID NO: 670602 - DNA, 25 bp, Homo sapien
atgagggtcgaacagtttcccagaa

SEQ ID NO: 670603 - DNA, 25 bp, Homo sapien
gaaggagccaaatcccctgacacat

SEQ ID NO: 670604 - DNA, 25 bp, Homo sapien
tccagcccaaaaactgccagacttg

SEQ ID NO: 670605 - DNA, 25 bp, Homo sapien
gccagacttgctagcatttgccagt

SEQ ID NO: 670606 - DNA, 25 bp, Homo sapien
atttgccagtccaccgaaacaaaca

SEQ ID NO: 670607 - DNA, 25 bp, Homo sapien
gaaacaaacatctcaccttcatcgt

SEQ ID NO: 670608 - DNA, 25 bp, Homo sapien
ccttcatcgtacagttccttggtaa

SEQ ID NO: 670609 - DNA, 25 bp, Homo sapien
agactacatgtacctcgccaaagag

SEQ ID NO: 670610 - DNA, 25 bp, Homo sapien
gggcctattatggtcatttctaaat

SEQ ID NO: 670611 - DNA, 25 bp, Homo sapien
caaaatgggtaggttcttcagacac

SEQ ID NO: 670612 - DNA, 25 bp, Homo sapien
ggttcttcagacacaatgtaactta

SEQ ID NO: 670613 - DNA, 25 bp, Homo sapien
taagtcatttttcccctttgccact

SEQ ID NO: 670614 - DNA, 25 bp, Homo sapien
ctttgccactctgctatatacacag

SEQ ID NO: 670615 - DNA, 25 bp, Homo sapien
gaacatgtaattttctaccataaga

SEQ ID NO: 670616 - DNA, 25 bp, Homo sapien
gaagttacgcttttgctaaccatcg

SEQ ID NO: 670617 - DNA, 25 bp, Homo sapien
gcttttgctaaccatcgtagatcat

SEQ ID NO: 670618 - DNA, 25 bp, Homo sapien
tcagcttcaattaatggccaacata

SEQ ID NO: 670619 - DNA, 25 bp, Homo sapien
taatggccaacataatgggctttta

SEQ ID NO: 670620 - DNA, 25 bp, Homo sapien
atgtgaacagagaaatgcctcccgt

SEQ ID NO: 670621 - DNA, 25 bp, Homo sapien
aatgcctcccgtagtgtttgaaagc

SEQ ID NO: 670622 - DNA, 25 bp, Homo sapien
actgctgagagatcaaagattcaac

SEQ ID NO: 670623 - DNA, 25 bp, Homo sapien
aagattcaacttgccatacacctca

SEQ ID NO: 670624 - DNA, 25 bp, Homo sapien
ttgccatacacctcaaattcggaga

SEQ ID NO: 670625 - DNA, 25 bp, Homo sapien
aatttgggcaaatctacagttctgt

SEQ ID NO: 670626 - DNA, 25 bp, Homo sapien
acagttctgtttttgctactctatt

SEQ ID NO: 670627 - DNA, 25 bp, Homo sapien
gctactctattgtcattcctgttta

SEQ ID NO: 670628 - DNA, 25 bp, Homo sapien
gtcattcctgtttaatactcactgt

SEQ ID NO: 670629 - DNA, 25 bp, Homo sapien
tactcactgtacttgtatttgagac

SEQ ID NO: 670630 - DNA, 25 bp, Homo sapien
cttttccattaaaacattggcacct

SEQ ID NO: 670631 - DNA, 25 bp, Homo sapien
gactaatacccaaattttctttctg

SEQ ID NO: 670632 - DNA, 25 bp, Homo sapien
tttctgccatctaacataaatcctg

SEQ ID NO: 670633 - DNA, 25 bp, Homo sapien
ataaatcctgaaggtcacagtttag

SEQ ID NO: 670634 - DNA, 25 bp, Homo sapien
cctgaaggtcacagtttagtactca

SEQ ID NO: 670635 - DNA, 25 bp, Homo sapien
agtactcatagtttttaaatgctaa

SEQ ID NO: 670636 - DNA, 25 bp, Homo sapien
aatgctaaagttgtgtgagtatgaa

SEQ ID NO: 670637 - DNA, 25 bp, Homo sapien
aagcaaatacctctcagggttttag

SEQ ID NO: 670638 - DNA, 25 bp, Homo sapien
atacctctcagggttttagtgccat

SEQ ID NO: 670639 - DNA, 25 bp, Homo sapien
ctcagggttttagtgccatcgggaa

SEQ ID NO: 670640 - DNA, 25 bp, Homo sapien
tgccatcgggaaggatatttctaaa

SEQ ID NO: 670641 - DNA, 25 bp, Homo sapien
gagtacatttcaatcaaagctggtt

SEQ ID NO: 670642 - DNA, 25 bp, Homo sapien
gcattagaagactcactgtggttta

SEQ ID NO: 670643 - DNA, 25 bp, Homo sapien
caggtactgctgtagttttgtgaac

SEQ ID NO: 670644 - DNA, 25 bp, Homo sapien
ggactggcatgatgtgcacaccctg

SEQ ID NO: 670645 - DNA, 25 bp, Homo sapien
gcacaccctgggtacttaatcgata

SEQ ID NO: 670646 - DNA, 25 bp, Homo sapien
taatcgatagttatccctcggtgct

SEQ ID NO: 670647 - DNA, 25 bp, Homo sapien
atagttatccctcggtgctttcagt

SEQ ID NO: 670648 - DNA, 25 bp, Homo sapien
tttcagtcctcactctatgcagagc

SEQ ID NO: 670649 - DNA, 25 bp, Homo sapien
actctatgcagagcactgttgtgcc

SEQ ID NO: 670650 - DNA, 25 bp, Homo sapien
ttgtgccaggccctcaaaagctgat

SEQ ID NO: 670651 - DNA, 25 bp, Homo sapien
aggccctcaaaagctgatcatctag

SEQ ID NO: 670652 - DNA, 25 bp, Homo sapien
gttttgaagttgatcatctcatcat

SEQ ID NO: 670653 - DNA, 25 bp, Homo sapien
ggctatgtgataatagttactcatt

SEQ ID NO: 670654 - DNA, 25 bp, Homo sapien
ttgtatcttttaatgtgtcagtgaa

SEQ ID NO: 670655 - DNA, 25 bp, Homo sapien
gatgagagcataacctttggcactt

SEQ ID NO: 670656 - DNA, 25 bp, Homo sapien
gagcataacctttggcacttcaaat

SEQ ID NO: 670657 - DNA, 25 bp, Homo sapien
gtttgaagtcaggttatgagccaat

SEQ ID NO: 670658 - DNA, 25 bp, Homo sapien
aaatgtttgtatggcactttgtagc

SEQ ID NO: 670659 - DNA, 25 bp, Homo sapien
actttgtagccataagtgctattga

SEQ ID NO: 670660 - DNA, 25 bp, Homo sapien
ggagtggctcagaaagctgttttcc

SEQ ID NO: 670661 - DNA, 25 bp, Homo sapien
gaggccctgagaaaaatctcactaa

SEQ ID NO: 670662 - DNA, 25 bp, Homo sapien
atctcactaagatatgcttggcttc

SEQ ID NO: 670663 - DNA, 25 bp, Homo sapien
gcttggcttcaaaagatgactcaac

SEQ ID NO: 670664 - DNA, 25 bp, Homo sapien
ggatgggatctctgtatcatgtttt

SEQ ID NO: 670665 - DNA, 25 bp, Homo sapien
aaatcacttatttcagagtgcaaca

SEQ ID NO: 670666 - DNA, 25 bp, Homo sapien
gagtgcaacacaaggctgcattttt

SEQ ID NO: 670667 - DNA, 25 bp, Homo sapien
gacacattcaatcttgcatcctaat

SEQ ID NO: 670668 - DNA, 25 bp, Homo sapien
gcatcctaatacaagcagtacggaa

SEQ ID NO: 670669 - DNA, 25 bp, Homo sapien
tctcagccaagtgactcgacgttta

SEQ ID NO: 670670 - DNA, 25 bp, Homo sapien
agccaagtgactcgacgtttatcca

SEQ ID NO: 670671 - DNA, 25 bp, Homo sapien
tgactcgacgtttatccacttctgt

SEQ ID NO: 670672 - DNA, 25 bp, Homo sapien
ccacttctgttcatttgatcgtttc

SEQ ID NO: 670673 - DNA, 25 bp, Homo sapien
ctgttcatttgatcgtttcagtaat

SEQ ID NO: 670674 - DNA, 25 bp, Homo sapien
ttgatcgtttcagtaatatgcttac

SEQ ID NO: 670675 - DNA, 25 bp, Homo sapien
ttgtaaaggcaagacatgaaatcat

SEQ ID NO: 670676 - DNA, 25 bp, Homo sapien
tacatacagtatgctctcattaacc

SEQ ID NO: 670677 - DNA, 25 bp, Homo sapien
tacagtatgctctcattaaccttaa

SEQ ID NO: 670678 - DNA, 25 bp, Homo sapien
gtatgctctcattaaccttaaaaaa

SEQ ID NO: 670679 - DNA, 25 bp, Homo sapien
aaaagtgatggctataagatgataa

SEQ ID NO: 670680 - DNA, 25 bp, Homo sapien
aatgctgttcttcattgtccagatt

SEQ ID NO: 670681 - DNA, 25 bp, Homo sapien
atgctgttcttcattgtccagattt

SEQ ID NO: 670682 - DNA, 25 bp, Homo sapien
tcttcattgtccagattttcactcc

SEQ ID NO: 670683 - DNA, 25 bp, Homo sapien
attgtccagattttcactcctgagg

SEQ ID NO: 670684 - DNA, 25 bp, Homo sapien
tgtccagattttcactcctgaggaa

SEQ ID NO: 670685 - DNA, 25 bp, Homo sapien
tccagattttcactcctgaggaaat

SEQ ID NO: 670686 - DNA, 25 bp, Homo sapien
cttgatgattcataaagctttgtga

SEQ ID NO: 670687 - DNA, 25 bp, Homo sapien
tgtgaagtgtggttactgcaagact

SEQ ID NO: 670688 - DNA, 25 bp, Homo sapien
ctgcaagacttggagtagtttgaaa

SEQ ID NO: 670689 - DNA, 25 bp, Homo sapien
tagctaatgcaacaagccttcctct

SEQ ID NO: 670690 - DNA, 25 bp, Homo sapien
ttcctctcacaaaaggaagccattt

SEQ ID NO: 670691 - DNA, 25 bp, Homo sapien
ggaagccatttacataactctgagc

SEQ ID NO: 670692 - DNA, 25 bp, Homo sapien
gccatttacataactctgagcttct

SEQ ID NO: 670693 - DNA, 25 bp, Homo sapien
cataactctgagcttctgaaggaag

SEQ ID NO: 670694 - DNA, 25 bp, Homo sapien
aatttcctcaacttgctgtcaagaa

SEQ ID NO: 670695 - DNA, 25 bp, Homo sapien
ctgtcaagaaaggagctggaagcaa

SEQ ID NO: 670696 - DNA, 25 bp, Homo sapien
aaggatctcagttttcattcctgtt

SEQ ID NO: 670697 - DNA, 25 bp, Homo sapien
gggctgagaggcacctcattcccaa

SEQ ID NO: 670698 - DNA, 25 bp, Homo sapien
acctcattcccaatggccagcatgg

SEQ ID NO: 670699 - DNA, 25 bp, Homo sapien
gcatggccattagctggaagcctac

SEQ ID NO: 670700 - DNA, 25 bp, Homo sapien
ttagctggaagcctacaggactccc

SEQ ID NO: 670701 - DNA, 25 bp, Homo sapien
ggaagcctacaggactcccatggca

SEQ ID NO: 670702 - DNA, 25 bp, Homo sapien
cccatggcacagcatgctgcaagta

SEQ ID NO: 670703 - DNA, 25 bp, Homo sapien
cagcatgctgcaagtactgttggca

SEQ ID NO: 670704 - DNA, 25 bp, Homo sapien
tgcaagtactgttggcagcctggct

SEQ ID NO: 670705 - DNA, 25 bp, Homo sapien
ccacctaagatgtgtttaccaaaat

SEQ ID NO: 670706 - DNA, 25 bp, Homo sapien
gttaaatataagcatgcccatggat

SEQ ID NO: 670707 - DNA, 25 bp, Homo sapien
ataagcatgcccatggatttttact

SEQ ID NO: 670708 - DNA, 25 bp, Homo sapien
aggttatccacctgtagacctggac

SEQ ID NO: 670709 - DNA, 25 bp, Homo sapien
ctgtagacctggacgggaccctcga

SEQ ID NO: 670710 - DNA, 25 bp, Homo sapien
tccctactctgaccatctggtttta

SEQ ID NO: 670711 - DNA, 25 bp, Homo sapien
gaaccagaagccgaggcagggtctc

SEQ ID NO: 670712 - DNA, 25 bp, Homo sapien
aagcaggctgtttccatcttcagga

SEQ ID NO: 670713 - DNA, 25 bp, Homo sapien
ggatacaagccatctgcgcatagga

SEQ ID NO: 670714 - DNA, 25 bp, Homo sapien
tcactcactggacggaggacctgac

SEQ ID NO: 670715 - DNA, 25 bp, Homo sapien
cccgttcccatcattggttctgaat

SEQ ID NO: 670716 - DNA, 25 bp, Homo sapien
attggttctgaatccatcagcccag

SEQ ID NO: 670717 - DNA, 25 bp, Homo sapien
agcccagcaagacaggtgtctccag

SEQ ID NO: 670718 - DNA, 25 bp, Homo sapien
gtaaaatacaaccatagccgggcct

SEQ ID NO: 670719 - DNA, 25 bp, Homo sapien
agaatgaatgcatcccaccctttcc

SEQ ID NO: 670720 - DNA, 25 bp, Homo sapien
tcccacccttggcacctgggagaat

SEQ ID NO: 670721 - DNA, 25 bp, Homo sapien
cttggcacctgggagaattctctaa

SEQ ID NO: 670722 - DNA, 25 bp, Homo sapien
tctaaggcgtgttcaacaccctggc

SEQ ID NO: 670723 - DNA, 25 bp, Homo sapien
aaggcgtgttcaacaccctggccct

SEQ ID NO: 670724 - DNA, 25 bp, Homo sapien
acaggtgggtccctcttcaaactgg

SEQ ID NO: 670725 - DNA, 25 bp, Homo sapien
aggtgggtccctcttcaaactggca

SEQ ID NO: 670726 - DNA, 25 bp, Homo sapien
ggtccctcttcaaactggcacattt

SEQ ID NO: 670727 - DNA, 25 bp, Homo sapien
cctcttcaaactggcacattttctt

SEQ ID NO: 670728 - DNA, 25 bp, Homo sapien
ttcaaactggcacattttcttaatg

SEQ ID NO: 670729 - DNA, 25 bp, Homo sapien
tttcttaatgatgcctcttttccca

SEQ ID NO: 670730 - DNA, 25 bp, Homo sapien
aacccccaggatcagagatggagtc

SEQ ID NO: 670731 - DNA, 25 bp, Homo sapien
acccccaggatcagagatggagtct

SEQ ID NO: 670732 - DNA, 25 bp, Homo sapien
cccccaggatcagagatggagtctc

SEQ ID NO: 670733 - DNA, 25 bp, Homo sapien
tggaatgtagtggcatcattgtaac

SEQ ID NO: 670734 - DNA, 25 bp, Homo sapien
ggaatgtagtggcatcattgtaact

SEQ ID NO: 670735 - DNA, 25 bp, Homo sapien
gaatgtagtggcatcattgtaactc

SEQ ID NO: 670736 - DNA, 25 bp, Homo sapien
aatgtagtggcatcattgtaactca

SEQ ID NO: 670737 - DNA, 25 bp, Homo sapien
gaactataggcacaagctaccatgc

SEQ ID NO: 670738 - DNA, 25 bp, Homo sapien
gtgtggcgtgctgggcctttattct

SEQ ID NO: 670739 - DNA, 25 bp, Homo sapien
ggcctttattcttctgggacacaaa

SEQ ID NO: 670740 - DNA, 25 bp, Homo sapien
tattcttctgggacacaaacacggg

SEQ ID NO: 670741 - DNA, 25 bp, Homo sapien
tctgggacacaaacacgggactgct

SEQ ID NO: 670742 - DNA, 25 bp, Homo sapien
aacacgggactgctgattggtctct

SEQ ID NO: 670743 - DNA, 25 bp, Homo sapien
gggactgctgattggtctctgatat

SEQ ID NO: 670744 - DNA, 25 bp, Homo sapien
gtctctgatatagaccctggagtct

SEQ ID NO: 670745 - DNA, 25 bp, Homo sapien
gatatagaccctggagtctgctcct

SEQ ID NO: 670746 - DNA, 25 bp, Homo sapien
agaccctggagtctgctccttttgt

SEQ ID NO: 670747 - DNA, 25 bp, Homo sapien
aaggaggaaattccagccgcaccac

SEQ ID NO: 670748 - DNA, 25 bp, Homo sapien
agccgcaccacatttgcaaacgaca

SEQ ID NO: 670749 - DNA, 25 bp, Homo sapien
cttgggaaccccagtcctgagcttg

SEQ ID NO: 670750 - DNA, 25 bp, Homo sapien
agagaatccttcctcagctctcttc

SEQ ID NO: 670751 - DNA, 25 bp, Homo sapien
agctctcttctttccaggggaagga

SEQ ID NO: 670752 - DNA, 25 bp, Homo sapien
gggtatccagagagccatacttctg

SEQ ID NO: 670753 - DNA, 25 bp, Homo sapien
gagagccatacttctgagggaagac

SEQ ID NO: 670754 - DNA, 25 bp, Homo sapien
ctgagggaagactggctggcaataa

SEQ ID NO: 670755 - DNA, 25 bp, Homo sapien
ctggctggcaataaagtcaaattaa

SEQ ID NO: 670756 - DNA, 25 bp, Homo sapien
gactctgggtcatccgagtccagaa

SEQ ID NO: 670757 - DNA, 25 bp, Homo sapien
gtcatccgagtccagaaaagacaca

SEQ ID NO: 670758 - DNA, 25 bp, Homo sapien
gacacaaaatgccaaggatgaagaa

SEQ ID NO: 670759 - DNA, 25 bp, Homo sapien
ctgactgctccttgggaaccccagt

SEQ ID NO: 670760 - DNA, 25 bp, Homo sapien
tccatcaccaaagtaggccaaaaga

SEQ ID NO: 670761 - DNA, 25 bp, Homo sapien
gtaggccaaaagaaaacgcctgctt

SEQ ID NO: 670762 - DNA, 25 bp, Homo sapien
agaaaacgcctgctttcccaccgtg

SEQ ID NO: 670763 - DNA, 25 bp, Homo sapien
accgtgctgctcgaaaccacgaaaa

SEQ ID NO: 670764 - DNA, 25 bp, Homo sapien
ccacgaaaacataggccacaggtca

SEQ ID NO: 670765 - DNA, 25 bp, Homo sapien
gccacaggtcatagggccctggcag

SEQ ID NO: 670766 - DNA, 25 bp, Homo sapien
tagggccctggcagccaaggatcaa

SEQ ID NO: 670767 - DNA, 25 bp, Homo sapien
gccaaggatcaagaaacagctccgg

SEQ ID NO: 670768 - DNA, 25 bp, Homo sapien
aaacagctccgggtccttgctgaaa

SEQ ID NO: 670769 - DNA, 25 bp, Homo sapien
gggtccttgctgaaattgccaaata

SEQ ID NO: 670770 - DNA, 25 bp, Homo sapien
taagtcaattctttgggcctactcc

SEQ ID NO: 670771 - DNA, 25 bp, Homo sapien
gtcccaagctgaggagatgagccga

SEQ ID NO: 670772 - DNA, 25 bp, Homo sapien
ggagatgagccgagcagtaaaaaga

SEQ ID NO: 670773 - DNA, 25 bp, Homo sapien
ggaggtttggaaaagcaatgtcctc

SEQ ID NO: 670774 - DNA, 25 bp, Homo sapien
agcaatgtcctctcagtctttaata

SEQ ID NO: 670775 - DNA, 25 bp, Homo sapien
atgtcctctcagtctttaataggtg

SEQ ID NO: 670776 - DNA, 25 bp, Homo sapien
ctctcagtctttaataggtggcccc

SEQ ID NO: 670777 - DNA, 25 bp, Homo sapien
gaacctgctggaagtggaagttaat

SEQ ID NO: 670778 - DNA, 25 bp, Homo sapien
ggaagttaataagctgaaggtggtc

SEQ ID NO: 670779 - DNA, 25 bp, Homo sapien
aatcattccttttaattaatagtgg

SEQ ID NO: 670780 - DNA, 25 bp, Homo sapien
ggcaaacaaaaggtggctctgaagc

SEQ ID NO: 670781 - DNA, 25 bp, Homo sapien
aaaaggtggctctgaagcgatatat

SEQ ID NO: 670782 - DNA, 25 bp, Homo sapien
atgagctacgatgaaaagcgccagc

SEQ ID NO: 670783 - DNA, 25 bp, Homo sapien
aaaagcgccagcttagcctggacat

SEQ ID NO: 670784 - DNA, 25 bp, Homo sapien
agcttagcctggacatcaaccggct

SEQ ID NO: 670785 - DNA, 25 bp, Homo sapien
gggccgggtagtgcacatcatccaa

SEQ ID NO: 670786 - DNA, 25 bp, Homo sapien
gggtagtgcacatcatccaatctcg

SEQ ID NO: 670787 - DNA, 25 bp, Homo sapien
agtgcacatcatccaatctcgggag

SEQ ID NO: 670788 - DNA, 25 bp, Homo sapien
atctcgggagccctcgctcagggac

SEQ ID NO: 670789 - DNA, 25 bp, Homo sapien
gggagccctcgctcagggactccaa

SEQ ID NO: 670790 - DNA, 25 bp, Homo sapien
aattgactttgagactctgaaaccc

SEQ ID NO: 670791 - DNA, 25 bp, Homo sapien
ctttgcgggaactggagagatatgt

SEQ ID NO: 670792 - DNA, 25 bp, Homo sapien
ggagagatatgtcaagtcttgttta

SEQ ID NO: 670793 - DNA, 25 bp, Homo sapien
gaagttggaatcactgaatatgtaa

SEQ ID NO: 670794 - DNA, 25 bp, Homo sapien
ggtgataaccgcaagtttgaaatct

SEQ ID NO: 670795 - DNA, 25 bp, Homo sapien
aggaagaagtttatattgtccaggc

SEQ ID NO: 670796 - DNA, 25 bp, Homo sapien
atattgtccaggcttctaatgtaga

SEQ ID NO: 670797 - DNA, 25 bp, Homo sapien
gtccaggcttctaatgtagatgtga

SEQ ID NO: 670798 - DNA, 25 bp, Homo sapien
agatgtgaagatgacgtggctaaaa

SEQ ID NO: 670799 - DNA, 25 bp, Homo sapien
attttgttgaagcagcaggaacttt

SEQ ID NO: 670800 - DNA, 25 bp, Homo sapien
gcagcaggaacttttgacagttaaa

SEQ ID NO: 670801 - DNA, 25 bp, Homo sapien
agaaagcaacaggatcaattaacag

SEQ ID NO: 670802 - DNA, 25 bp, Homo sapien
gaacgggataagtttcagatttctc

SEQ ID NO: 670803 - DNA, 25 bp, Homo sapien
ctgtgtcggagatggctctcctata

SEQ ID NO: 670804 - DNA, 25 bp, Homo sapien
cctctgttgcagaactggagttgct

SEQ ID NO: 670805 - DNA, 25 bp, Homo sapien
aaatgtgaactgatggcccttggac

SEQ ID NO: 670806 - DNA, 25 bp, Homo sapien
ctgatggcccttggactgaaatgtg

SEQ ID NO: 670807 - DNA, 25 bp, Homo sapien
ggagcgggcagcaagactcttctct

SEQ ID NO: 670808 - DNA, 25 bp, Homo sapien
gcaagactcttctctgtcagaggac

SEQ ID NO: 670809 - DNA, 25 bp, Homo sapien
aggagcaaattgacccggctttatt

SEQ ID NO: 670810 - DNA, 25 bp, Homo sapien
attgacccggctttatttgccaagc

SEQ ID NO: 670811 - DNA, 25 bp, Homo sapien
atcagagctgattcctatttgttta

SEQ ID NO: 670812 - DNA, 25 bp, Homo sapien
gtgtctaccatttacaacctgcata

SEQ ID NO: 670813 - DNA, 25 bp, Homo sapien
aacctgcataatgtggactcttgac

SEQ ID NO: 670814 - DNA, 25 bp, Homo sapien
gactcttgaccagtattcctgttga

SEQ ID NO: 670815 - DNA, 25 bp, Homo sapien
ttaaggctgaagaactatgccctgg

SEQ ID NO: 670816 - DNA, 25 bp, Homo sapien
accaaagaggagctgtagtctggaa

SEQ ID NO: 670817 - DNA, 25 bp, Homo sapien
agaggagctgtagtctggaagataa

SEQ ID NO: 670818 - DNA, 25 bp, Homo sapien
aagagcctttggtaccgcaagccct

SEQ ID NO: 670819 - DNA, 25 bp, Homo sapien
cgcaagccctgtcatctgtgagtgt

SEQ ID NO: 670820 - DNA, 25 bp, Homo sapien
tcatctgtgagtgtggcacagtgaa

SEQ ID NO: 670821 - DNA, 25 bp, Homo sapien
agtgaaggcctggagagtcatgacc

SEQ ID NO: 670822 - DNA, 25 bp, Homo sapien
tggagagtcatgacctaggccctgt

SEQ ID NO: 670823 - DNA, 25 bp, Homo sapien
agagtcatgacctaggccctgtgaa

SEQ ID NO: 670824 - DNA, 25 bp, Homo sapien
agtcatgacctaggccctgtgaagt

SEQ ID NO: 670825 - DNA, 25 bp, Homo sapien
ggccctgtgaagtcaagtattttta

SEQ ID NO: 670826 - DNA, 25 bp, Homo sapien
gaattaggtcatatgaacggattga

SEQ ID NO: 670827 - DNA, 25 bp, Homo sapien
gaacggattgaagagtagtgtatgc

SEQ ID NO: 670828 - DNA, 25 bp, Homo sapien
atttgattgagtggtggctcctggt

SEQ ID NO: 670829 - DNA, 25 bp, Homo sapien
aaagagggtcatctttccctgaagc

SEQ ID NO: 670830 - DNA, 25 bp, Homo sapien
agggtcatctttccctgaagccgca

SEQ ID NO: 670831 - DNA, 25 bp, Homo sapien
tgaagccgcaccatctgaagttagc

SEQ ID NO: 670832 - DNA, 25 bp, Homo sapien
caccatctgaagttagctgcgtcta

SEQ ID NO: 670833 - DNA, 25 bp, Homo sapien
agctgcgtctatctgtagtcttcaa

SEQ ID NO: 670834 - DNA, 25 bp, Homo sapien
atctgtagtcttcaacactcttgct

SEQ ID NO: 670835 - DNA, 25 bp, Homo sapien
agtcttcaacactcttgctgcttct

SEQ ID NO: 670836 - DNA, 25 bp, Homo sapien
tgctcaccgctcagccgcttgtgtt

SEQ ID NO: 670837 - DNA, 25 bp, Homo sapien
ggagtacagtggcctacacctgtaa

SEQ ID NO: 670838 - DNA, 25 bp, Homo sapien
aaaatcagcagcgtgtagtggatac

SEQ ID NO: 670839 - DNA, 25 bp, Homo sapien
aaatcagcagcgtgtagtggataca

SEQ ID NO: 670840 - DNA, 25 bp, Homo sapien
aatcagcagcgtgtagtggatacat

SEQ ID NO: 670841 - DNA, 25 bp, Homo sapien
atcagcagcgtgtagtggatacatg

SEQ ID NO: 670842 - DNA, 25 bp, Homo sapien
tcagcagcgtgtagtggatacatgc

SEQ ID NO: 670843 - DNA, 25 bp, Homo sapien
cagcagcgtgtagtggatacatgcc

SEQ ID NO: 670844 - DNA, 25 bp, Homo sapien
agcagcgtgtagtggatacatgcct

SEQ ID NO: 670845 - DNA, 25 bp, Homo sapien
gcagcgtgtagtggatacatgcctg

SEQ ID NO: 670846 - DNA, 25 bp, Homo sapien
aagtgcagatactttggcttagcat

SEQ ID NO: 670847 - DNA, 25 bp, Homo sapien
ggcttagcatttaaataacacagta

SEQ ID NO: 670848 - DNA, 25 bp, Homo sapien
aagctacagaaagtatggatctctt

SEQ ID NO: 670849 - DNA, 25 bp, Homo sapien
agtatggatctcttaaatttttaga

SEQ ID NO: 670850 - DNA, 25 bp, Homo sapien
gatttgaaaagatcattcctgccta

SEQ ID NO: 670851 - DNA, 25 bp, Homo sapien
gatcattcctgcctaaagagcaaag

SEQ ID NO: 670852 - DNA, 25 bp, Homo sapien
gcctaaagagcaaagcttatgtgtt

SEQ ID NO: 670853 - DNA, 25 bp, Homo sapien
ttatacttttagtgtttgtggcatt

SEQ ID NO: 670854 - DNA, 25 bp, Homo sapien
agctttagtgctggagttagtttta

SEQ ID NO: 670855 - DNA, 25 bp, Homo sapien
gtgctggagttagttttaacaaatt

SEQ ID NO: 670856 - DNA, 25 bp, Homo sapien
aggttgcaatatgtaatatggcaca

SEQ ID NO: 670857 - DNA, 25 bp, Homo sapien
agcttgttcctctgctcttggctac

SEQ ID NO: 670858 - DNA, 25 bp, Homo sapien
tgttcctctgctcttggctacttaa

SEQ ID NO: 670859 - DNA, 25 bp, Homo sapien
tctgctcttggctacttaacataca

SEQ ID NO: 670860 - DNA, 25 bp, Homo sapien
gctcttggctacttaacatacaatg

SEQ ID NO: 670861 - DNA, 25 bp, Homo sapien
ggctacttaacatacaatgcaaatg

SEQ ID NO: 670862 - DNA, 25 bp, Homo sapien
aatgcaaatgctttccgcatcctat

SEQ ID NO: 670863 - DNA, 25 bp, Homo sapien
aatgctttccgcatcctattaaaag

SEQ ID NO: 670864 - DNA, 25 bp, Homo sapien
gctttccgcatcctattaaaagaat

SEQ ID NO: 670865 - DNA, 25 bp, Homo sapien
aaacctaatcagttcattcgtataa

SEQ ID NO: 670866 - DNA, 25 bp, Homo sapien
agcagagatgcaagtattaacccag

SEQ ID NO: 670867 - DNA, 25 bp, Homo sapien
gagatgcaagtattaacccagcatt

SEQ ID NO: 670868 - DNA, 25 bp, Homo sapien
ctacatgcaggtgggccggggccaa

SEQ ID NO: 670869 - DNA, 25 bp, Homo sapien
gggcacagccgtggctgtgaagcct

SEQ ID NO: 670870 - DNA, 25 bp, Homo sapien
cggacctttggcctctgcaactggg

SEQ ID NO: 670871 - DNA, 25 bp, Homo sapien
gcctctgcaactggggtgccttagt

SEQ ID NO: 670872 - DNA, 25 bp, Homo sapien
tgccttagtggcctttcagggagct

SEQ ID NO: 670873 - DNA, 25 bp, Homo sapien
gccttagtggcctttcagggagctg

SEQ ID NO: 670874 - DNA, 25 bp, Homo sapien
ccttagtggcctttcagggagctga

SEQ ID NO: 670875 - DNA, 25 bp, Homo sapien
cttagtggcctttcagggagctgag

SEQ ID NO: 670876 - DNA, 25 bp, Homo sapien
agtggcctttcagggagctgaggga

SEQ ID NO: 670877 - DNA, 25 bp, Homo sapien
gcctttcagggagctgagggaagca

SEQ ID NO: 670878 - DNA, 25 bp, Homo sapien
ctgagggaagcaagattctaagaat

SEQ ID NO: 670879 - DNA, 25 bp, Homo sapien
taaaacaattcaggacatggagact

SEQ ID NO: 670880 - DNA, 25 bp, Homo sapien
caattcaggacatggagactgtgga

SEQ ID NO: 670881 - DNA, 25 bp, Homo sapien
gagactgtggaaagttgttatttaa

SEQ ID NO: 670882 - DNA, 25 bp, Homo sapien
ttataagcttgttggcctagactgc

SEQ ID NO: 670883 - DNA, 25 bp, Homo sapien
aagcttgttggcctagactgctcaa

SEQ ID NO: 670884 - DNA, 25 bp, Homo sapien
cttgttggcctagactgctcaaaga

SEQ ID NO: 670885 - DNA, 25 bp, Homo sapien
tggcctagactgctcaaagaaatga

SEQ ID NO: 670886 - DNA, 25 bp, Homo sapien
taaaaatatggctgtgagtaaggca

SEQ ID NO: 670887 - DNA, 25 bp, Homo sapien
gagtaaggcaggagtacctaatttt

SEQ ID NO: 670888 - DNA, 25 bp, Homo sapien
ggcaggagtacctaattttagattt

SEQ ID NO: 670889 - DNA, 25 bp, Homo sapien
agatttgtcaagtttcatctttttt

SEQ ID NO: 670890 - DNA, 25 bp, Homo sapien
gggagatcttcaagtgagtgccggg

SEQ ID NO: 670891 - DNA, 25 bp, Homo sapien
agatcttcaagtgagtgccggggcc

SEQ ID NO: 670892 - DNA, 25 bp, Homo sapien
gatcttcaagtgagtgccggggccc

SEQ ID NO: 670893 - DNA, 25 bp, Homo sapien
atcttcaagtgagtgccggggcccc

SEQ ID NO: 670894 - DNA, 25 bp, Homo sapien
tcttcaagtgagtgccggggcccct

SEQ ID NO: 670895 - DNA, 25 bp, Homo sapien
cttcaagtgagtgccggggcccctt

SEQ ID NO: 670896 - DNA, 25 bp, Homo sapien
ttcaagtgagtgccggggccccttg

SEQ ID NO: 670897 - DNA, 25 bp, Homo sapien
tcaagtgagtgccggggccccttgg

SEQ ID NO: 670898 - DNA, 25 bp, Homo sapien
caagtgagtgccggggccccttggc

SEQ ID NO: 670899 - DNA, 25 bp, Homo sapien
agtgagtgccggggccccttggcct

SEQ ID NO: 670900 - DNA, 25 bp, Homo sapien
gagtgccggggccccttggcctgtc

SEQ ID NO: 670901 - DNA, 25 bp, Homo sapien
ggtgcgttattcctaattgtaaaca

SEQ ID NO: 670902 - DNA, 25 bp, Homo sapien
aacacctgtttcgttatggagctgt

SEQ ID NO: 670903 - DNA, 25 bp, Homo sapien
ggagctgtgcattacttaggaggaa

SEQ ID NO: 670904 - DNA, 25 bp, Homo sapien
gctaacacaggtggttaccccaatt

SEQ ID NO: 670905 - DNA, 25 bp, Homo sapien
ggttaccccaattaccagatgaatt

SEQ ID NO: 670906 - DNA, 25 bp, Homo sapien
agaacactatgttaagccctcttac

SEQ ID NO: 670907 - DNA, 25 bp, Homo sapien
gaggacacgttaccagtttccttga

SEQ ID NO: 670908 - DNA, 25 bp, Homo sapien
gattgtgtctccttggctgtataaa

SEQ ID NO: 670909 - DNA, 25 bp, Homo sapien
taaaagagggatttccttctctctt

SEQ ID NO: 670910 - DNA, 25 bp, Homo sapien
cttctctctttgtaacctcattagc

SEQ ID NO: 670911 - DNA, 25 bp, Homo sapien
gcagattagccgtgatgtgcatcaa

SEQ ID NO: 670912 - DNA, 25 bp, Homo sapien
gctatttatttgtaggaaatcctca

SEQ ID NO: 670913 - DNA, 25 bp, Homo sapien
aattatccataattaataccagaga

SEQ ID NO: 670914 - DNA, 25 bp, Homo sapien
ttattatggtgttttctttgctagt

SEQ ID NO: 670915 - DNA, 25 bp, Homo sapien
attatggtgttttctttgctagtat

SEQ ID NO: 670916 - DNA, 25 bp, Homo sapien
gttttctttgctagtatttaagatc

SEQ ID NO: 670917 - DNA, 25 bp, Homo sapien
atcattattaagatcacatacacat

SEQ ID NO: 670918 - DNA, 25 bp, Homo sapien
catttttgcttactatcattagcat

SEQ ID NO: 670919 - DNA, 25 bp, Homo sapien
gcttactatcattagcatttgatga

SEQ ID NO: 670920 - DNA, 25 bp, Homo sapien
taatggctgcacgatatttcattgt

SEQ ID NO: 670921 - DNA, 25 bp, Homo sapien
ggctgcacgatatttcattgtgtac

SEQ ID NO: 670922 - DNA, 25 bp, Homo sapien
tacaaataaaataactactgttccg

SEQ ID NO: 670923 - DNA, 25 bp, Homo sapien
gtgttaggtggatgaaccgcatcaa

SEQ ID NO: 670924 - DNA, 25 bp, Homo sapien
taggtggatgaaccgcatcaaagac

SEQ ID NO: 670925 - DNA, 25 bp, Homo sapien
gatgaaccgcatcaaagacttccag

SEQ ID NO: 670926 - DNA, 25 bp, Homo sapien
tgaaccgcatcaaagacttccagaa

SEQ ID NO: 670927 - DNA, 25 bp, Homo sapien
tccagaagccactccagtgaccata

SEQ ID NO: 670928 - DNA, 25 bp, Homo sapien
cagaagccactccagtgaccataag

SEQ ID NO: 670929 - DNA, 25 bp, Homo sapien
gaagccactccagtgaccataagat

SEQ ID NO: 670930 - DNA, 25 bp, Homo sapien
gccactccagtgaccataagataaa

SEQ ID NO: 670931 - DNA, 25 bp, Homo sapien
actccagtgaccataagataaatgt

SEQ ID NO: 670932 - DNA, 25 bp, Homo sapien
ataaatgtcagaatcgcataacccc

SEQ ID NO: 670933 - DNA, 25 bp, Homo sapien
aaatgtcagaatcgcataaccccca

SEQ ID NO: 670934 - DNA, 25 bp, Homo sapien
gcaggcagagcctggccagcagaat

SEQ ID NO: 670935 - DNA, 25 bp, Homo sapien
cagagcctggccagcagaattcgct

SEQ ID NO: 670936 - DNA, 25 bp, Homo sapien
gcctggccagcagaattcgctctaa

SEQ ID NO: 670937 - DNA, 25 bp, Homo sapien
gccagcagaattcgctctaacaaga

SEQ ID NO: 670938 - DNA, 25 bp, Homo sapien
attcgctctaacaagaaaatgctgt

SEQ ID NO: 670939 - DNA, 25 bp, Homo sapien
aaatgctgttattggttggagggct

SEQ ID NO: 670940 - DNA, 25 bp, Homo sapien
gagggctgcctcctggaccggaccg

SEQ ID NO: 670941 - DNA, 25 bp, Homo sapien
ctccccagcaatttggttcagtatt

SEQ ID NO: 670942 - DNA, 25 bp, Homo sapien
gcaatttggttcagtattacgacga

SEQ ID NO: 670943 - DNA, 25 bp, Homo sapien
atttggttcagtattacgacgatga

SEQ ID NO: 670944 - DNA, 25 bp, Homo sapien
gtattacgacgatgaaaagaagaca

SEQ ID NO: 670945 - DNA, 25 bp, Homo sapien
accgagcctggcctctactttttat

SEQ ID NO: 670946 - DNA, 25 bp, Homo sapien
ccgagcctggcctctactttttatt

SEQ ID NO: 670947 - DNA, 25 bp, Homo sapien
tactttttattactgtcatgtagtt

SEQ ID NO: 670948 - DNA, 25 bp, Homo sapien
tttattactgtcatgtagttagtga

SEQ ID NO: 670949 - DNA, 25 bp, Homo sapien
attactgtcatgtagttagtgataa

SEQ ID NO: 670950 - DNA, 25 bp, Homo sapien
gttagtgataaaatgcttctatctg

SEQ ID NO: 670951 - DNA, 25 bp, Homo sapien
gtgataaaatgcttctatctgaaaa

SEQ ID NO: 670952 - DNA, 25 bp, Homo sapien
aaaaaattctcgtgattattgctta

SEQ ID NO: 670953 - DNA, 25 bp, Homo sapien
aaaattctcgtgattattgcttaaa

SEQ ID NO: 670954 - DNA, 25 bp, Homo sapien
aaattctcgtgattattgcttaaat

SEQ ID NO: 670955 - DNA, 25 bp, Homo sapien
ttctcgtgattattgcttaaatttt

SEQ ID NO: 670956 - DNA, 25 bp, Homo sapien
gagtcatgtcctacaaacatgggta

SEQ ID NO: 670957 - DNA, 25 bp, Homo sapien
aaacatgggtacaaatatgggcatc

SEQ ID NO: 670958 - DNA, 25 bp, Homo sapien
tacccctgaaagtccctaagtgttg

SEQ ID NO: 670959 - DNA, 25 bp, Homo sapien
gaaagtccctaagtgttggcgtgaa

SEQ ID NO: 670960 - DNA, 25 bp, Homo sapien
gtgttggcgtgaacagtttcgcaat

SEQ ID NO: 670961 - DNA, 25 bp, Homo sapien
gtttcgcaatatatactggctgatt

SEQ ID NO: 670962 - DNA, 25 bp, Homo sapien
ggctgattttactatggcaggctca

SEQ ID NO: 670963 - DNA, 25 bp, Homo sapien
ggcaggctcacaaagtttatacaga

SEQ ID NO: 670964 - DNA, 25 bp, Homo sapien
gaatagacctttccaatctccttga

SEQ ID NO: 670965 - DNA, 25 bp, Homo sapien
tccaatctccttgatttctttgttt

SEQ ID NO: 670966 - DNA, 25 bp, Homo sapien
gaaatgtggctgatgtctgaataca

SEQ ID NO: 670967 - DNA, 25 bp, Homo sapien
caaagagggcaagggctacattgac

SEQ ID NO: 670968 - DNA, 25 bp, Homo sapien
agggcaagggctacattgactggaa

SEQ ID NO: 670969 - DNA, 25 bp, Homo sapien
gcaagggctacattgactggaacac

SEQ ID NO: 670970 - DNA, 25 bp, Homo sapien
aagggctacattgactggaacacac

SEQ ID NO: 670971 - DNA, 25 bp, Homo sapien
gggctacattgactggaacacactc

SEQ ID NO: 670972 - DNA, 25 bp, Homo sapien
tggaacacactcaagtacgtgctaa

SEQ ID NO: 670973 - DNA, 25 bp, Homo sapien
gaacacactcaagtacgtgctaatg

SEQ ID NO: 670974 - DNA, 25 bp, Homo sapien
acacactcaagtacgtgctaatgaa

SEQ ID NO: 670975 - DNA, 25 bp, Homo sapien
actcaagtacgtgctaatgaacgca

SEQ ID NO: 670976 - DNA, 25 bp, Homo sapien
caagtacgtgctaatgaacgcaggg

SEQ ID NO: 670977 - DNA, 25 bp, Homo sapien
agcagatgatgaaggaggccgacaa

SEQ ID NO: 670978 - DNA, 25 bp, Homo sapien
gccaggacatccacgtgaccagaga

SEQ ID NO: 670979 - DNA, 25 bp, Homo sapien
tgaagcaccacctctctaagtctga

SEQ ID NO: 670980 - DNA, 25 bp, Homo sapien
ctctaagtctgatttgttggcaaac

SEQ ID NO: 670981 - DNA, 25 bp, Homo sapien
cagagccaagaggtcctagaggaga

SEQ ID NO: 670982 - DNA, 25 bp, Homo sapien
gagagaacacgaatccagttcataa

SEQ ID NO: 670983 - DNA, 25 bp, Homo sapien
ataagatggagccacactcgtatct

SEQ ID NO: 670984 - DNA, 25 bp, Homo sapien
acactcgtatcttccaagtgccaag

SEQ ID NO: 670985 - DNA, 25 bp, Homo sapien
gagcaggtgagacgaagcatatccc

SEQ ID NO: 670986 - DNA, 25 bp, Homo sapien
atatcccgtcttacagatgtctcag

SEQ ID NO: 670987 - DNA, 25 bp, Homo sapien
gatgtctcagctcaggacttcagta

SEQ ID NO: 670988 - DNA, 25 bp, Homo sapien
caggacttcagtatgagaccctcct

SEQ ID NO: 670989 - DNA, 25 bp, Homo sapien
gaaagcggtgtaaatggctcttatc

SEQ ID NO: 670990 - DNA, 25 bp, Homo sapien
cggtgtaaatggctcttatctgaac

SEQ ID NO: 670991 - DNA, 25 bp, Homo sapien
gtaaatggctcttatctgaaccaca

SEQ ID NO: 670992 - DNA, 25 bp, Homo sapien
tggctcttatctgaaccacaatgaa

SEQ ID NO: 670993 - DNA, 25 bp, Homo sapien
acatattcaagttggcttcttcgga

SEQ ID NO: 670994 - DNA, 25 bp, Homo sapien
caagttggcttcttcggaaatttca

SEQ ID NO: 670995 - DNA, 25 bp, Homo sapien
gcttcttcggaaatttcaggccaca

SEQ ID NO: 670996 - DNA, 25 bp, Homo sapien
tcttcggaaatttcaggccacaaat

SEQ ID NO: 670997 - DNA, 25 bp, Homo sapien
gccacaaatggcagtgatgcgacca

SEQ ID NO: 670998 - DNA, 25 bp, Homo sapien
aatggcagtgatgcgaccaggagca

SEQ ID NO: 670999 - DNA, 25 bp, Homo sapien
tgatgcgaccaggagcagtaacacg

SEQ ID NO: 671000 - DNA, 25 bp, Homo sapien
ggaaagcaggatgaagcctgagcca

SEQ ID NO: 671001 - DNA, 25 bp, Homo sapien
ttttgtgttattgctgtggtgtgca

SEQ ID NO: 671002 - DNA, 25 bp, Homo sapien
gctgtggtgtgcatgatttgcaaag

SEQ ID NO: 671003 - DNA, 25 bp, Homo sapien
agattaagtgcattttctctgtcta

SEQ ID NO: 671004 - DNA, 25 bp, Homo sapien
tttctctgtctatactgattattgt

SEQ ID NO: 671005 - DNA, 25 bp, Homo sapien
catttttgccattatgtaaatccca

SEQ ID NO: 671006 - DNA, 25 bp, Homo sapien
aaatcccatgatttcaactgtaaac

SEQ ID NO: 671007 - DNA, 25 bp, Homo sapien
aactgtaaacatctgtccattggtg

SEQ ID NO: 671008 - DNA, 25 bp, Homo sapien
tctgtccattggtgtagctttacaa

SEQ ID NO: 671009 - DNA, 25 bp, Homo sapien
gtagctttacaaaccattcactgat

SEQ ID NO: 671010 - DNA, 25 bp, Homo sapien
gctttacaaaccattcactgatttt

SEQ ID NO: 671011 - DNA, 25 bp, Homo sapien
tattcaagactttcgacttgcaaag

SEQ ID NO: 671012 - DNA, 25 bp, Homo sapien
aagactttcgacttgcaaagctgaa

SEQ ID NO: 671013 - DNA, 25 bp, Homo sapien
tttcgacttgcaaagctgaacccct

SEQ ID NO: 671014 - DNA, 25 bp, Homo sapien
gacttgcaaagctgaaccccttgtt

SEQ ID NO: 671015 - DNA, 25 bp, Homo sapien
tgcaaagctgaaccccttgtttatt

SEQ ID NO: 671016 - DNA, 25 bp, Homo sapien
aagctgaaccccttgtttattgcaa

SEQ ID NO: 671017 - DNA, 25 bp, Homo sapien
gctgaaccccttgtttattgcaaag

SEQ ID NO: 671018 - DNA, 25 bp, Homo sapien
tgaaccccttgtttattgcaaagtc

SEQ ID NO: 671019 - DNA, 25 bp, Homo sapien
tattgcaaagtccatcaccaaagta

SEQ ID NO: 671020 - DNA, 25 bp, Homo sapien
aatctatacttatcttccgtgaata

SEQ ID NO: 671021 - DNA, 25 bp, Homo sapien
atcttccgtgaataaacaagtgtca

SEQ ID NO: 671022 - DNA, 25 bp, Homo sapien
taggtggtcctacacacagtaggat

SEQ ID NO: 671023 - DNA, 25 bp, Homo sapien
cacacagtaggatcaattgctaatc

SEQ ID NO: 671024 - DNA, 25 bp, Homo sapien
aggatcaattgctaatctactttgt

SEQ ID NO: 671025 - DNA, 25 bp, Homo sapien
ttgctaatctactttgtgaaaaaga

SEQ ID NO: 671026 - DNA, 25 bp, Homo sapien
gaaaaagaactaagcactaatcaat

SEQ ID NO: 671027 - DNA, 25 bp, Homo sapien
ataataaggcttacatctaattctc

SEQ ID NO: 671028 - DNA, 25 bp, Homo sapien
attctcaaaggtgcttatccatttt

SEQ ID NO: 671029 - DNA, 25 bp, Homo sapien
aggtgcttatccattttcttgctaa

SEQ ID NO: 671030 - DNA, 25 bp, Homo sapien
gtgcttatccattttcttgctaaat

SEQ ID NO: 671031 - DNA, 25 bp, Homo sapien
tatccttcttgtaatttggctaaac

SEQ ID NO: 671032 - DNA, 25 bp, Homo sapien
ttggctaaacactaaaacatggaat

SEQ ID NO: 671033 - DNA, 25 bp, Homo sapien
tatcacagtatcagtggactaaaca

SEQ ID NO: 671034 - DNA, 25 bp, Homo sapien
gtatcagtggactaaacattaaaat

SEQ ID NO: 671035 - DNA, 25 bp, Homo sapien
aatgtaccactctaatcattggcct

SEQ ID NO: 671036 - DNA, 25 bp, Homo sapien
atcattggcctcatgattgaagcat

SEQ ID NO: 671037 - DNA, 25 bp, Homo sapien
attggcctcatgattgaagcatcct

SEQ ID NO: 671038 - DNA, 25 bp, Homo sapien
ggcctcatgattgaagcatcctgaa

SEQ ID NO: 671039 - DNA, 25 bp, Homo sapien
tcatgattgaagcatcctgaactat

SEQ ID NO: 671040 - DNA, 25 bp, Homo sapien
gattgaagcatcctgaactatgaat

SEQ ID NO: 671041 - DNA, 25 bp, Homo sapien
gaagcatcctgaactatgaattaga

SEQ ID NO: 671042 - DNA, 25 bp, Homo sapien
gcatcctgaactatgaattagacat

SEQ ID NO: 671043 - DNA, 25 bp, Homo sapien
gtataacttactgaatgtggatttt

SEQ ID NO: 671044 - DNA, 25 bp, Homo sapien
gtttctcatccgaccttgccctgca

SEQ ID NO: 671045 - DNA, 25 bp, Homo sapien
tttctcatccgaccttgccctgcat

SEQ ID NO: 671046 - DNA, 25 bp, Homo sapien
ttctcatccgaccttgccctgcatc

SEQ ID NO: 671047 - DNA, 25 bp, Homo sapien
tctcatccgaccttgccctgcatca

SEQ ID NO: 671048 - DNA, 25 bp, Homo sapien
ctgcatcaccccctccttaccggcc

SEQ ID NO: 671049 - DNA, 25 bp, Homo sapien
tgcatcaccccctccttaccggccc

SEQ ID NO: 671050 - DNA, 25 bp, Homo sapien
tttttttctagctgttacaagccag

SEQ ID NO: 671051 - DNA, 25 bp, Homo sapien
tttttgtaccatggagtgggtatgg

SEQ ID NO: 671052 - DNA, 25 bp, Homo sapien
ttttgtaccatggagtgggtatggc

SEQ ID NO: 671053 - DNA, 25 bp, Homo sapien
tttgtaccatggagtgggtatggcg

SEQ ID NO: 671054 - DNA, 25 bp, Homo sapien
ttgtaccatggagtgggtatggcgg

SEQ ID NO: 671055 - DNA, 25 bp, Homo sapien
ccctagcaggccaacgtcattgaaa

SEQ ID NO: 671056 - DNA, 25 bp, Homo sapien
tagcaggccaacgtcattgaaaccc

SEQ ID NO: 671057 - DNA, 25 bp, Homo sapien
gcaggccaacgtcattgaaacccaa

SEQ ID NO: 671058 - DNA, 25 bp, Homo sapien
aggccaacgtcattgaaacccaaat

SEQ ID NO: 671059 - DNA, 25 bp, Homo sapien
ggccaacgtcattgaaacccaaatg

SEQ ID NO: 671060 - DNA, 25 bp, Homo sapien
gtcattgaaacccaaatgctactgc

SEQ ID NO: 671061 - DNA, 25 bp, Homo sapien
cattgaaacccaaatgctactgcct

SEQ ID NO: 671062 - DNA, 25 bp, Homo sapien
aaatgctactgcctttggccattcc

SEQ ID NO: 671063 - DNA, 25 bp, Homo sapien
aatgctactgcctttggccattcct

SEQ ID NO: 671064 - DNA, 25 bp, Homo sapien
tgctactgcctttggccattcctct

SEQ ID NO: 671065 - DNA, 25 bp, Homo sapien
attcctctctctcagatctgcgcct

SEQ ID NO: 671066 - DNA, 25 bp, Homo sapien
gttggaggcatgactgctattgttc

SEQ ID NO: 671067 - DNA, 25 bp, Homo sapien
ggcatgactgctattgttccttggc

SEQ ID NO: 671068 - DNA, 25 bp, Homo sapien
atgactgctattgttccttggcttc

SEQ ID NO: 671069 - DNA, 25 bp, Homo sapien
actgctattgttccttggcttctct

SEQ ID NO: 671070 - DNA, 25 bp, Homo sapien
ctctccatttgtctcaaactttcct

SEQ ID NO: 671071 - DNA, 25 bp, Homo sapien
catttgtctcaaactttcctaatag

SEQ ID NO: 671072 - DNA, 25 bp, Homo sapien
gtctcaaactttcctaatagagcaa

SEQ ID NO: 671073 - DNA, 25 bp, Homo sapien
gagcaaaattgctgagtggtctcta

SEQ ID NO: 671074 - DNA, 25 bp, Homo sapien
aattgctgagtggtctctatttacc

SEQ ID NO: 671075 - DNA, 25 bp, Homo sapien
gagtggtctctatttaccaacatga

SEQ ID NO: 671076 - DNA, 25 bp, Homo sapien
gtctctatttaccaacatgaaacag

SEQ ID NO: 671077 - DNA, 25 bp, Homo sapien
cttgtgaacagatagaccctctcct

SEQ ID NO: 671078 - DNA, 25 bp, Homo sapien
tctcctgccactccagatagacgta

SEQ ID NO: 671079 - DNA, 25 bp, Homo sapien
tccagatagacgtatccgggtcaca

SEQ ID NO: 671080 - DNA, 25 bp, Homo sapien
gggtcacacacacctgatttaacaa

SEQ ID NO: 671081 - DNA, 25 bp, Homo sapien
tttaacaacatctcattatctcagg

SEQ ID NO: 671082 - DNA, 25 bp, Homo sapien
aacatctcattatctcaggcaccaa

SEQ ID NO: 671083 - DNA, 25 bp, Homo sapien
catctcattatctcaggcaccaatt

SEQ ID NO: 671084 - DNA, 25 bp, Homo sapien
ctcattatctcaggcaccaatttga

SEQ ID NO: 671085 - DNA, 25 bp, Homo sapien
aactgagacaatgaacttccgcagg

SEQ ID NO: 671086 - DNA, 25 bp, Homo sapien
atgaacttccgcaggacccaaagca

SEQ ID NO: 671087 - DNA, 25 bp, Homo sapien
gtcaatccataaacacacttaagta

SEQ ID NO: 671088 - DNA, 25 bp, Homo sapien
taggaaatgtgaatcctccaacctt

SEQ ID NO: 671089 - DNA, 25 bp, Homo sapien
ctttttcaagcttgattggctattc

SEQ ID NO: 671090 - DNA, 25 bp, Homo sapien
ttttcaagcttgattggctattctg

SEQ ID NO: 671091 - DNA, 25 bp, Homo sapien
ttcaagcttgattggctattctggg

SEQ ID NO: 671092 - DNA, 25 bp, Homo sapien
tcaagcttgattggctattctgggt

SEQ ID NO: 671093 - DNA, 25 bp, Homo sapien
ggctattctgggtctcttgcacttc

SEQ ID NO: 671094 - DNA, 25 bp, Homo sapien
gctattctgggtctcttgcacttcc

SEQ ID NO: 671095 - DNA, 25 bp, Homo sapien
ctattctgggtctcttgcacttcca

SEQ ID NO: 671096 - DNA, 25 bp, Homo sapien
tattctgggtctcttgcacttccat

SEQ ID NO: 671097 - DNA, 25 bp, Homo sapien
attctgggtctcttgcacttccata

SEQ ID NO: 671098 - DNA, 25 bp, Homo sapien
ttctgggtctcttgcacttccatat

SEQ ID NO: 671099 - DNA, 25 bp, Homo sapien
ttccctatcgtcttggcccaaataa

SEQ ID NO: 671100 - DNA, 25 bp, Homo sapien
gtaacaatatctatgcccatgtgac

SEQ ID NO: 671101 - DNA, 25 bp, Homo sapien
tatctatgcccatgtgacactttga

SEQ ID NO: 671102 - DNA, 25 bp, Homo sapien
catgtgacactttgagacactctgt

SEQ ID NO: 671103 - DNA, 25 bp, Homo sapien
agacactctgtctaatgtacttttg

SEQ ID NO: 671104 - DNA, 25 bp, Homo sapien
accagtcttttttagctcactgaga

SEQ ID NO: 671105 - DNA, 25 bp, Homo sapien
ttagctcactgagagctgtctctct

SEQ ID NO: 671106 - DNA, 25 bp, Homo sapien
tgagagctgtctctctcaatcactc

SEQ ID NO: 671107 - DNA, 25 bp, Homo sapien
caatcactcctcaatgttctatctt

SEQ ID NO: 671108 - DNA, 25 bp, Homo sapien
tcaatgttctatcttaattttgtgg

SEQ ID NO: 671109 - DNA, 25 bp, Homo sapien
aaagttttcaatgagctggagatga

SEQ ID NO: 671110 - DNA, 25 bp, Homo sapien
tggcatgtattcctagggcaactgc

SEQ ID NO: 671111 - DNA, 25 bp, Homo sapien
catgtattcctagggcaactgcaag

SEQ ID NO: 671112 - DNA, 25 bp, Homo sapien
tattcctagggcaactgcaagaagg

SEQ ID NO: 671113 - DNA, 25 bp, Homo sapien
tagggcaactgcaagaaggacagaa

SEQ ID NO: 671114 - DNA, 25 bp, Homo sapien
acagaagaaagatcgtgcgtcaaat

SEQ ID NO: 671115 - DNA, 25 bp, Homo sapien
gaaagatcgtgcgtcaaattctaat

SEQ ID NO: 671116 - DNA, 25 bp, Homo sapien
cgtgcgtcaaattctaatataggtt

SEQ ID NO: 671117 - DNA, 25 bp, Homo sapien
ataggttgtaagaacgtgagtcctt

SEQ ID NO: 671118 - DNA, 25 bp, Homo sapien
ttgtatgcacataccccatattagc

SEQ ID NO: 671119 - DNA, 25 bp, Homo sapien
taccccatattagccttccagtatg

SEQ ID NO: 671120 - DNA, 25 bp, Homo sapien
gggattctgaactcaaaaacacaat

SEQ ID NO: 671121 - DNA, 25 bp, Homo sapien
ctgagactggcatcgtacctggcga

SEQ ID NO: 671122 - DNA, 25 bp, Homo sapien
atcgtacctggcgaggatggccatg

SEQ ID NO: 671123 - DNA, 25 bp, Homo sapien
ttcgccggctcctgagtgtggtact

SEQ ID NO: 671124 - DNA, 25 bp, Homo sapien
ggctcctgagtgtggtactgcccac

SEQ ID NO: 671125 - DNA, 25 bp, Homo sapien
tggattcggccaccgagagacatgt

SEQ ID NO: 671126 - DNA, 25 bp, Homo sapien
agacatgtggaccacgcagctgaga

SEQ ID NO: 671127 - DNA, 25 bp, Homo sapien
accagagctggtggcaagccttaga

SEQ ID NO: 671128 - DNA, 25 bp, Homo sapien
ggtggcaagccttagatggcaaact

SEQ ID NO: 671129 - DNA, 25 bp, Homo sapien
atggcaaactgcgaggagatctgat

SEQ ID NO: 671130 - DNA, 25 bp, Homo sapien
tagaaaagatgctgtgggcccgcaa

SEQ ID NO: 671131 - DNA, 25 bp, Homo sapien
ctgtgggcccgcaagagaaagcaga

SEQ ID NO: 671132 - DNA, 25 bp, Homo sapien
gatgaaccgcatcaaagacttccag

SEQ ID NO: 671133 - DNA, 25 bp, Homo sapien
gaagccactccagtgaccataagat

SEQ ID NO: 671134 - DNA, 25 bp, Homo sapien
ataaatgtcagaatcgcataacccc

SEQ ID NO: 671135 - DNA, 25 bp, Homo sapien
aacccccaggatcagagatggagtc

SEQ ID NO: 671136 - DNA, 25 bp, Homo sapien
cccccaggatcagagatggagtctc

SEQ ID NO: 671137 - DNA, 25 bp, Homo sapien
gaatgtagtggcatcattgtaactc

SEQ ID NO: 671138 - DNA, 25 bp, Homo sapien
aatgtagtggcatcattgtaactca

SEQ ID NO: 671139 - DNA, 25 bp, Homo sapien
gtggcatcattgtaactcactgcag

SEQ ID NO: 671140 - DNA, 25 bp, Homo sapien
tggcatcattgtaactcactgcagc

SEQ ID NO: 671141 - DNA, 25 bp, Homo sapien
gaactataggcacaagctaccatgc

SEQ ID NO: 671142 - DNA, 25 bp, Homo sapien
gcctggctattcttttttgttaatt

SEQ ID NO: 671143 - DNA, 25 bp, Homo sapien
cccctgcagcaataagatgctcgga

SEQ ID NO: 671144 - DNA, 25 bp, Homo sapien
aagatgctcggattcactctgtgac

SEQ ID NO: 671145 - DNA, 25 bp, Homo sapien
tcggattcactctgtgaccgcatat

SEQ ID NO: 671146 - DNA, 25 bp, Homo sapien
gattcactctgtgaccgcatatgtg

SEQ ID NO: 671147 - DNA, 25 bp, Homo sapien
tctgtgaccgcatatgtgagaggca

SEQ ID NO: 671148 - DNA, 25 bp, Homo sapien
tgaccgcatatgtgagaggcagaga

SEQ ID NO: 671149 - DNA, 25 bp, Homo sapien
gctgcgagagagaatgagcctcccg

SEQ ID NO: 671150 - DNA, 25 bp, Homo sapien
gagagagaatgagcctcccgccaga

SEQ ID NO: 671151 - DNA, 25 bp, Homo sapien
gagaatgagcctcccgccagacagg

SEQ ID NO: 671152 - DNA, 25 bp, Homo sapien
tagcaactttgctgtgattccgttt

SEQ ID NO: 671153 - DNA, 25 bp, Homo sapien
aactttgctgtgattccgtttgtat

SEQ ID NO: 671154 - DNA, 25 bp, Homo sapien
gtatggtggattagatacatccaca

SEQ ID NO: 671155 - DNA, 25 bp, Homo sapien
tatggtggattagatacatccacaa

SEQ ID NO: 671156 - DNA, 25 bp, Homo sapien
atggtggattagatacatccacaaa

SEQ ID NO: 671157 - DNA, 25 bp, Homo sapien
tggtggattagatacatccacaaat

SEQ ID NO: 671158 - DNA, 25 bp, Homo sapien
ggtggattagatacatccacaaatt

SEQ ID NO: 671159 - DNA, 25 bp, Homo sapien
gtggattagatacatccacaaattc

SEQ ID NO: 671160 - DNA, 25 bp, Homo sapien
tggattagatacatccacaaattct

SEQ ID NO: 671161 - DNA, 25 bp, Homo sapien
catccacaaattctttgctgcccat

SEQ ID NO: 671162 - DNA, 25 bp, Homo sapien
aagagtaatatttcaacaggttcct

SEQ ID NO: 671163 - DNA, 25 bp, Homo sapien
aacaggttcctgtatttcaagaata

SEQ ID NO: 671164 - DNA, 25 bp, Homo sapien
aaagcaaattatcctagctccctca

SEQ ID NO: 671165 - DNA, 25 bp, Homo sapien
aaattatcctagctccctcaattaa

SEQ ID NO: 671166 - DNA, 25 bp, Homo sapien
attatcctagctccctcaattaata

SEQ ID NO: 671167 - DNA, 25 bp, Homo sapien
cctagctccctcaattaatatttta

SEQ ID NO: 671168 - DNA, 25 bp, Homo sapien
atattttaaaaccatgacaatcagt

SEQ ID NO: 671169 - DNA, 25 bp, Homo sapien
aaaccatgacaatcagttattaata

SEQ ID NO: 671170 - DNA, 25 bp, Homo sapien
taccatcttcttcaactaggtggtc

SEQ ID NO: 671171 - DNA, 25 bp, Homo sapien
catcttcttcaactaggtggtctat

SEQ ID NO: 671172 - DNA, 25 bp, Homo sapien
ttcttcaactaggtggtctatcatt

SEQ ID NO: 671173 - DNA, 25 bp, Homo sapien
acctgtttacagtcaattataacct

SEQ ID NO: 671174 - DNA, 25 bp, Homo sapien
ttataacctgacaaacgagactttt

SEQ ID NO: 671175 - DNA, 25 bp, Homo sapien
acgagacttttgtaacatattattg

SEQ ID NO: 671176 - DNA, 25 bp, Homo sapien
acatctttctgaaaccttcaaaccg

SEQ ID NO: 671177 - DNA, 25 bp, Homo sapien
aaggaagtgttaactggcaagcagt

SEQ ID NO: 671178 - DNA, 25 bp, Homo sapien
ggcaagcagttgtactttagacttt

SEQ ID NO: 671179 - DNA, 25 bp, Homo sapien
gtactttagactttgtgagaaattc

SEQ ID NO: 671180 - DNA, 25 bp, Homo sapien
gagaaattcataaaggtggctgagt

SEQ ID NO: 671181 - DNA, 25 bp, Homo sapien
gaatagagttctaactgaaaccaga

SEQ ID NO: 671182 - DNA, 25 bp, Homo sapien
gaaaccagaattaatttggctcttg

SEQ ID NO: 671183 - DNA, 25 bp, Homo sapien
atttggctcttgtagcttagtaatg

SEQ ID NO: 671184 - DNA, 25 bp, Homo sapien
gagactgagaagttgcctcgcaaac

SEQ ID NO: 671185 - DNA, 25 bp, Homo sapien
agactgagaagttgcctcgcaaacg

SEQ ID NO: 671186 - DNA, 25 bp, Homo sapien
gactgagaagttgcctcgcaaacga

SEQ ID NO: 671187 - DNA, 25 bp, Homo sapien
ctgagaagttgcctcgcaaacgagc

SEQ ID NO: 671188 - DNA, 25 bp, Homo sapien
gagaagttgcctcgcaaacgagcag

SEQ ID NO: 671189 - DNA, 25 bp, Homo sapien
gaagttgcctcgcaaacgagcaggg

SEQ ID NO: 671190 - DNA, 25 bp, Homo sapien
tcgcaaacgagcaggggccccagtt

SEQ ID NO: 671191 - DNA, 25 bp, Homo sapien
gggccccagttggtgggagtcctgg

SEQ ID NO: 671192 - DNA, 25 bp, Homo sapien
gggagtcctgggctggcaaagcggg

SEQ ID NO: 671193 - DNA, 25 bp, Homo sapien
gcctgagggttcagtagaggagtct

SEQ ID NO: 671194 - DNA, 25 bp, Homo sapien
gggttcagtagaggagtctgaggct

SEQ ID NO: 671195 - DNA, 25 bp, Homo sapien
tgaactctctccatctgatagctct

SEQ ID NO: 671196 - DNA, 25 bp, Homo sapien
actctctccatctgatagctctgat

SEQ ID NO: 671197 - DNA, 25 bp, Homo sapien
atctgatagctctgatggaacatac

SEQ ID NO: 671198 - DNA, 25 bp, Homo sapien
gatagctctgatggaacatacatgt

SEQ ID NO: 671199 - DNA, 25 bp, Homo sapien
agctctgatggaacatacatgtggg

SEQ ID NO: 671200 - DNA, 25 bp, Homo sapien
catacatgtgggatgaagaaggctt

SEQ ID NO: 671201 - DNA, 25 bp, Homo sapien
aggcttggaacccattggaaatgtc

SEQ ID NO: 671202 - DNA, 25 bp, Homo sapien
cttggaacccattggaaatgtccat

SEQ ID NO: 671203 - DNA, 25 bp, Homo sapien
acccattggaaatgtccatccagtt

SEQ ID NO: 671204 - DNA, 25 bp, Homo sapien
ggaaatgtccatccagttgggagct

SEQ ID NO: 671205 - DNA, 25 bp, Homo sapien
aatgtccatccagttgggagctatg

SEQ ID NO: 671206 - DNA, 25 bp, Homo sapien
ttgtgtcaaccaaaacgagagttca

SEQ ID NO: 671207 - DNA, 25 bp, Homo sapien
aacgagagttcagagtcactctaaa

SEQ ID NO: 671208 - DNA, 25 bp, Homo sapien
gaaactccttcaagatttgatgaat

SEQ ID NO: 671209 - DNA, 25 bp, Homo sapien
gatgaatgcgcattttgatgccaca

SEQ ID NO: 671210 - DNA, 25 bp, Homo sapien
gcgcattttgatgccacatctattt

SEQ ID NO: 671211 - DNA, 25 bp, Homo sapien
tgccacatctatttttagaaagctg

SEQ ID NO: 671212 - DNA, 25 bp, Homo sapien
gaaagctgtggctgaataaagcatt

SEQ ID NO: 671213 - DNA, 25 bp, Homo sapien
cgttaccccttccagatcagaatgg

SEQ ID NO: 671214 - DNA, 25 bp, Homo sapien
cccttccagatcagaatgggtgctt

SEQ ID NO: 671215 - DNA, 25 bp, Homo sapien
atcagaatgggtgctttatttgttt

SEQ ID NO: 671216 - DNA, 25 bp, Homo sapien
gtttttatggattattgtgtcaacc

SEQ ID NO: 671217 - DNA, 25 bp, Homo sapien
taagccagaaactaaaaagatttgc

SEQ ID NO: 671218 - DNA, 25 bp, Homo sapien
gccagaaactaaaaagatttgcaaa

SEQ ID NO: 671219 - DNA, 25 bp, Homo sapien
taaatcgtattctttttgttaacat

SEQ ID NO: 671220 - DNA, 25 bp, Homo sapien
gtgttacttgccgtttttcactctc

SEQ ID NO: 671221 - DNA, 25 bp, Homo sapien
tgttacttgccgtttttcactctca

SEQ ID NO: 671222 - DNA, 25 bp, Homo sapien
gttacttgccgtttttcactctcat

SEQ ID NO: 671223 - DNA, 25 bp, Homo sapien
ttacttgccgtttttcactctcatt

SEQ ID NO: 671224 - DNA, 25 bp, Homo sapien
ggaattttccagatatgtaatattg

SEQ ID NO: 671225 - DNA, 25 bp, Homo sapien
gaattttccagatatgtaatattgg

SEQ ID NO: 671226 - DNA, 25 bp, Homo sapien
gtaatattggagttgattgaatgca

SEQ ID NO: 671227 - DNA, 25 bp, Homo sapien
tattggagttgattgaatgcaggag

SEQ ID NO: 671228 - DNA, 25 bp, Homo sapien
ttaggcaggatcatgtctacaaaag

SEQ ID NO: 671229 - DNA, 25 bp, Homo sapien
aggcaggatcatgtctacaaaagag

SEQ ID NO: 671230 - DNA, 25 bp, Homo sapien
caggatcatgtctacaaaagaggct

SEQ ID NO: 671231 - DNA, 25 bp, Homo sapien
caaaagaggctgtcactttggctta

SEQ ID NO: 671232 - DNA, 25 bp, Homo sapien
agaggctgtcactttggcttatcaa

SEQ ID NO: 671233 - DNA, 25 bp, Homo sapien
gaggctgtcactttggcttatcaat

SEQ ID NO: 671234 - DNA, 25 bp, Homo sapien
ttggcttatcaatattttcacctcg

SEQ ID NO: 671235 - DNA, 25 bp, Homo sapien
ggcttatcaatattttcacctcgtt

SEQ ID NO: 671236 - DNA, 25 bp, Homo sapien
gcttatcaatattttcacctcgtta

SEQ ID NO: 671237 - DNA, 25 bp, Homo sapien
ttatcaatattttcacctcgttacc

SEQ ID NO: 671238 - DNA, 25 bp, Homo sapien
tcaatattttcacctcgttacccct

SEQ ID NO: 671239 - DNA, 25 bp, Homo sapien
aaaccaaagctgagagtaagagttc

SEQ ID NO: 671240 - DNA, 25 bp, Homo sapien
accaaagctgagagtaagagttcaa

SEQ ID NO: 671241 - DNA, 25 bp, Homo sapien
gagagtaagagttcaaaacccacgg

SEQ ID NO: 671242 - DNA, 25 bp, Homo sapien
gtaagagttcaaaacccacggccag

SEQ ID NO: 671243 - DNA, 25 bp, Homo sapien
taagagttcaaaacccacggccagc

SEQ ID NO: 671244 - DNA, 25 bp, Homo sapien
aagagttcaaaacccacggccagca

SEQ ID NO: 671245 - DNA, 25 bp, Homo sapien
gagttcaaaacccacggccagcaag

SEQ ID NO: 671246 - DNA, 25 bp, Homo sapien
agttcaaaacccacggccagcaagg

SEQ ID NO: 671247 - DNA, 25 bp, Homo sapien
gttcaaaacccacggccagcaaggt

SEQ ID NO: 671248 - DNA, 25 bp, Homo sapien
caaaacccacggccagcaaggtcaa

SEQ ID NO: 671249 - DNA, 25 bp, Homo sapien
gcaaggtcaagaatggtgctgcttc

SEQ ID NO: 671250 - DNA, 25 bp, Homo sapien
gggttataagctaaacacacttgtt

SEQ ID NO: 671251 - DNA, 25 bp, Homo sapien
aacacacttgttaacatcctatggg

SEQ ID NO: 671252 - DNA, 25 bp, Homo sapien
ggatgaacctgctcttcagtgtgaa

SEQ ID NO: 671253 - DNA, 25 bp, Homo sapien
tcattccaagaaccatgcaccatta

SEQ ID NO: 671254 - DNA, 25 bp, Homo sapien
tgcaccattattacaagagctccaa

SEQ ID NO: 671255 - DNA, 25 bp, Homo sapien
gagctccaaacaaaaccagttcact

SEQ ID NO: 671256 - DNA, 25 bp, Homo sapien
tcactgagaacacaggagcacttca

SEQ ID NO: 671257 - DNA, 25 bp, Homo sapien
aggagcacttcatcaataggttggg

SEQ ID NO: 671258 - DNA, 25 bp, Homo sapien
gaagtggttctaactttccttctca

SEQ ID NO: 671259 - DNA, 25 bp, Homo sapien
tttccttctcaaatacagacctgga

SEQ ID NO: 671260 - DNA, 25 bp, Homo sapien
aatacagacctggagcaatctgatg

SEQ ID NO: 671261 - DNA, 25 bp, Homo sapien
tctctcctacataggtgtctccaaa

SEQ ID NO: 671262 - DNA, 25 bp, Homo sapien
ataggtgtctccaaaatctttgagg

SEQ ID NO: 671263 - DNA, 25 bp, Homo sapien
gcccctcatcgcagcctgaaagtgg

SEQ ID NO: 671264 - DNA, 25 bp, Homo sapien
cgctggcaccggagcacagactctg

SEQ ID NO: 671265 - DNA, 25 bp, Homo sapien
acagactctgcccatggagacacca

SEQ ID NO: 671266 - DNA, 25 bp, Homo sapien
gagacaccactcgtcgtcaagatag

SEQ ID NO: 671267 - DNA, 25 bp, Homo sapien
tagacaaaccctatctgctgctgat

SEQ ID NO: 671268 - DNA, 25 bp, Homo sapien
aaaccctatctgctgctgatttaca

SEQ ID NO: 671269 - DNA, 25 bp, Homo sapien
atctgctgctgatttacagcgagaa

SEQ ID NO: 671270 - DNA, 25 bp, Homo sapien
gcgagaaaataccttccgtgctctt

SEQ ID NO: 671271 - DNA, 25 bp, Homo sapien
ttccgtgctcttcctgggaaagatt

SEQ ID NO: 671272 - DNA, 25 bp, Homo sapien
gtataatcgctgtactatacaactc

SEQ ID NO: 671273 - DNA, 25 bp, Homo sapien
aatcgctgtactatacaactctaag

SEQ ID NO: 671274 - DNA, 25 bp, Homo sapien
cgctgtactatacaactctaagcag

SEQ ID NO: 671275 - DNA, 25 bp, Homo sapien
actctaagcagtaatatatgtgtgt

SEQ ID NO: 671276 - DNA, 25 bp, Homo sapien
atgtgtgtgtgagctcacatgtaaa

SEQ ID NO: 671277 - DNA, 25 bp, Homo sapien
gtgtgagctcacatgtaaatgtata

SEQ ID NO: 671278 - DNA, 25 bp, Homo sapien
gtaaatgtataatatagccacccat

SEQ ID NO: 671279 - DNA, 25 bp, Homo sapien
atagccacccatataatcaacttcc

SEQ ID NO: 671280 - DNA, 25 bp, Homo sapien
gccacccatataatcaacttcctgt

SEQ ID NO: 671281 - DNA, 25 bp, Homo sapien
acccatataatcaacttcctgtggg

SEQ ID NO: 671282 - DNA, 25 bp, Homo sapien
tacctttctctggaaccagtttcaa

SEQ ID NO: 671283 - DNA, 25 bp, Homo sapien
catctaataacacccaacgctgtca

SEQ ID NO: 671284 - DNA, 25 bp, Homo sapien
taacacccaacgctgtcaagaatgt

SEQ ID NO: 671285 - DNA, 25 bp, Homo sapien
aaaacagacatgtatgcattgttga

SEQ ID NO: 671286 - DNA, 25 bp, Homo sapien
tcaattggtacccattttttggagg

SEQ ID NO: 671287 - DNA, 25 bp, Homo sapien
ttggagggagtttgctagtatcatt

SEQ ID NO: 671288 - DNA, 25 bp, Homo sapien
aaatagatatgctttcagactcaac

SEQ ID NO: 671289 - DNA, 25 bp, Homo sapien
ttcagactcaacatttccacttcta

SEQ ID NO: 671290 - DNA, 25 bp, Homo sapien
gaaatatgtgcacatggacacaaag

SEQ ID NO: 671291 - DNA, 25 bp, Homo sapien
atggacacaaagagtcgggcatgaa

SEQ ID NO: 671292 - DNA, 25 bp, Homo sapien
gtcgggcatgaagatgtttgcagaa

SEQ ID NO: 671293 - DNA, 25 bp, Homo sapien
gcagaaatgttgtttgcaactgcaa

SEQ ID NO: 671294 - DNA, 25 bp, Homo sapien
ccagcaccttgttactttgttctta

SEQ ID NO: 671295 - DNA, 25 bp, Homo sapien
agccaagcagcaggactctagcgac

SEQ ID NO: 671296 - DNA, 25 bp, Homo sapien
ggactctagcgactgtttgatgcat

SEQ ID NO: 671297 - DNA, 25 bp, Homo sapien
tttgatgcatcaccacctttgttta

SEQ ID NO: 671298 - DNA, 25 bp, Homo sapien
acctttgtttactttcgactgtctg

SEQ ID NO: 671299 - DNA, 25 bp, Homo sapien
tttcgactgtctgatacaccactgc

SEQ ID NO: 671300 - DNA, 25 bp, Homo sapien
atacaccactgcctttgtttacttt

SEQ ID NO: 671301 - DNA, 25 bp, Homo sapien
attttcctcgtccatgacgtggaac

SEQ ID NO: 671302 - DNA, 25 bp, Homo sapien
tgacgtggaacggaattcctaccct

SEQ ID NO: 671303 - DNA, 25 bp, Homo sapien
aaataacacactctctgcgaaacca

SEQ ID NO: 671304 - DNA, 25 bp, Homo sapien
tgcgaaaccactgtaagccttaaat

SEQ ID NO: 671305 - DNA, 25 bp, Homo sapien
acctcgtttggctccttcagtcgtt

SEQ ID NO: 671306 - DNA, 25 bp, Homo sapien
ccttcagtcgttcgccgtacaactt

SEQ ID NO: 671307 - DNA, 25 bp, Homo sapien
gtacaactttcctttccatagtgcg

SEQ ID NO: 671308 - DNA, 25 bp, Homo sapien
tccatagtgcgttactgtggcggac

SEQ ID NO: 671309 - DNA, 25 bp, Homo sapien
actgtggcggacagagcacctgtga

SEQ ID NO: 671310 - DNA, 25 bp, Homo sapien
tgaggtcaccacagcctttagactg

SEQ ID NO: 671311 - DNA, 25 bp, Homo sapien
acagcctttagactgtctgcagccc

SEQ ID NO: 671312 - DNA, 25 bp, Homo sapien
gcggaggttatgaggattcttgtat

SEQ ID NO: 671313 - DNA, 25 bp, Homo sapien
gattcttgtattgatccggtcctca

SEQ ID NO: 671314 - DNA, 25 bp, Homo sapien
attgatccggtcctcaaccctattt

SEQ ID NO: 671315 - DNA, 25 bp, Homo sapien
aaccctatttcccaagatccaatct

SEQ ID NO: 671316 - DNA, 25 bp, Homo sapien
ttcaccctaaggttagcgttacaat

SEQ ID NO: 671317 - DNA, 25 bp, Homo sapien
atccccttaggttagcaaaccactg

SEQ ID NO: 671318 - DNA, 25 bp, Homo sapien
tactttgtcctttcttgttagactt

SEQ ID NO: 671319 - DNA, 25 bp, Homo sapien
gtaattccagattaagtctcatcct

SEQ ID NO: 671320 - DNA, 25 bp, Homo sapien
aagtctcatcctgatatcgtcaaaa

SEQ ID NO: 671321 - DNA, 25 bp, Homo sapien
caattcaattatactgcctgccttt

SEQ ID NO: 671322 - DNA, 25 bp, Homo sapien
aaaatttccctttgtcgatggcatc

SEQ ID NO: 671323 - DNA, 25 bp, Homo sapien
tcacacttccaatctctttttcaat

SEQ ID NO: 671324 - DNA, 25 bp, Homo sapien
ttttcaatggttgccttcatcctcc

SEQ ID NO: 671325 - DNA, 25 bp, Homo sapien
ttcatcctcctacatgtgactgcaa

SEQ ID NO: 671326 - DNA, 25 bp, Homo sapien
tacatgtgactgcaactccttcaag

SEQ ID NO: 671327 - DNA, 25 bp, Homo sapien
ggataaaaatagcacttgccagccg

SEQ ID NO: 671328 - DNA, 25 bp, Homo sapien
gataaaaatagcacttgccagccgg

SEQ ID NO: 671329 - DNA, 25 bp, Homo sapien
ataaaaatagcacttgccagccggg

SEQ ID NO: 671330 - DNA, 25 bp, Homo sapien
taaaaatagcacttgccagccgggc

SEQ ID NO: 671331 - DNA, 25 bp, Homo sapien
aaaaatagcacttgccagccgggcg

SEQ ID NO: 671332 - DNA, 25 bp, Homo sapien
aaaatagcacttgccagccgggcgt

SEQ ID NO: 671333 - DNA, 25 bp, Homo sapien
aaatagcacttgccagccgggcgtg

SEQ ID NO: 671334 - DNA, 25 bp, Homo sapien
aatagcacttgccagccgggcgtgg

SEQ ID NO: 671335 - DNA, 25 bp, Homo sapien
atagcacttgccagccgggcgtggt

SEQ ID NO: 671336 - DNA, 25 bp, Homo sapien
tagcacttgccagccgggcgtggtg

SEQ ID NO: 671337 - DNA, 25 bp, Homo sapien
cgtgaccatcctggacaacatggta

SEQ ID NO: 671338 - DNA, 25 bp, Homo sapien
tttgacaccaaccatgatggctcgg

SEQ ID NO: 671339 - DNA, 25 bp, Homo sapien
ttgacaccaaccatgatggctcggt

SEQ ID NO: 671340 - DNA, 25 bp, Homo sapien
tgacaccaaccatgatggctcggtc

SEQ ID NO: 671341 - DNA, 25 bp, Homo sapien
gacaccaaccatgatggctcggtca

SEQ ID NO: 671342 - DNA, 25 bp, Homo sapien
acaccaaccatgatggctcggtcag

SEQ ID NO: 671343 - DNA, 25 bp, Homo sapien
accaaccatgatggctcggtcagtt

SEQ ID NO: 671344 - DNA, 25 bp, Homo sapien
caaccatgatggctcggtcagtttt

SEQ ID NO: 671345 - DNA, 25 bp, Homo sapien
aaccatgatggctcggtcagttttg

SEQ ID NO: 671346 - DNA, 25 bp, Homo sapien
accatgatggctcggtcagttttga

SEQ ID NO: 671347 - DNA, 25 bp, Homo sapien
catgatggctcggtcagttttgagg

SEQ ID NO: 671348 - DNA, 25 bp, Homo sapien
atgatggctcggtcagttttgagga

SEQ ID NO: 671349 - DNA, 25 bp, Homo sapien
ccatgcaggtgctgttttccggtga

SEQ ID NO: 671350 - DNA, 25 bp, Homo sapien
caggtgctgttttccggtgaggcca

SEQ ID NO: 671351 - DNA, 25 bp, Homo sapien
tgctgttttccggtgaggccaccca

SEQ ID NO: 671352 - DNA, 25 bp, Homo sapien
tgaggccacccaccgcaagtactat

SEQ ID NO: 671353 - DNA, 25 bp, Homo sapien
gcaagtactattccaccacccacgg

SEQ ID NO: 671354 - DNA, 25 bp, Homo sapien
aggctgcccgcctcattgagatgta

SEQ ID NO: 671355 - DNA, 25 bp, Homo sapien
gcccgcctcattgagatgtaccgag

SEQ ID NO: 671356 - DNA, 25 bp, Homo sapien
atgtaccgagacctcttccagcagg

SEQ ID NO: 671357 - DNA, 25 bp, Homo sapien
tgtcctcgctgctgagaagagccac

SEQ ID NO: 671358 - DNA, 25 bp, Homo sapien
agaagagccactaactcgtgacctc

SEQ ID NO: 671359 - DNA, 25 bp, Homo sapien
tgccttcctgatcctctgtagaaag

SEQ ID NO: 671360 - DNA, 25 bp, Homo sapien
taaaatccagctagaacccaaccac

SEQ ID NO: 671361 - DNA, 25 bp, Homo sapien
tagaacccaaccaccttatgcagca

SEQ ID NO: 671362 - DNA, 25 bp, Homo sapien
caaccaccttatgcagcagttctta

SEQ ID NO: 671363 - DNA, 25 bp, Homo sapien
gggctgtgtcatcaatcaaagtcct

SEQ ID NO: 671364 - DNA, 25 bp, Homo sapien
gtgtcatcaatcaaagtcctcatat

SEQ ID NO: 671365 - DNA, 25 bp, Homo sapien
caatcaaagtcctcatatttggctc

SEQ ID NO: 671366 - DNA, 25 bp, Homo sapien
atttgacatgtgttgacaagtctgt

SEQ ID NO: 671367 - DNA, 25 bp, Homo sapien
gacaagtctgtcttaccgttcttta

SEQ ID NO: 671368 - DNA, 25 bp, Homo sapien
gtctgtcttaccgttctttaataag

SEQ ID NO: 671369 - DNA, 25 bp, Homo sapien
ataagggccgtgtataatgttttct

SEQ ID NO: 671370 - DNA, 25 bp, Homo sapien
atgttttctttagcaagtgtggcaa

SEQ ID NO: 671371 - DNA, 25 bp, Homo sapien
gtcagagatactggactatcgttca

SEQ ID NO: 671372 - DNA, 25 bp, Homo sapien
ggctctatcccctttgtgcctgtga

SEQ ID NO: 671373 - DNA, 25 bp, Homo sapien
ttccacctctcgagctgtgcaacaa

SEQ ID NO: 671374 - DNA, 25 bp, Homo sapien
acctctcgagctgtgcaacaacaaa

SEQ ID NO: 671375 - DNA, 25 bp, Homo sapien
tctcgagctgtgcaacaacaaatgc

SEQ ID NO: 671376 - DNA, 25 bp, Homo sapien
aacaacaaatgcaggatgctcagcc

SEQ ID NO: 671377 - DNA, 25 bp, Homo sapien
ggatgctcagccctcatgtgtcagt

SEQ ID NO: 671378 - DNA, 25 bp, Homo sapien
tcatgtgtcagtcccctcaattcac

SEQ ID NO: 671379 - DNA, 25 bp, Homo sapien
tcagtcccctcaattcacttgtaat

SEQ ID NO: 671380 - DNA, 25 bp, Homo sapien
gtcccctcaattcacttgtaattaa

SEQ ID NO: 671381 - DNA, 25 bp, Homo sapien
tgtaattaaataacaacacacctct

SEQ ID NO: 671382 - DNA, 25 bp, Homo sapien
tgaggcccctgatctctacacctac

SEQ ID NO: 671383 - DNA, 25 bp, Homo sapien
acacctacttcaccatgctcaaggc

SEQ ID NO: 671384 - DNA, 25 bp, Homo sapien
ggatgtggaccatgggctgctgccg

SEQ ID NO: 671385 - DNA, 25 bp, Homo sapien
caaggtggcaggcagcgaagagaat

SEQ ID NO: 671386 - DNA, 25 bp, Homo sapien
aagagaatggaaccgcagagacaga

SEQ ID NO: 671387 - DNA, 25 bp, Homo sapien
ggaagtcgaggacgagagtgcctca

SEQ ID NO: 671388 - DNA, 25 bp, Homo sapien
agagtgcctcaggagagctggacct

SEQ ID NO: 671389 - DNA, 25 bp, Homo sapien
atcctcatgcacctcaccgagaaag

SEQ ID NO: 671390 - DNA, 25 bp, Homo sapien
tgcacctcaccgagaaagcccagga

SEQ ID NO: 671391 - DNA, 25 bp, Homo sapien
ccaggaggtgacaaggaaataccag

SEQ ID NO: 671392 - DNA, 25 bp, Homo sapien
taccaggaaatgacgggacaagttt

SEQ ID NO: 671393 - DNA, 25 bp, Homo sapien
gtatgcattgttgatgcgagtgtca

SEQ ID NO: 671394 - DNA, 25 bp, Homo sapien
tatgcattgttgatgcgagtgtcaa

SEQ ID NO: 671395 - DNA, 25 bp, Homo sapien
atgcattgttgatgcgagtgtcaat

SEQ ID NO: 671396 - DNA, 25 bp, Homo sapien
tgcattgttgatgcgagtgtcaatt

SEQ ID NO: 671397 - DNA, 25 bp, Homo sapien
cattgttgatgcgagtgtcaattgg

SEQ ID NO: 671398 - DNA, 25 bp, Homo sapien
attgttgatgcgagtgtcaattggt

SEQ ID NO: 671399 - DNA, 25 bp, Homo sapien
tgttgatgcgagtgtcaattggtac

SEQ ID NO: 671400 - DNA, 25 bp, Homo sapien
gttgatgcgagtgtcaattggtacc

SEQ ID NO: 671401 - DNA, 25 bp, Homo sapien
ttgatgcgagtgtcaattggtaccc

SEQ ID NO: 671402 - DNA, 25 bp, Homo sapien
tgatgcgagtgtcaattggtaccca

SEQ ID NO: 671403 - DNA, 25 bp, Homo sapien
gatgcgagtgtcaattggtacccat

SEQ ID NO: 671404 - DNA, 25 bp, Homo sapien
gaaaaaccttgttctatatgaccta

SEQ ID NO: 671405 - DNA, 25 bp, Homo sapien
aaggaggtcatcactctacactctt

SEQ ID NO: 671406 - DNA, 25 bp, Homo sapien
gagaaacatctttgtgctactgtta

SEQ ID NO: 671407 - DNA, 25 bp, Homo sapien
acatctttgtgctactgttagaagt

SEQ ID NO: 671408 - DNA, 25 bp, Homo sapien
aagtatatacttttagcccagatcc

SEQ ID NO: 671409 - DNA, 25 bp, Homo sapien
atacttttagcccagatcctagcct

SEQ ID NO: 671410 - DNA, 25 bp, Homo sapien
cagttttaccctccattttgcatag

SEQ ID NO: 671411 - DNA, 25 bp, Homo sapien
taccctccattttgcataggaaatc

SEQ ID NO: 671412 - DNA, 25 bp, Homo sapien
ggaaatcaggatccctgggccctat

SEQ ID NO: 671413 - DNA, 25 bp, Homo sapien
ggccctatgggtttctgtattcagt

SEQ ID NO: 671414 - DNA, 25 bp, Homo sapien
ttacctatctctggaaattaaactt

SEQ ID NO: 671415 - DNA, 25 bp, Homo sapien
taagtctatggattgggaatttacc

SEQ ID NO: 671416 - DNA, 25 bp, Homo sapien
tggattgggaatttaccactgaaat

SEQ ID NO: 671417 - DNA, 25 bp, Homo sapien
ggaatttaccactgaaattgatcgt

SEQ ID NO: 671418 - DNA, 25 bp, Homo sapien
taccactgaaattgatcgttcaaag

SEQ ID NO: 671419 - DNA, 25 bp, Homo sapien
aaattgatcgttcaaagtgtgactt

SEQ ID NO: 671420 - DNA, 25 bp, Homo sapien
gggccagctcctcctaagttgtcct

SEQ ID NO: 671421 - DNA, 25 bp, Homo sapien
gccagctcctcctaagttgtccttt

SEQ ID NO: 671422 - DNA, 25 bp, Homo sapien
ccataaagattcatttaatagctga

SEQ ID NO: 671423 - DNA, 25 bp, Homo sapien
gaataggacgaatttaacatggaat

SEQ ID NO: 671424 - DNA, 25 bp, Homo sapien
tgccctttactgatatttaacacat

SEQ ID NO: 671425 - DNA, 25 bp, Homo sapien
tttaacacattttctcaaagctttt

SEQ ID NO: 671426 - DNA, 25 bp, Homo sapien
aatccagaggagacataagaagccc

SEQ ID NO: 671427 - DNA, 25 bp, Homo sapien
tccagaggagacataagaagcccct

SEQ ID NO: 671428 - DNA, 25 bp, Homo sapien
gaggagacataagaagcccctggca

SEQ ID NO: 671429 - DNA, 25 bp, Homo sapien
aggagacataagaagcccctggcag

SEQ ID NO: 671430 - DNA, 25 bp, Homo sapien
ggagacataagaagcccctggcaga

SEQ ID NO: 671431 - DNA, 25 bp, Homo sapien
gacataagaagcccctggcagaaga

SEQ ID NO: 671432 - DNA, 25 bp, Homo sapien
gaagaagaggcagaccccacgctga

SEQ ID NO: 671433 - DNA, 25 bp, Homo sapien
aagaagaggcagaccccacgctgac

SEQ ID NO: 671434 - DNA, 25 bp, Homo sapien
agaagaggcagaccccacgctgaca

SEQ ID NO: 671435 - DNA, 25 bp, Homo sapien
agaggcagaccccacgctgacaggc

SEQ ID NO: 671436 - DNA, 25 bp, Homo sapien
cagctggccgtcatgccgctccttg

SEQ ID NO: 671437 - DNA, 25 bp, Homo sapien
agcctccacactcaaaggtgtctct

SEQ ID NO: 671438 - DNA, 25 bp, Homo sapien
ctcaaaggtgtctctgtcagtgtgt

SEQ ID NO: 671439 - DNA, 25 bp, Homo sapien
tctgtcagtgtgtaggagaaaccct

SEQ ID NO: 671440 - DNA, 25 bp, Homo sapien
ggagaaaccctaccacagtacctgg

SEQ ID NO: 671441 - DNA, 25 bp, Homo sapien
gaaaccctaccacagtacctgggct

SEQ ID NO: 671442 - DNA, 25 bp, Homo sapien
atgcccagcttgattaaagacaatg

SEQ ID NO: 671443 - DNA, 25 bp, Homo sapien
gacaatggtgtttattaattcatcc

SEQ ID NO: 671444 - DNA, 25 bp, Homo sapien
atccatttgttcatcaaggttgcat

SEQ ID NO: 671445 - DNA, 25 bp, Homo sapien
aggttgcatgactattatgtgccaa

SEQ ID NO: 671446 - DNA, 25 bp, Homo sapien
ttatgtgccaaagaataagcagaac

SEQ ID NO: 671447 - DNA, 25 bp, Homo sapien
acactgctctttaaatgttcttaag

SEQ ID NO: 671448 - DNA, 25 bp, Homo sapien
tatcttcagaactgcggtgcatttt

SEQ ID NO: 671449 - DNA, 25 bp, Homo sapien
tcagaactgcggtgcatttttttaa

SEQ ID NO: 671450 - DNA, 25 bp, Homo sapien
ggttttacttctgtatgctactcgg

SEQ ID NO: 671451 - DNA, 25 bp, Homo sapien
ttttacttctgtatgctactcggta

SEQ ID NO: 671452 - DNA, 25 bp, Homo sapien
tacttctgtatgctactcggtaatt

SEQ ID NO: 671453 - DNA, 25 bp, Homo sapien
ttctgtatgctactcggtaattagt

SEQ ID NO: 671454 - DNA, 25 bp, Homo sapien
gctactcggtaattagtaaagtgat

SEQ ID NO: 671455 - DNA, 25 bp, Homo sapien
ggtaggtaactgtatattgatctct

SEQ ID NO: 671456 - DNA, 25 bp, Homo sapien
tatattgatctcttccttgaggaac

SEQ ID NO: 671457 - DNA, 25 bp, Homo sapien
gaaatcaagtctgtaaacctttata

SEQ ID NO: 671458 - DNA, 25 bp, Homo sapien
tcaagtctgtaaacctttatatgaa

SEQ ID NO: 671459 - DNA, 25 bp, Homo sapien
gtgcatgagtcacagcatggatcca

SEQ ID NO: 671460 - DNA, 25 bp, Homo sapien
catgagtcacagcatggatccagga

SEQ ID NO: 671461 - DNA, 25 bp, Homo sapien
tcacagcatggatccaggatgaatc

SEQ ID NO: 671462 - DNA, 25 bp, Homo sapien
aggatgaatcccagttcttcccctg

SEQ ID NO: 671463 - DNA, 25 bp, Homo sapien
agctattgggagctgccctaagcgt

SEQ ID NO: 671464 - DNA, 25 bp, Homo sapien
ctattgggagctgccctaagcgttg

SEQ ID NO: 671465 - DNA, 25 bp, Homo sapien
attgggagctgccctaagcgttgcc

SEQ ID NO: 671466 - DNA, 25 bp, Homo sapien
ccccatttgtctgtgaggaaaggcc

SEQ ID NO: 671467 - DNA, 25 bp, Homo sapien
ccatttgtctgtgaggaaaggccag

SEQ ID NO: 671468 - DNA, 25 bp, Homo sapien
gcactgacccctcttagatctactt

SEQ ID NO: 671469 - DNA, 25 bp, Homo sapien
tgccctgactttcgccattggaaag

SEQ ID NO: 671470 - DNA, 25 bp, Homo sapien
ctacgacctctctcgggatatttta

SEQ ID NO: 671471 - DNA, 25 bp, Homo sapien
ataatttcccacactcaatagccag

SEQ ID NO: 671472 - DNA, 25 bp, Homo sapien
tcccacactcaatagccaggcagaa

SEQ ID NO: 671473 - DNA, 25 bp, Homo sapien
caggcagaagcgaatattggtaaac

SEQ ID NO: 671474 - DNA, 25 bp, Homo sapien
attggtaaacctcagtatggtggaa

SEQ ID NO: 671475 - DNA, 25 bp, Homo sapien
aaacaagctggttgaactggaacat

SEQ ID NO: 671476 - DNA, 25 bp, Homo sapien
gaactggaacatactctacttagca

SEQ ID NO: 671477 - DNA, 25 bp, Homo sapien
atactctacttagcaagggtttcag

SEQ ID NO: 671478 - DNA, 25 bp, Homo sapien
caagggtttcagaggtgcatcacct

SEQ ID NO: 671479 - DNA, 25 bp, Homo sapien
tcaccggaaatccacctaaaagcgt

SEQ ID NO: 671480 - DNA, 25 bp, Homo sapien
gaaatccacctaaaagcgtacagga

SEQ ID NO: 671481 - DNA, 25 bp, Homo sapien
gttcactccatatattcagcatcgt

SEQ ID NO: 671482 - DNA, 25 bp, Homo sapien
tccatatattcagcatcgtcagaga

SEQ ID NO: 671483 - DNA, 25 bp, Homo sapien
gtcagagaaacccaaatcagccatt

SEQ ID NO: 671484 - DNA, 25 bp, Homo sapien
atcagccattttacattcttcatcc

SEQ ID NO: 671485 - DNA, 25 bp, Homo sapien
atcctaaatttatatggcagctctg

SEQ ID NO: 671486 - DNA, 25 bp, Homo sapien
ttatatggcagctctgggatattat

SEQ ID NO: 671487 - DNA, 25 bp, Homo sapien
gagaagattcaaccaaacccaccat

SEQ ID NO: 671488 - DNA, 25 bp, Homo sapien
aaacccaccatcttctggtttcatt

SEQ ID NO: 671489 - DNA, 25 bp, Homo sapien
catcttctggtttcattggctcatt

SEQ ID NO: 671490 - DNA, 25 bp, Homo sapien
ggtttcattggctcatttgtaaaaa

SEQ ID NO: 671491 - DNA, 25 bp, Homo sapien
aattggccatatcagagcttgcagt

SEQ ID NO: 671492 - DNA, 25 bp, Homo sapien
ggctgaagacactgataaggaggaa

SEQ ID NO: 671493 - DNA, 25 bp, Homo sapien
gacactgataaggaggaatgcatgc

SEQ ID NO: 671494 - DNA, 25 bp, Homo sapien
cactgataaggaggaatgcatgcat

SEQ ID NO: 671495 - DNA, 25 bp, Homo sapien
ctgataaggaggaatgcatgcataa

SEQ ID NO: 671496 - DNA, 25 bp, Homo sapien
aatgcatgcataattcagtgaatac

SEQ ID NO: 671497 - DNA, 25 bp, Homo sapien
taattcagtgaatacccaaccttta

SEQ ID NO: 671498 - DNA, 25 bp, Homo sapien
aattcagtgaatacccaacctttat

SEQ ID NO: 671499 - DNA, 25 bp, Homo sapien
attcagtgaatacccaacctttata

SEQ ID NO: 671500 - DNA, 25 bp, Homo sapien
tcagtgaatacccaacctttataat

SEQ ID NO: 671501 - DNA, 25 bp, Homo sapien
cagtgaatacccaacctttataata

SEQ ID NO: 671502 - DNA, 25 bp, Homo sapien
gtgaatacccaacctttataataat

SEQ ID NO: 671503 - DNA, 25 bp, Homo sapien
gtggtacccagtcataaatcacctg

SEQ ID NO: 671504 - DNA, 25 bp, Homo sapien
tcacctgttttggatacaaagccca

SEQ ID NO: 671505 - DNA, 25 bp, Homo sapien
ggcacaccgaaagaaagcagtactg

SEQ ID NO: 671506 - DNA, 25 bp, Homo sapien
gtactgaaagcagccagtcggccaa

SEQ ID NO: 671507 - DNA, 25 bp, Homo sapien
gtctctggccaagacacatcaggga

SEQ ID NO: 671508 - DNA, 25 bp, Homo sapien
aatacagaaggttcacccgcagcgg

SEQ ID NO: 671509 - DNA, 25 bp, Homo sapien
ggaaaaggcccagctcaagtctgaa

SEQ ID NO: 671510 - DNA, 25 bp, Homo sapien
agtctgaagccgcaggcagcccaga

SEQ ID NO: 671511 - DNA, 25 bp, Homo sapien
atacagccccgcaagaggtgtggct

SEQ ID NO: 671512 - DNA, 25 bp, Homo sapien
tggctggaccacgtggacaggatcc

SEQ ID NO: 671513 - DNA, 25 bp, Homo sapien
tcagcagcccctgtggctagaggaa

SEQ ID NO: 671514 - DNA, 25 bp, Homo sapien
catatgatggatgctccaccactct

SEQ ID NO: 671515 - DNA, 25 bp, Homo sapien
tctccttttccacatattaaacaac

SEQ ID NO: 671516 - DNA, 25 bp, Homo sapien
ttaaacaacagccaggctcaccacg

SEQ ID NO: 671517 - DNA, 25 bp, Homo sapien
ttcccagcagcactccatttatatt

SEQ ID NO: 671518 - DNA, 25 bp, Homo sapien
tccatttatatttccccgcacaaga

SEQ ID NO: 671519 - DNA, 25 bp, Homo sapien
atttccccgcacaagaatgggtcag

SEQ ID NO: 671520 - DNA, 25 bp, Homo sapien
aatgggtcaggccttacaccaagaa

SEQ ID NO: 671521 - DNA, 25 bp, Homo sapien
aggccttacaccaagaagcgctctg

SEQ ID NO: 671522 - DNA, 25 bp, Homo sapien
aagcgctctgctgtacaagttcaat

SEQ ID NO: 671523 - DNA, 25 bp, Homo sapien
gtacaagttcaatggcagcccttct

SEQ ID NO: 671524 - DNA, 25 bp, Homo sapien
caagttcaatggcagcccttctaag

SEQ ID NO: 671525 - DNA, 25 bp, Homo sapien
gacaatggaaacatgtagacagttc

SEQ ID NO: 671526 - DNA, 25 bp, Homo sapien
caatggaaacatgtagacagttcta

SEQ ID NO: 671527 - DNA, 25 bp, Homo sapien
ggaaacatgtagacagttctaactg

SEQ ID NO: 671528 - DNA, 25 bp, Homo sapien
gaaacatgtagacagttctaactgt

SEQ ID NO: 671529 - DNA, 25 bp, Homo sapien
acatgtagacagttctaactgtgga

SEQ ID NO: 671530 - DNA, 25 bp, Homo sapien
tagacagttctaactgtggaggttc

SEQ ID NO: 671531 - DNA, 25 bp, Homo sapien
gacagttctaactgtggaggttctg

SEQ ID NO: 671532 - DNA, 25 bp, Homo sapien
cagttctaactgtggaggttctgga

SEQ ID NO: 671533 - DNA, 25 bp, Homo sapien
agttctaactgtggaggttctggag

SEQ ID NO: 671534 - DNA, 25 bp, Homo sapien
ctaactgtggaggttctggagggtg

SEQ ID NO: 671535 - DNA, 25 bp, Homo sapien
ggaggttctggagggtgtggaagtt

SEQ ID NO: 671536 - DNA, 25 bp, Homo sapien
atattcttccacattatgtttaatg

SEQ ID NO: 671537 - DNA, 25 bp, Homo sapien
tagttattttaaccaccccacaatg

SEQ ID NO: 671538 - DNA, 25 bp, Homo sapien
ttaaccaccccacaatgttgcaaaa

SEQ ID NO: 671539 - DNA, 25 bp, Homo sapien
cttatttgggacaacactgctgcaa

SEQ ID NO: 671540 - DNA, 25 bp, Homo sapien
actgctgcaaacactttgacccata

SEQ ID NO: 671541 - DNA, 25 bp, Homo sapien
ctttgacccatatgtcctttttgtg

SEQ ID NO: 671542 - DNA, 25 bp, Homo sapien
cctttttgtgtgcactcttatggca

SEQ ID NO: 671543 - DNA, 25 bp, Homo sapien
gtgtgcactcttatggcaacttcta

SEQ ID NO: 671544 - DNA, 25 bp, Homo sapien
tggcaacttctaacggtggcatttc

SEQ ID NO: 671545 - DNA, 25 bp, Homo sapien
ttctaacggtggcatttctgaatca

SEQ ID NO: 671546 - DNA, 25 bp, Homo sapien
gaatcatagacacttttttgacttc

SEQ ID NO: 671547 - DNA, 25 bp, Homo sapien
aagtatttgtttacctctatctcca

SEQ ID NO: 671548 - DNA, 25 bp, Homo sapien
gatataccaattttaactatttctg

SEQ ID NO: 671549 - DNA, 25 bp, Homo sapien
atttctgatacagctgaaagcacta

SEQ ID NO: 671550 - DNA, 25 bp, Homo sapien
gaaagcactaaactacttcataaga

SEQ ID NO: 671551 - DNA, 25 bp, Homo sapien
gtaacactatttagggcttttgtgg

SEQ ID NO: 671552 - DNA, 25 bp, Homo sapien
taaaggaaaccactctttctacagg

SEQ ID NO: 671553 - DNA, 25 bp, Homo sapien
gaaaccactctttctacaggaaaca

SEQ ID NO: 671554 - DNA, 25 bp, Homo sapien
ggaaacaagggctcaggattcttca

SEQ ID NO: 671555 - DNA, 25 bp, Homo sapien
agggctcaggattcttcagatgacc

SEQ ID NO: 671556 - DNA, 25 bp, Homo sapien
aggattcttcagatgaccttataaa

SEQ ID NO: 671557 - DNA, 25 bp, Homo sapien
aaaatgcagtccacagtgctatcaa

SEQ ID NO: 671558 - DNA, 25 bp, Homo sapien
tccacttgggcgacacagccagaac

SEQ ID NO: 671559 - DNA, 25 bp, Homo sapien
ccacttgggcgacacagccagaact

SEQ ID NO: 671560 - DNA, 25 bp, Homo sapien
gaactcctctttgaaaaacataata

SEQ ID NO: 671561 - DNA, 25 bp, Homo sapien
atagtagtaataagagaccccttag

SEQ ID NO: 671562 - DNA, 25 bp, Homo sapien
tagtagtaataagagaccccttaga

SEQ ID NO: 671563 - DNA, 25 bp, Homo sapien
gagaccccttagaaaaaatcaactg

SEQ ID NO: 671564 - DNA, 25 bp, Homo sapien
cttagaaaaaatcaactggctcttt

SEQ ID NO: 671565 - DNA, 25 bp, Homo sapien
tcaactggctcttttatgaaaggaa

SEQ ID NO: 671566 - DNA, 25 bp, Homo sapien
aagatgctttcagaatgaatagcta

SEQ ID NO: 671567 - DNA, 25 bp, Homo sapien
gatgctttcagaatgaatagctaat

SEQ ID NO: 671568 - DNA, 25 bp, Homo sapien
tttcagaatgaatagctaatgcatg

SEQ ID NO: 671569 - DNA, 25 bp, Homo sapien
ttttgccaatgggaggtagacacaa

SEQ ID NO: 671570 - DNA, 25 bp, Homo sapien
ataatgccatgggagtcacactgaa

SEQ ID NO: 671571 - DNA, 25 bp, Homo sapien
gcaattttgagcttatctgtcttat

SEQ ID NO: 671572 - DNA, 25 bp, Homo sapien
gcttatctgtcttatttatgctttg

SEQ ID NO: 671573 - DNA, 25 bp, Homo sapien
ttatgctttgagtgaatcatctgtt

SEQ ID NO: 671574 - DNA, 25 bp, Homo sapien
gaatcatctgttgaggtctaatgcc

SEQ ID NO: 671575 - DNA, 25 bp, Homo sapien
ggcctatttgccagagaacatctta

SEQ ID NO: 671576 - DNA, 25 bp, Homo sapien
gagaacatcttaatgcagcctgcat

SEQ ID NO: 671577 - DNA, 25 bp, Homo sapien
gcagcctgcatagtgaaatggttat

SEQ ID NO: 671578 - DNA, 25 bp, Homo sapien
attttgagatcaccgctctgtagct

SEQ ID NO: 671579 - DNA, 25 bp, Homo sapien
cgctctgtagctaacccttataaac

SEQ ID NO: 671580 - DNA, 25 bp, Homo sapien
tcctgcttcacgtgtgtgacctgcg

SEQ ID NO: 671581 - DNA, 25 bp, Homo sapien
ggatgagagctttgccctgggcagc

SEQ ID NO: 671582 - DNA, 25 bp, Homo sapien
aacgaggtgtactgcctggacgact

SEQ ID NO: 671583 - DNA, 25 bp, Homo sapien
tgtactgcctggacgacttctacag

SEQ ID NO: 671584 - DNA, 25 bp, Homo sapien
gacgacttctacaggtacgagaagg

SEQ ID NO: 671585 - DNA, 25 bp, Homo sapien
caggtacgagaagggtttgtgcact

SEQ ID NO: 671586 - DNA, 25 bp, Homo sapien
ggacagggcgagacccaagcagggt

SEQ ID NO: 671587 - DNA, 25 bp, Homo sapien
gtgctgggccagagtttcctgtcta

SEQ ID NO: 671588 - DNA, 25 bp, Homo sapien
ccagagtttcctgtctactggttta

SEQ ID NO: 671589 - DNA, 25 bp, Homo sapien
tggtccgggaccacatcatcagggc

SEQ ID NO: 671590 - DNA, 25 bp, Homo sapien
gggaccacatcatcagggccctggg

SEQ ID NO: 671591 - DNA, 25 bp, Homo sapien
agtagtgcattagagggctgtggaa

SEQ ID NO: 671592 - DNA, 25 bp, Homo sapien
tgtggttcttgggttataaataaag

SEQ ID NO: 671593 - DNA, 25 bp, Homo sapien
ataaataaaggtggctgatgggtca

SEQ ID NO: 671594 - DNA, 25 bp, Homo sapien
gctgatgggtcaagggctgggagaa

SEQ ID NO: 671595 - DNA, 25 bp, Homo sapien
gggtttcaattgtatctgttatgtt

SEQ ID NO: 671596 - DNA, 25 bp, Homo sapien
agctggctggtggatacacaggtct

SEQ ID NO: 671597 - DNA, 25 bp, Homo sapien
ctggctggtggatacacaggtcttt

SEQ ID NO: 671598 - DNA, 25 bp, Homo sapien
gctggtggatacacaggtctttgtt

SEQ ID NO: 671599 - DNA, 25 bp, Homo sapien
acaggtctttgttacatcatcatct

SEQ ID NO: 671600 - DNA, 25 bp, Homo sapien
caggtctttgttacatcatcatcta

SEQ ID NO: 671601 - DNA, 25 bp, Homo sapien
tgtatgcctgaaatatttcatgttt

SEQ ID NO: 671602 - DNA, 25 bp, Homo sapien
tgaatggccaaaactataaaaacat

SEQ ID NO: 671603 - DNA, 25 bp, Homo sapien
agtaaatgtgtatgcaccaataaaa

SEQ ID NO: 671604 - DNA, 25 bp, Homo sapien
gtagtacaaatagaaaggactttct

SEQ ID NO: 671605 - DNA, 25 bp, Homo sapien
aataagacttgatactggaaaccat

SEQ ID NO: 671606 - DNA, 25 bp, Homo sapien
gacttgatactggaaaccataacga

SEQ ID NO: 671607 - DNA, 25 bp, Homo sapien
atactggaaaccataacgaatggct

SEQ ID NO: 671608 - DNA, 25 bp, Homo sapien
aacgaatggctaatttgcttactac

SEQ ID NO: 671609 - DNA, 25 bp, Homo sapien
gaatggctaatttgcttactacaca

SEQ ID NO: 671610 - DNA, 25 bp, Homo sapien
ggctaatttgcttactacacagaga

SEQ ID NO: 671611 - DNA, 25 bp, Homo sapien
atttgcttactacacagagatataa

SEQ ID NO: 671612 - DNA, 25 bp, Homo sapien
ggacaaaggatataaaattgcttac

SEQ ID NO: 671613 - DNA, 25 bp, Homo sapien
ggatgagagctttgccctgggcagc

SEQ ID NO: 671614 - DNA, 25 bp, Homo sapien
agccagaacgaggtgtactgcctgg

SEQ ID NO: 671615 - DNA, 25 bp, Homo sapien
cagaacgaggtgtactgcctggacg

SEQ ID NO: 671616 - DNA, 25 bp, Homo sapien
agaacgaggtgtactgcctggacga

SEQ ID NO: 671617 - DNA, 25 bp, Homo sapien
aacgaggtgtactgcctggacgact

SEQ ID NO: 671618 - DNA, 25 bp, Homo sapien
acgaggtgtactgcctggacgactt

SEQ ID NO: 671619 - DNA, 25 bp, Homo sapien
gaggtgtactgcctggacgacttct

SEQ ID NO: 671620 - DNA, 25 bp, Homo sapien
aggtgtactgcctggacgacttcta

SEQ ID NO: 671621 - DNA, 25 bp, Homo sapien
ggtgtactgcctggacgacttctac

SEQ ID NO: 671622 - DNA, 25 bp, Homo sapien
tgtactgcctggacgacttctacag

SEQ ID NO: 671623 - DNA, 25 bp, Homo sapien
gtactgcctggacgacttctacagg

SEQ ID NO: 671624 - DNA, 25 bp, Homo sapien
ggcagcccttctaaggtaaggtgaa

SEQ ID NO: 671625 - DNA, 25 bp, Homo sapien
cagcccttctaaggtaaggtgaata

SEQ ID NO: 671626 - DNA, 25 bp, Homo sapien
cttctaaggtaaggtgaataggcta

SEQ ID NO: 671627 - DNA, 25 bp, Homo sapien
gtgaataggctaaaagttggatttc

SEQ ID NO: 671628 - DNA, 25 bp, Homo sapien
tggatttcagattaacagtcagtaa

SEQ ID NO: 671629 - DNA, 25 bp, Homo sapien
gatttcagattaacagtcagtaact

SEQ ID NO: 671630 - DNA, 25 bp, Homo sapien
agtcagtaactgttaatcctgcctc

SEQ ID NO: 671631 - DNA, 25 bp, Homo sapien
gtcagtaactgttaatcctgcctct

SEQ ID NO: 671632 - DNA, 25 bp, Homo sapien
tcagtaactgttaatcctgcctctt

SEQ ID NO: 671633 - DNA, 25 bp, Homo sapien
cagtaactgttaatcctgcctcttt

SEQ ID NO: 671634 - DNA, 25 bp, Homo sapien
gccaagttactactatactaataaa

SEQ ID NO: 671635 - DNA, 25 bp, Homo sapien
tctggctgatatgatggagttttgc

SEQ ID NO: 671636 - DNA, 25 bp, Homo sapien
ctgccgcttgggttgaagcgattat

SEQ ID NO: 671637 - DNA, 25 bp, Homo sapien
tgggttgaagcgattatcctgtcta

SEQ ID NO: 671638 - DNA, 25 bp, Homo sapien
gaagcgattatcctgtctaagcctc

SEQ ID NO: 671639 - DNA, 25 bp, Homo sapien
actgagccagccatgtttgttaata

SEQ ID NO: 671640 - DNA, 25 bp, Homo sapien
atattttagctttttcacttttcag

SEQ ID NO: 671641 - DNA, 25 bp, Homo sapien
gctttttcacttttcagtatctcct

SEQ ID NO: 671642 - DNA, 25 bp, Homo sapien
ttcacttttcagtatctcctgaggc

SEQ ID NO: 671643 - DNA, 25 bp, Homo sapien
ttttcagtatctcctgaggcttttc

SEQ ID NO: 671644 - DNA, 25 bp, Homo sapien
agtatctcctgaggcttttctcatg

SEQ ID NO: 671645 - DNA, 25 bp, Homo sapien
atctcctgaggcttttctcatgtca

SEQ ID NO: 671646 - DNA, 25 bp, Homo sapien
tcatcatccaaagtgtccagccaga

SEQ ID NO: 671647 - DNA, 25 bp, Homo sapien
atcatccaaagtgtccagccagagg

SEQ ID NO: 671648 - DNA, 25 bp, Homo sapien
tgtccagccagagggctgaagctta

SEQ ID NO: 671649 - DNA, 25 bp, Homo sapien
gggctgaagcttagggccagaggca

SEQ ID NO: 671650 - DNA, 25 bp, Homo sapien
gggtccaaggtggtacctgcacatt

SEQ ID NO: 671651 - DNA, 25 bp, Homo sapien
aaggtggtacctgcacatttgtcca

SEQ ID NO: 671652 - DNA, 25 bp, Homo sapien
ggtacctgcacatttgtccaggaag

SEQ ID NO: 671653 - DNA, 25 bp, Homo sapien
ctgcacatttgtccaggaagacaga

SEQ ID NO: 671654 - DNA, 25 bp, Homo sapien
cctagaaaggctgggctgcccatca

SEQ ID NO: 671655 - DNA, 25 bp, Homo sapien
gaaaggctgggctgcccatcaaggc

SEQ ID NO: 671656 - DNA, 25 bp, Homo sapien
ggctgggctgcccatcaaggcctca

SEQ ID NO: 671657 - DNA, 25 bp, Homo sapien
tcactgtttgtccttttacactctt

SEQ ID NO: 671658 - DNA, 25 bp, Homo sapien
cactgtttgtccttttacactctta

SEQ ID NO: 671659 - DNA, 25 bp, Homo sapien
aaaagcacatctctgtatagcccat

SEQ ID NO: 671660 - DNA, 25 bp, Homo sapien
aagcacatctctgtatagcccattc

SEQ ID NO: 671661 - DNA, 25 bp, Homo sapien
catctctgtatagcccattccaaaa

SEQ ID NO: 671662 - DNA, 25 bp, Homo sapien
ctgtatagcccattccaaaaagata

SEQ ID NO: 671663 - DNA, 25 bp, Homo sapien
agcccattccaaaaagataattatg

SEQ ID NO: 671664 - DNA, 25 bp, Homo sapien
tagtgttttacttcatcatagagcc

SEQ ID NO: 671665 - DNA, 25 bp, Homo sapien
gttttacttcatcatagagccttgt

SEQ ID NO: 671666 - DNA, 25 bp, Homo sapien
tacttcatcatagagccttgtttat

SEQ ID NO: 671667 - DNA, 25 bp, Homo sapien
catcatagagccttgtttattctat

SEQ ID NO: 671668 - DNA, 25 bp, Homo sapien
ccggcatggtggagccctgtctcta

SEQ ID NO: 671669 - DNA, 25 bp, Homo sapien
cggcatggtggagccctgtctctac

SEQ ID NO: 671670 - DNA, 25 bp, Homo sapien
ggcatggtggagccctgtctctact

SEQ ID NO: 671671 - DNA, 25 bp, Homo sapien
ggcgggcgcctgtgattgcagctac

SEQ ID NO: 671672 - DNA, 25 bp, Homo sapien
gggcgcctgtgattgcagctactcg

SEQ ID NO: 671673 - DNA, 25 bp, Homo sapien
ggcgcctgtgattgcagctactcgg

SEQ ID NO: 671674 - DNA, 25 bp, Homo sapien
gcagatttgcagtgagctaagatca

SEQ ID NO: 671675 - DNA, 25 bp, Homo sapien
catgcctctgcattccagccagggt

SEQ ID NO: 671676 - DNA, 25 bp, Homo sapien
atgcctctgcattccagccagggtg

SEQ ID NO: 671677 - DNA, 25 bp, Homo sapien
tgcctctgcattccagccagggtga

SEQ ID NO: 671678 - DNA, 25 bp, Homo sapien
gcctctgcattccagccagggtgac

SEQ ID NO: 671679 - DNA, 25 bp, Homo sapien
acttcaccacctggaaggaagctat

SEQ ID NO: 671680 - DNA, 25 bp, Homo sapien
aagctatggaggagaattgcccaaa

SEQ ID NO: 671681 - DNA, 25 bp, Homo sapien
gaattgcccaaacaaatacaactgc

SEQ ID NO: 671682 - DNA, 25 bp, Homo sapien
aactgcatcaaattttgcctctgta

SEQ ID NO: 671683 - DNA, 25 bp, Homo sapien
ttgcctctgtaagaaatagatcttt

SEQ ID NO: 671684 - DNA, 25 bp, Homo sapien
gttatgctacaataggtccctgaga

SEQ ID NO: 671685 - DNA, 25 bp, Homo sapien
gattttatttgttatagtagctagc

SEQ ID NO: 671686 - DNA, 25 bp, Homo sapien
aataaatggttctcacggttctgta

SEQ ID NO: 671687 - DNA, 25 bp, Homo sapien
gttctcacggttctgtaaagctgca

SEQ ID NO: 671688 - DNA, 25 bp, Homo sapien
aagctgcaacatgcttttaaaatgt

SEQ ID NO: 671689 - DNA, 25 bp, Homo sapien
gacacaatgatcaaacaacaggaag

SEQ ID NO: 671690 - DNA, 25 bp, Homo sapien
catgggaggctgaagcaagagaatc

SEQ ID NO: 671691 - DNA, 25 bp, Homo sapien
atcacttgagcaggggaggcagcca

SEQ ID NO: 671692 - DNA, 25 bp, Homo sapien
tcacttgagcaggggaggcagccac

SEQ ID NO: 671693 - DNA, 25 bp, Homo sapien
cacttgagcaggggaggcagccact

SEQ ID NO: 671694 - DNA, 25 bp, Homo sapien
acttgagcaggggaggcagccactg

SEQ ID NO: 671695 - DNA, 25 bp, Homo sapien
aggggaggcagccactgccctccag

SEQ ID NO: 671696 - DNA, 25 bp, Homo sapien
gccctccagcccgggcagcagagtg

SEQ ID NO: 671697 - DNA, 25 bp, Homo sapien
ccctccagcccgggcagcagagtga

SEQ ID NO: 671698 - DNA, 25 bp, Homo sapien
cctccagcccgggcagcagagtgag

SEQ ID NO: 671699 - DNA, 25 bp, Homo sapien
ccgggcagcagagtgagactcttgt

SEQ ID NO: 671700 - DNA, 25 bp, Homo sapien
cgggcagcagagtgagactcttgtc

SEQ ID NO: 671701 - DNA, 25 bp, Homo sapien
cgcctccagggctgaaatcacatct

SEQ ID NO: 671702 - DNA, 25 bp, Homo sapien
ggctgaaatcacatctcaattctta

SEQ ID NO: 671703 - DNA, 25 bp, Homo sapien
tctgcttccttcactgaagggactt

SEQ ID NO: 671704 - DNA, 25 bp, Homo sapien
cttcactgaagggactttactaagt

SEQ ID NO: 671705 - DNA, 25 bp, Homo sapien
ctaagtgtttcattgcaagttttct

SEQ ID NO: 671706 - DNA, 25 bp, Homo sapien
gctctcagagccatttcaaataggg

SEQ ID NO: 671707 - DNA, 25 bp, Homo sapien
gagccatttcaaatagggttttatg

SEQ ID NO: 671708 - DNA, 25 bp, Homo sapien
gttcctaaattcagttagttctcaa

SEQ ID NO: 671709 - DNA, 25 bp, Homo sapien
gttagttctcaacatttgagaccaa

SEQ ID NO: 671710 - DNA, 25 bp, Homo sapien
ttgagaccaattcttgcagcaaggt

SEQ ID NO: 671711 - DNA, 25 bp, Homo sapien
aggtggagaataactctcatctgtg

SEQ ID NO: 671712 - DNA, 25 bp, Homo sapien
ggcggtggctcctgtctataatcgc

SEQ ID NO: 671713 - DNA, 25 bp, Homo sapien
gcggtggctcctgtctataatcgca

SEQ ID NO: 671714 - DNA, 25 bp, Homo sapien
cggtggctcctgtctataatcgcag

SEQ ID NO: 671715 - DNA, 25 bp, Homo sapien
ggtggctcctgtctataatcgcagc

SEQ ID NO: 671716 - DNA, 25 bp, Homo sapien
gtggctcctgtctataatcgcagca

SEQ ID NO: 671717 - DNA, 25 bp, Homo sapien
tggctcctgtctataatcgcagcac

SEQ ID NO: 671718 - DNA, 25 bp, Homo sapien
ggctcctgtctataatcgcagcact

SEQ ID NO: 671719 - DNA, 25 bp, Homo sapien
gctcctgtctataatcgcagcactt

SEQ ID NO: 671720 - DNA, 25 bp, Homo sapien
aattagccaggactgatggcatgtg

SEQ ID NO: 671721 - DNA, 25 bp, Homo sapien
attagccaggactgatggcatgtgc

SEQ ID NO: 671722 - DNA, 25 bp, Homo sapien
ttagccaggactgatggcatgtgcc

SEQ ID NO: 671723 - DNA, 25 bp, Homo sapien
gtagacgtgtgatgcaaatttctta

SEQ ID NO: 671724 - DNA, 25 bp, Homo sapien
gcaaatttcttaatagtcaaacgtt

SEQ ID NO: 671725 - DNA, 25 bp, Homo sapien
gtcaaacgttatgcaacatatgatg

SEQ ID NO: 671726 - DNA, 25 bp, Homo sapien
gatgcataagaattgtactatctca

SEQ ID NO: 671727 - DNA, 25 bp, Homo sapien
ctcttgatgccactttcatttacct

SEQ ID NO: 671728 - DNA, 25 bp, Homo sapien
gatgccactttcatttacctacaca

SEQ ID NO: 671729 - DNA, 25 bp, Homo sapien
aatcacatatacatatactgacacg

SEQ ID NO: 671730 - DNA, 25 bp, Homo sapien
gagggaggataactttaatcatgat

SEQ ID NO: 671731 - DNA, 25 bp, Homo sapien
tttaatcatgatacactgccaatat

SEQ ID NO: 671732 - DNA, 25 bp, Homo sapien
tacactgccaatataagaactccct

SEQ ID NO: 671733 - DNA, 25 bp, Homo sapien
caatataagaactcccttttggccg

SEQ ID NO: 671734 - DNA, 25 bp, Homo sapien
ttgcaattgggcttacagtaattta

SEQ ID NO: 671735 - DNA, 25 bp, Homo sapien
ataatttgagattgtctttagacca

SEQ ID NO: 671736 - DNA, 25 bp, Homo sapien
gtctttagaccatttgagattgtca

SEQ ID NO: 671737 - DNA, 25 bp, Homo sapien
ggtaataattctgacagctattctt

SEQ ID NO: 671738 - DNA, 25 bp, Homo sapien
cagctattcttttttgcggactttg

SEQ ID NO: 671739 - DNA, 25 bp, Homo sapien
tcttttttgcggactttggaccaag

SEQ ID NO: 671740 - DNA, 25 bp, Homo sapien
gcggactttggaccaagtatattat

SEQ ID NO: 671741 - DNA, 25 bp, Homo sapien
gtacttagcatctactttgtaaacc

SEQ ID NO: 671742 - DNA, 25 bp, Homo sapien
atacaaatccataccctcatgggtt

SEQ ID NO: 671743 - DNA, 25 bp, Homo sapien
taccctcatgggttgggatgctttt

SEQ ID NO: 671744 - DNA, 25 bp, Homo sapien
ctcatgggttgggatgcttttttgt

SEQ ID NO: 671745 - DNA, 25 bp, Homo sapien
aaatccgtggagctgtcccaacttc

SEQ ID NO: 671746 - DNA, 25 bp, Homo sapien
cctgggccattatcatcatatggaa

SEQ ID NO: 671747 - DNA, 25 bp, Homo sapien
atatggaatgcctcacgtttgtcag

SEQ ID NO: 671748 - DNA, 25 bp, Homo sapien
gcctcacgtttgtcagtataatgct

SEQ ID NO: 671749 - DNA, 25 bp, Homo sapien
ggtatccagtacagtgggtaggaat

SEQ ID NO: 671750 - DNA, 25 bp, Homo sapien
gaatttcaggaacaacacaacaatc

SEQ ID NO: 671751 - DNA, 25 bp, Homo sapien
aacaatctgtagtaattcccgccca

SEQ ID NO: 671752 - DNA, 25 bp, Homo sapien
attccagccagggatgaatatgcag

SEQ ID NO: 671753 - DNA, 25 bp, Homo sapien
aatatgcaggcatttccaacttcat

SEQ ID NO: 671754 - DNA, 25 bp, Homo sapien
ggcatttccaacttcatcagtgcag

SEQ ID NO: 671755 - DNA, 25 bp, Homo sapien
atcagtgcagaatcctgccacaatc

SEQ ID NO: 671756 - DNA, 25 bp, Homo sapien
aacaacatgtaggtgtccccttact

SEQ ID NO: 671757 - DNA, 25 bp, Homo sapien
aacatgtaggtgtccccttactcaa

SEQ ID NO: 671758 - DNA, 25 bp, Homo sapien
tgtaggtgtccccttactcaagaaa

SEQ ID NO: 671759 - DNA, 25 bp, Homo sapien
ccttgtgacactggaggtaagtttg

SEQ ID NO: 671760 - DNA, 25 bp, Homo sapien
gacactggaggtaagtttggaagaa

SEQ ID NO: 671761 - DNA, 25 bp, Homo sapien
gaatatggatctgtcaacctgagga

SEQ ID NO: 671762 - DNA, 25 bp, Homo sapien
aaatatggatctgtcaacctgagga

SEQ ID NO: 671763 - DNA, 25 bp, Homo sapien
atggatctgtcaacctgaggaattg

SEQ ID NO: 671764 - DNA, 25 bp, Homo sapien
gtcaacctgaggaattgggaaagat

SEQ ID NO: 671765 - DNA, 25 bp, Homo sapien
catcctagtaagaggcatggcctaa

SEQ ID NO: 671766 - DNA, 25 bp, Homo sapien
aagaggcatggcctaattcctctcc

SEQ ID NO: 671767 - DNA, 25 bp, Homo sapien
attttcttaaggcaaggacctagtg

SEQ ID NO: 671768 - DNA, 25 bp, Homo sapien
ggacctagtgttgaattatctggct

SEQ ID NO: 671769 - DNA, 25 bp, Homo sapien
ttatctggcttaggtgggacatccc

SEQ ID NO: 671770 - DNA, 25 bp, Homo sapien
tgggacatcccaaggcttggtttct

SEQ ID NO: 671771 - DNA, 25 bp, Homo sapien
tcttctttttgttccactctcacaa

SEQ ID NO: 671772 - DNA, 25 bp, Homo sapien
gttccactctcacaattaatactac

SEQ ID NO: 671773 - DNA, 25 bp, Homo sapien
acaattaatactaccaatctggaaa

SEQ ID NO: 671774 - DNA, 25 bp, Homo sapien
ttctggagtggcagttcattaactt

SEQ ID NO: 671775 - DNA, 25 bp, Homo sapien
tcattaacttttaacaggtaccaag

SEQ ID NO: 671776 - DNA, 25 bp, Homo sapien
gtaccaagtccctaaatgctgcatt

SEQ ID NO: 671777 - DNA, 25 bp, Homo sapien
catcattgtcatgttaatcatctta

SEQ ID NO: 671778 - DNA, 25 bp, Homo sapien
gtttcgcacagaggtctggtgctgt

SEQ ID NO: 671779 - DNA, 25 bp, Homo sapien
attagtggatctggaccagtggaac

SEQ ID NO: 671780 - DNA, 25 bp, Homo sapien
gatctggaccagtggaacattggtt

SEQ ID NO: 671781 - DNA, 25 bp, Homo sapien
aacattggtttagtgtaatctctga

SEQ ID NO: 671782 - DNA, 25 bp, Homo sapien
gtaatctctgatttgtgttgagtga

SEQ ID NO: 671783 - DNA, 25 bp, Homo sapien
tttgagtatagtccaaccaccaccc

SEQ ID NO: 671784 - DNA, 25 bp, Homo sapien
caactaaaccatgtgcccctcagga

SEQ ID NO: 671785 - DNA, 25 bp, Homo sapien
attttctattccttatagcaggctc

SEQ ID NO: 671786 - DNA, 25 bp, Homo sapien
attccttatagcaggctcagtgcct

SEQ ID NO: 671787 - DNA, 25 bp, Homo sapien
gtgcctgacacactacgttgaattt

SEQ ID NO: 671788 - DNA, 25 bp, Homo sapien
gacacactacgttgaattttatttt

SEQ ID NO: 671789 - DNA, 25 bp, Homo sapien
aaactcctctgtcactttctgtgtc

SEQ ID NO: 671790 - DNA, 25 bp, Homo sapien
tttctgtgtccagcgggcccctggg

SEQ ID NO: 671791 - DNA, 25 bp, Homo sapien
gccttggtgctgtagggactgttat

SEQ ID NO: 671792 - DNA, 25 bp, Homo sapien
tagggactgttataagagctgctgt

SEQ ID NO: 671793 - DNA, 25 bp, Homo sapien
gttataagagctgctgtccgatccc

SEQ ID NO: 671794 - DNA, 25 bp, Homo sapien
taagagctgctgtccgatccccata

SEQ ID NO: 671795 - DNA, 25 bp, Homo sapien
tgtccgatccccatattcaatctca

SEQ ID NO: 671796 - DNA, 25 bp, Homo sapien
atattcaatctcacagccccacttt

SEQ ID NO: 671797 - DNA, 25 bp, Homo sapien
accagagccatcttcttaaaatcag

SEQ ID NO: 671798 - DNA, 25 bp, Homo sapien
ttaaaatcagatcctgtcactcctc

SEQ ID NO: 671799 - DNA, 25 bp, Homo sapien
ctaccagtggtctaataaaatcttg

SEQ ID NO: 671800 - DNA, 25 bp, Homo sapien
gaagcagtacttggatggcatctca

SEQ ID NO: 671801 - DNA, 25 bp, Homo sapien
cagtacttggatggcatctcagtga

SEQ ID NO: 671802 - DNA, 25 bp, Homo sapien
cttggatggcatctcagtgagtgac

SEQ ID NO: 671803 - DNA, 25 bp, Homo sapien
ggatggcatctcagtgagtgacgaa

SEQ ID NO: 671804 - DNA, 25 bp, Homo sapien
gcatctcagtgagtgacgaagtgct

SEQ ID NO: 671805 - DNA, 25 bp, Homo sapien
gagtgacgaagtgctgagccagctc

SEQ ID NO: 671806 - DNA, 25 bp, Homo sapien
tgagccagctcaacccactctttat

SEQ ID NO: 671807 - DNA, 25 bp, Homo sapien
agctcaacccactctttatagtcaa

SEQ ID NO: 671808 - DNA, 25 bp, Homo sapien
caacccactctttatagtcaactat

SEQ ID NO: 671809 - DNA, 25 bp, Homo sapien
tagtcaactatcaaagcaacttact

SEQ ID NO: 671810 - DNA, 25 bp, Homo sapien
aactatcaaagcaacttactccagc

SEQ ID NO: 671811 - DNA, 25 bp, Homo sapien
tccatcctcgtcaccagtgaatatt

SEQ ID NO: 671812 - DNA, 25 bp, Homo sapien
gtcaccagtgaatatttgtaccttc

SEQ ID NO: 671813 - DNA, 25 bp, Homo sapien
gaagtgctccttgattaatcctcta

SEQ ID NO: 671814 - DNA, 25 bp, Homo sapien
ccttgattaatcctctaagcactta

SEQ ID NO: 671815 - DNA, 25 bp, Homo sapien
aagcacttaaatgaaagcactttgc

SEQ ID NO: 671816 - DNA, 25 bp, Homo sapien
gcactttgcttatgcttatttcaca

SEQ ID NO: 671817 - DNA, 25 bp, Homo sapien
gcttatgcttatttcacatttgctg

SEQ ID NO: 671818 - DNA, 25 bp, Homo sapien
atttgctgccacttgcctctttgaa

SEQ ID NO: 671819 - DNA, 25 bp, Homo sapien
tgccacttgcctctttgaaatatgt

SEQ ID NO: 671820 - DNA, 25 bp, Homo sapien
aaatgtacattttctcgtaacttgc

SEQ ID NO: 671821 - DNA, 25 bp, Homo sapien
acattttctcgtaacttgctattaa

SEQ ID NO: 671822 - DNA, 25 bp, Homo sapien
gggccctgcaggaccatcagaccat

SEQ ID NO: 671823 - DNA, 25 bp, Homo sapien
caggaccatcagaccattcttccat

SEQ ID NO: 671824 - DNA, 25 bp, Homo sapien
ttccatgccctgtctgtgaagcatg

SEQ ID NO: 671825 - DNA, 25 bp, Homo sapien
tgccctgtctgtgaagcatgaggat

SEQ ID NO: 671826 - DNA, 25 bp, Homo sapien
ttcctggaggtggacgctgacaact

SEQ ID NO: 671827 - DNA, 25 bp, Homo sapien
agagagtgcgccatcatgtgtgtcc

SEQ ID NO: 671828 - DNA, 25 bp, Homo sapien
gagtgcgccatcatgtgtgtcccaa

SEQ ID NO: 671829 - DNA, 25 bp, Homo sapien
tgtgtgtcccaacctttcagtttta

SEQ ID NO: 671830 - DNA, 25 bp, Homo sapien
aggtggatgaactttgcggcgccct

SEQ ID NO: 671831 - DNA, 25 bp, Homo sapien
tgcggcgcccttaaggaaaaacttg

SEQ ID NO: 671832 - DNA, 25 bp, Homo sapien
aaacttgaagcagtcattgcagaat

SEQ ID NO: 671833 - DNA, 25 bp, Homo sapien
tatcaagcaagtatggtcctatttc

SEQ ID NO: 671834 - DNA, 25 bp, Homo sapien
gtatggtcctatttcttacaaagaa

SEQ ID NO: 671835 - DNA, 25 bp, Homo sapien
gaacaattccgaagtgaaaatccta

SEQ ID NO: 671836 - DNA, 25 bp, Homo sapien
aaatggatctgtgacaaggatttcc

SEQ ID NO: 671837 - DNA, 25 bp, Homo sapien
aaggatttccagactgtattaccat

SEQ ID NO: 671838 - DNA, 25 bp, Homo sapien
cagactgtattaccatcatttgagc

SEQ ID NO: 671839 - DNA, 25 bp, Homo sapien
accatcatttgagctcttctcaaag

SEQ ID NO: 671840 - DNA, 25 bp, Homo sapien
ttatattcaaaagctggacagattg

SEQ ID NO: 671841 - DNA, 25 bp, Homo sapien
gaaactgaagccatctgcattttaa

SEQ ID NO: 671842 - DNA, 25 bp, Homo sapien
acagatgaagatcctgtaggaaata

SEQ ID NO: 671843 - DNA, 25 bp, Homo sapien
ggaaatatacttgctatgattcaat

SEQ ID NO: 671844 - DNA, 25 bp, Homo sapien
tcatcatccaaagtgtccagccaga

SEQ ID NO: 671845 - DNA, 25 bp, Homo sapien
aaaccaaagctgagagtaagagttc

SEQ ID NO: 671846 - DNA, 25 bp, Homo sapien
gtaagagttcaaaacccacggccag

SEQ ID NO: 671847 - DNA, 25 bp, Homo sapien
aagagttcaaaacccacggccagca

SEQ ID NO: 671848 - DNA, 25 bp, Homo sapien
gagttcaaaacccacggccagcaag

SEQ ID NO: 671849 - DNA, 25 bp, Homo sapien
gttcaaaacccacggccagcaaggt

SEQ ID NO: 671850 - DNA, 25 bp, Homo sapien
gcaaggtcaagaatggtgctgcttc

SEQ ID NO: 671851 - DNA, 25 bp, Homo sapien
aggtcaagaatggtgctgcttcccc

SEQ ID NO: 671852 - DNA, 25 bp, Homo sapien
gctgcttccccgaccaaaaagaagg

SEQ ID NO: 671853 - DNA, 25 bp, Homo sapien
aggccaaggcccctaaagctgggca

SEQ ID NO: 671854 - DNA, 25 bp, Homo sapien
aaggtggtacctgcacatttgtcca

SEQ ID NO: 671855 - DNA, 25 bp, Homo sapien
aggatactgagtagcacttgcaatc

SEQ ID NO: 671856 - DNA, 25 bp, Homo sapien
gtagcacttgcaatctggactggat

SEQ ID NO: 671857 - DNA, 25 bp, Homo sapien
gcaatctggactggatggctatttt

SEQ ID NO: 671858 - DNA, 25 bp, Homo sapien
ttcatggagatggaaaggtgccaca

SEQ ID NO: 671859 - DNA, 25 bp, Homo sapien
aggtgccacaacaaaggtagtgcta

SEQ ID NO: 671860 - DNA, 25 bp, Homo sapien
ggtagtgctaaggtgaatatttctc

SEQ ID NO: 671861 - DNA, 25 bp, Homo sapien
ggtgaatatttctcctctgtgatga

SEQ ID NO: 671862 - DNA, 25 bp, Homo sapien
tctcctctgtgatgaaaaataactc

SEQ ID NO: 671863 - DNA, 25 bp, Homo sapien
aaccaaacactcagatcatcaacag

SEQ ID NO: 671864 - DNA, 25 bp, Homo sapien
aacactcagatcatcaacagcaaac

SEQ ID NO: 671865 - DNA, 25 bp, Homo sapien
gtgaatgtttttactgcacacaata

SEQ ID NO: 671866 - DNA, 25 bp, Homo sapien
ctctggcaccccctttcattggttc

SEQ ID NO: 671867 - DNA, 25 bp, Homo sapien
gggcgctctgagattaaagagtttt

SEQ ID NO: 671868 - DNA, 25 bp, Homo sapien
ggcgctctgagattaaagagtttta

SEQ ID NO: 671869 - DNA, 25 bp, Homo sapien
gcgctctgagattaaagagttttac

SEQ ID NO: 671870 - DNA, 25 bp, Homo sapien
cgctctgagattaaagagttttacc

SEQ ID NO: 671871 - DNA, 25 bp, Homo sapien
gctctgagattaaagagttttacct

SEQ ID NO: 671872 - DNA, 25 bp, Homo sapien
ctgagattaaagagttttacctctg

SEQ ID NO: 671873 - DNA, 25 bp, Homo sapien
tgagattaaagagttttacctctga

SEQ ID NO: 671874 - DNA, 25 bp, Homo sapien
gagattaaagagttttacctctgag

SEQ ID NO: 671875 - DNA, 25 bp, Homo sapien
agattaaagagttttacctctgaga

SEQ ID NO: 671876 - DNA, 25 bp, Homo sapien
gattaaagagttttacctctgagat

SEQ ID NO: 671877 - DNA, 25 bp, Homo sapien
gaaggaaacatcttccggaacctga

SEQ ID NO: 671878 - DNA, 25 bp, Homo sapien
ggaacctgacttacgcagtgcggtg

SEQ ID NO: 671879 - DNA, 25 bp, Homo sapien
tacgcagtgcggtgtatacataata

SEQ ID NO: 671880 - DNA, 25 bp, Homo sapien
gatcatcatgctcaggaacgacatt

SEQ ID NO: 671881 - DNA, 25 bp, Homo sapien
aggaacgacatttaccgctgccgag

SEQ ID NO: 671882 - DNA, 25 bp, Homo sapien
tcaggcatctttcttcgcttggagg

SEQ ID NO: 671883 - DNA, 25 bp, Homo sapien
ggtggcttgattgccggcaacaaca

SEQ ID NO: 671884 - DNA, 25 bp, Homo sapien
tgccggcaacaacatttaccacaat

SEQ ID NO: 671885 - DNA, 25 bp, Homo sapien
tttaccacaatgcagaggctggtgt

SEQ ID NO: 671886 - DNA, 25 bp, Homo sapien
gtaaccagatccaccatggccttcg

SEQ ID NO: 671887 - DNA, 25 bp, Homo sapien
cttggcaatgggaaaggcatcatcc

SEQ ID NO: 671888 - DNA, 25 bp, Homo sapien
caggccctgttgagggtctacgtca

SEQ ID NO: 671889 - DNA, 25 bp, Homo sapien
agggtctacgtcatccaggagcagg

SEQ ID NO: 671890 - DNA, 25 bp, Homo sapien
tcatccaggagcaggcgacggtcaa

SEQ ID NO: 671891 - DNA, 25 bp, Homo sapien
gagcaggcgacggtcaagctccagt

SEQ ID NO: 671892 - DNA, 25 bp, Homo sapien
atccgcatgtggcagtgccggcaat

SEQ ID NO: 671893 - DNA, 25 bp, Homo sapien
agtgccggcaatgttaccgccaaat

SEQ ID NO: 671894 - DNA, 25 bp, Homo sapien
ttaccgccaaatgtgcaatgctctc

SEQ ID NO: 671895 - DNA, 25 bp, Homo sapien
aatgtgcaatgctctctgcttgttc

SEQ ID NO: 671896 - DNA, 25 bp, Homo sapien
gcagccttgccttccagactgatgg

SEQ ID NO: 671897 - DNA, 25 bp, Homo sapien
tgctccaaaccatgggcagtaaatg

SEQ ID NO: 671898 - DNA, 25 bp, Homo sapien
cagtaaatgctgtaaaggtggtcca

SEQ ID NO: 671899 - DNA, 25 bp, Homo sapien
tgtcagctgcatggagcttcgttca

SEQ ID NO: 671900 - DNA, 25 bp, Homo sapien
gctgcatggagcttcgttcaagtat

SEQ ID NO: 671901 - DNA, 25 bp, Homo sapien
tggagcttcgttcaagtattttctg

SEQ ID NO: 671902 - DNA, 25 bp, Homo sapien
tattttctgagcctgatggatttac

SEQ ID NO: 671903 - DNA, 25 bp, Homo sapien
ctgagcctgatggatttacagtgat

SEQ ID NO: 671904 - DNA, 25 bp, Homo sapien
gaataacgctggtggaaccatgcac

SEQ ID NO: 671905 - DNA, 25 bp, Homo sapien
aacgctggtggaaccatgcactgga

SEQ ID NO: 671906 - DNA, 25 bp, Homo sapien
ggaaccatgcactggaatgacacac

SEQ ID NO: 671907 - DNA, 25 bp, Homo sapien
atgcactggaatgacacacgcccgg

SEQ ID NO: 671908 - DNA, 25 bp, Homo sapien
acacgcccggcacatttcaggatac

SEQ ID NO: 671909 - DNA, 25 bp, Homo sapien
gcccggcacatttcaggatactaaa

SEQ ID NO: 671910 - DNA, 25 bp, Homo sapien
tttttcataacgttctacagtactc

SEQ ID NO: 671911 - DNA, 25 bp, Homo sapien
aacgttctacagtactcaaaattat

SEQ ID NO: 671912 - DNA, 25 bp, Homo sapien
cttttagtgcttcttttggctgtgc

SEQ ID NO: 671913 - DNA, 25 bp, Homo sapien
tttggctgtgctgctagccctggga

SEQ ID NO: 671914 - DNA, 25 bp, Homo sapien
gtgctgctagccctgggatttctct

SEQ ID NO: 671915 - DNA, 25 bp, Homo sapien
tgctagccctgggatttctcttttt

SEQ ID NO: 671916 - DNA, 25 bp, Homo sapien
tctttttcatttgccctatctcctt

SEQ ID NO: 671917 - DNA, 25 bp, Homo sapien
ttcttccttcctagatttctcccag

SEQ ID NO: 671918 - DNA, 25 bp, Homo sapien
catcacctttaatctcccacttttt

SEQ ID NO: 671919 - DNA, 25 bp, Homo sapien
tctaattctaagacattcatgcccc

SEQ ID NO: 671920 - DNA, 25 bp, Homo sapien
taagacattcatgcccccatttttc

SEQ ID NO: 671921 - DNA, 25 bp, Homo sapien
tggcctggcggctctggtcactatg

SEQ ID NO: 671922 - DNA, 25 bp, Homo sapien
tggcggctctggtcactatgagtga

SEQ ID NO: 671923 - DNA, 25 bp, Homo sapien
gaaacatctttcaacctaatatcag

SEQ ID NO: 671924 - DNA, 25 bp, Homo sapien
tgtgacattctatccattcttcggg

SEQ ID NO: 671925 - DNA, 25 bp, Homo sapien
attctatccattcttcgggaccatc

SEQ ID NO: 671926 - DNA, 25 bp, Homo sapien
tcttcgggaccatcctgaaaacagg

SEQ ID NO: 671927 - DNA, 25 bp, Homo sapien
ggaggaaaatcgaggaactcagcaa

SEQ ID NO: 671928 - DNA, 25 bp, Homo sapien
aactcagcaaaaggttcaccgccat

SEQ ID NO: 671929 - DNA, 25 bp, Homo sapien
gcaaaaggttcaccgccatccgcaa

SEQ ID NO: 671930 - DNA, 25 bp, Homo sapien
aactgcttctacagggccttgggct

SEQ ID NO: 671931 - DNA, 25 bp, Homo sapien
gccttgggctattcctacctggagt

SEQ ID NO: 671932 - DNA, 25 bp, Homo sapien
cacagaggagaagtaaagccatttc

SEQ ID NO: 671933 - DNA, 25 bp, Homo sapien
gaggagaagtaaagccatttctgcc

SEQ ID NO: 671934 - DNA, 25 bp, Homo sapien
aggagaagtaaagccatttctgcca

SEQ ID NO: 671935 - DNA, 25 bp, Homo sapien
ggtctgtgcctgactggccacatct

SEQ ID NO: 671936 - DNA, 25 bp, Homo sapien
gtctgtgcctgactggccacatcta

SEQ ID NO: 671937 - DNA, 25 bp, Homo sapien
tctgtgcctgactggccacatctaa

SEQ ID NO: 671938 - DNA, 25 bp, Homo sapien
tgcctgactggccacatctaactct

SEQ ID NO: 671939 - DNA, 25 bp, Homo sapien
tgactggccacatctaactctctgt

SEQ ID NO: 671940 - DNA, 25 bp, Homo sapien
gactggccacatctaactctctgtt

SEQ ID NO: 671941 - DNA, 25 bp, Homo sapien
actggccacatctaactctctgttt

SEQ ID NO: 671942 - DNA, 25 bp, Homo sapien
ctggccacatctaactctctgtttc

SEQ ID NO: 671943 - DNA, 25 bp, Homo sapien
ttactccagcccttgtccatacgta

SEQ ID NO: 671944 - DNA, 25 bp, Homo sapien
tactccagcccttgtccatacgtat

SEQ ID NO: 671945 - DNA, 25 bp, Homo sapien
ctccagcccttgtccatacgtatag

SEQ ID NO: 671946 - DNA, 25 bp, Homo sapien
tccagcccttgtccatacgtatagc

SEQ ID NO: 671947 - DNA, 25 bp, Homo sapien
ccagcccttgtccatacgtatagcc

SEQ ID NO: 671948 - DNA, 25 bp, Homo sapien
agcccttgtccatacgtatagccca

SEQ ID NO: 671949 - DNA, 25 bp, Homo sapien
gcccttgtccatacgtatagcccat

SEQ ID NO: 671950 - DNA, 25 bp, Homo sapien
cccttgtccatacgtatagcccatc

SEQ ID NO: 671951 - DNA, 25 bp, Homo sapien
cttgtccatacgtatagcccatcca

SEQ ID NO: 671952 - DNA, 25 bp, Homo sapien
ttgtccatacgtatagcccatccag

SEQ ID NO: 671953 - DNA, 25 bp, Homo sapien
tgtccatacgtatagcccatccagg

SEQ ID NO: 671954 - DNA, 25 bp, Homo sapien
ggcccacaggtctcgagacgcacat

SEQ ID NO: 671955 - DNA, 25 bp, Homo sapien
agacgcacatgcacgcctgggcgtg

SEQ ID NO: 671956 - DNA, 25 bp, Homo sapien
ggcgtggcagcctcacagggaacac

SEQ ID NO: 671957 - DNA, 25 bp, Homo sapien
agcctcacagggaacacgggacaga

SEQ ID NO: 671958 - DNA, 25 bp, Homo sapien
aacacgggacagacgccggcgacgc

SEQ ID NO: 671959 - DNA, 25 bp, Homo sapien
ggcgacgcgcagacacacggacacg

SEQ ID NO: 671960 - DNA, 25 bp, Homo sapien
acactctggcgggtcccgcaaggga

SEQ ID NO: 671961 - DNA, 25 bp, Homo sapien
aacaggcggccgagctgccgaattc

SEQ ID NO: 671962 - DNA, 25 bp, Homo sapien
gccgagctgccgaattcagttgaca

SEQ ID NO: 671963 - DNA, 25 bp, Homo sapien
gaattcagttgacacgaggcacaga

SEQ ID NO: 671964 - DNA, 25 bp, Homo sapien
aacaaacttgattaaaactggtgct

SEQ ID NO: 671965 - DNA, 25 bp, Homo sapien
agcaggacgggatggaccgctacct

SEQ ID NO: 671966 - DNA, 25 bp, Homo sapien
ggaccgctacctcatctatgtggat

SEQ ID NO: 671967 - DNA, 25 bp, Homo sapien
atctatgtggatgagagccgagagt

SEQ ID NO: 671968 - DNA, 25 bp, Homo sapien
gcaggcatcgtgctgatcggcattc

SEQ ID NO: 671969 - DNA, 25 bp, Homo sapien
tgatcggcattctcctgctggtcat

SEQ ID NO: 671970 - DNA, 25 bp, Homo sapien
gctggtcatctggaaggctctgatc

SEQ ID NO: 671971 - DNA, 25 bp, Homo sapien
tccgggagtacaggcgctttgagaa

SEQ ID NO: 671972 - DNA, 25 bp, Homo sapien
gagaagctcaagtcccagtggaaca

SEQ ID NO: 671973 - DNA, 25 bp, Homo sapien
tgataatccccttttcaagagcgcc

SEQ ID NO: 671974 - DNA, 25 bp, Homo sapien
agagcgccaccacgacggtcatgaa

SEQ ID NO: 671975 - DNA, 25 bp, Homo sapien
ggtcatgaaccccaagtttgctgag

SEQ ID NO: 671976 - DNA, 25 bp, Homo sapien
aatggcatgaaaaggcacttgctgc

SEQ ID NO: 671977 - DNA, 25 bp, Homo sapien
gcatgaaaaggcacttgctgctgga

SEQ ID NO: 671978 - DNA, 25 bp, Homo sapien
tgaaaaggcacttgctgctggagga

SEQ ID NO: 671979 - DNA, 25 bp, Homo sapien
ggagtagggtccattgttcgtgtct

SEQ ID NO: 671980 - DNA, 25 bp, Homo sapien
agtagggtccattgttcgtgtcttg

SEQ ID NO: 671981 - DNA, 25 bp, Homo sapien
tagggtccattgttcgtgtcttgac

SEQ ID NO: 671982 - DNA, 25 bp, Homo sapien
agggtccattgttcgtgtcttgact

SEQ ID NO: 671983 - DNA, 25 bp, Homo sapien
ggtccattgttcgtgtcttgactgc

SEQ ID NO: 671984 - DNA, 25 bp, Homo sapien
tccattgttcgtgtcttgactgcaa

SEQ ID NO: 671985 - DNA, 25 bp, Homo sapien
cattgttcgtgtcttgactgcaaga

SEQ ID NO: 671986 - DNA, 25 bp, Homo sapien
attgttcgtgtcttgactgcaagaa

SEQ ID NO: 671987 - DNA, 25 bp, Homo sapien
cgccctcaagcacaaggtggaaccg

SEQ ID NO: 671988 - DNA, 25 bp, Homo sapien
gccctcaagcacaaggtggaaccgg

SEQ ID NO: 671989 - DNA, 25 bp, Homo sapien
tacttcaagatcctctctggggtca

SEQ ID NO: 671990 - DNA, 25 bp, Homo sapien
gaggtggtcgccgaggaatttgcca

SEQ ID NO: 671991 - DNA, 25 bp, Homo sapien
ggtggtcgccgaggaatttgccagt

SEQ ID NO: 671992 - DNA, 25 bp, Homo sapien
acttcccacctgagacgcagagagc

SEQ ID NO: 671993 - DNA, 25 bp, Homo sapien
tcccacctgagacgcagagagcctg

SEQ ID NO: 671994 - DNA, 25 bp, Homo sapien
gggccaagctgcgtggcctcatcta

SEQ ID NO: 671995 - DNA, 25 bp, Homo sapien
ggccaagctgcgtggcctcatctac

SEQ ID NO: 671996 - DNA, 25 bp, Homo sapien
ccacgtgaccgctgcctacaaggaa

SEQ ID NO: 671997 - DNA, 25 bp, Homo sapien
ctgggtgcagcaggtccccaacgcc

SEQ ID NO: 671998 - DNA, 25 bp, Homo sapien
tattctattgcatcgatatgcccta

SEQ ID NO: 671999 - DNA, 25 bp, Homo sapien
tcgatatgccctattttattcattc

SEQ ID NO: 672000 - DNA, 25 bp, Homo sapien
atttctcttaaatgtctaggagtag

SEQ ID NO: 672001 - DNA, 25 bp, Homo sapien
tctaggagtagaagacctgggtcat

SEQ ID NO: 672002 - DNA, 25 bp, Homo sapien
aagacctgggtcatataattgtgtg

SEQ ID NO: 672003 - DNA, 25 bp, Homo sapien
gtttaatcacttgaggcactgccag

SEQ ID NO: 672004 - DNA, 25 bp, Homo sapien
gaggcactgccaggttgttttctaa

SEQ ID NO: 672005 - DNA, 25 bp, Homo sapien
gcactgccaggttgttttctaaagc

SEQ ID NO: 672006 - DNA, 25 bp, Homo sapien
agcagcccactttacatttccatag

SEQ ID NO: 672007 - DNA, 25 bp, Homo sapien
gcccactttacatttccatagtcag

SEQ ID NO: 672008 - DNA, 25 bp, Homo sapien
gtcagtatatgaggattctagtttc

SEQ ID NO: 672009 - DNA, 25 bp, Homo sapien
ctcatcaagtggttccctgaggtca

SEQ ID NO: 672010 - DNA, 25 bp, Homo sapien
ttccctgaggtcacgcatttctgcc

SEQ ID NO: 672011 - DNA, 25 bp, Homo sapien
ctgaggtcacgcatttctgccgcgg

SEQ ID NO: 672012 - DNA, 25 bp, Homo sapien
tgaggtcacgcatttctgccgcggg

SEQ ID NO: 672013 - DNA, 25 bp, Homo sapien
gaggtcacgcatttctgccgcggga

SEQ ID NO: 672014 - DNA, 25 bp, Homo sapien
aggtcacgcatttctgccgcgggat

SEQ ID NO: 672015 - DNA, 25 bp, Homo sapien
ggtcacgcatttctgccgcgggatc

SEQ ID NO: 672016 - DNA, 25 bp, Homo sapien
gtcacgcatttctgccgcgggatcc

SEQ ID NO: 672017 - DNA, 25 bp, Homo sapien
gcgggatccccatggtgctcatcgg

SEQ ID NO: 672018 - DNA, 25 bp, Homo sapien
ggtgctcatcggctgcaagacagac

SEQ ID NO: 672019 - DNA, 25 bp, Homo sapien
tgcaagacagacctgaggaaggaca

SEQ ID NO: 672020 - DNA, 25 bp, Homo sapien
tatgcggagccgctgaagggcgtcc

SEQ ID NO: 672021 - DNA, 25 bp, Homo sapien
agggcgtcccgccagagaagttcaa

SEQ ID NO: 672022 - DNA, 25 bp, Homo sapien
gtcccgccagagaagttcaaccaca

SEQ ID NO: 672023 - DNA, 25 bp, Homo sapien
agagaagttcaaccacaccgccatc

SEQ ID NO: 672024 - DNA, 25 bp, Homo sapien
agggctaccgctgcccttggcagga

SEQ ID NO: 672025 - DNA, 25 bp, Homo sapien
gcccttggcaggagttcgtcagcta

SEQ ID NO: 672026 - DNA, 25 bp, Homo sapien
aggagttcgtcagctaccgggacta

SEQ ID NO: 672027 - DNA, 25 bp, Homo sapien
gttcgtcagctaccgggactaccag

SEQ ID NO: 672028 - DNA, 25 bp, Homo sapien
agctaccgggactaccagagcgatg

SEQ ID NO: 672029 - DNA, 25 bp, Homo sapien
taccgggactaccagagcgatggcc

SEQ ID NO: 672030 - DNA, 25 bp, Homo sapien
taccagagcgatggccgaagtcaca

SEQ ID NO: 672031 - DNA, 25 bp, Homo sapien
ctgtgtggcctccagaagttaaaat

SEQ ID NO: 672032 - DNA, 25 bp, Homo sapien
tgtggcctccagaagttaaaatcct

SEQ ID NO: 672033 - DNA, 25 bp, Homo sapien
ggcctccagaagttaaaatcctgtt

SEQ ID NO: 672034 - DNA, 25 bp, Homo sapien
ctgttaggggttattctgcacgaat

SEQ ID NO: 672035 - DNA, 25 bp, Homo sapien
cacagagcagcttgacaatagggtt

SEQ ID NO: 672036 - DNA, 25 bp, Homo sapien
gcagcttgacaatagggttggaatt

SEQ ID NO: 672037 - DNA, 25 bp, Homo sapien
ttggaattagacaccaggccttcta

SEQ ID NO: 672038 - DNA, 25 bp, Homo sapien
gaattagacaccaggccttctaggg

SEQ ID NO: 672039 - DNA, 25 bp, Homo sapien
tctaggggccctgaagagcctgaaa

SEQ ID NO: 672040 - DNA, 25 bp, Homo sapien
aaaccttgacctaggaatctcatat

SEQ ID NO: 672041 - DNA, 25 bp, Homo sapien
aaccttgacctaggaatctcatatt

SEQ ID NO: 672042 - DNA, 25 bp, Homo sapien
actgtggattgagccggtgaagccc

SEQ ID NO: 672043 - DNA, 25 bp, Homo sapien
tggattgagccggtgaagccctgag

SEQ ID NO: 672044 - DNA, 25 bp, Homo sapien
ccggtgaagccctgagggatttcat

SEQ ID NO: 672045 - DNA, 25 bp, Homo sapien
gaagccctgagggatttcatcgctg

SEQ ID NO: 672046 - DNA, 25 bp, Homo sapien
aagccctgagggatttcatcgctga

SEQ ID NO: 672047 - DNA, 25 bp, Homo sapien
agccctgagggatttcatcgctgag

SEQ ID NO: 672048 - DNA, 25 bp, Homo sapien
gccctgagggatttcatcgctgagg

SEQ ID NO: 672049 - DNA, 25 bp, Homo sapien
ccctgagggatttcatcgctgaggt

SEQ ID NO: 672050 - DNA, 25 bp, Homo sapien
atttcatcgctgaggtggatggaga

SEQ ID NO: 672051 - DNA, 25 bp, Homo sapien
ggccttggctgtaaggacccctaag

SEQ ID NO: 672052 - DNA, 25 bp, Homo sapien
gccttggctgtaaggacccctaagg

SEQ ID NO: 672053 - DNA, 25 bp, Homo sapien
ggagtacagtggcctacacctgtaa

SEQ ID NO: 672054 - DNA, 25 bp, Homo sapien
aaaatcagcagcgtgtagtggatac

SEQ ID NO: 672055 - DNA, 25 bp, Homo sapien
aaatcagcagcgtgtagtggataca

SEQ ID NO: 672056 - DNA, 25 bp, Homo sapien
aatcagcagcgtgtagtggatacat

SEQ ID NO: 672057 - DNA, 25 bp, Homo sapien
atcagcagcgtgtagtggatacatg

SEQ ID NO: 672058 - DNA, 25 bp, Homo sapien
tcagcagcgtgtagtggatacatgc

SEQ ID NO: 672059 - DNA, 25 bp, Homo sapien
cagcagcgtgtagtggatacatgcc

SEQ ID NO: 672060 - DNA, 25 bp, Homo sapien
agcagcgtgtagtggatacatgcct

SEQ ID NO: 672061 - DNA, 25 bp, Homo sapien
gcagcgtgtagtggatacatgcctg

SEQ ID NO: 672062 - DNA, 25 bp, Homo sapien
cagcgtgtagtggatacatgcctgt

SEQ ID NO: 672063 - DNA, 25 bp, Homo sapien
agcgtgtagtggatacatgcctgta

SEQ ID NO: 672064 - DNA, 25 bp, Homo sapien
cacctgatttaacaacatctcatta

SEQ ID NO: 672065 - DNA, 25 bp, Homo sapien
taacaacatctcattatctcaggca

SEQ ID NO: 672066 - DNA, 25 bp, Homo sapien
aacatctcattatctcaggcaccaa

SEQ ID NO: 672067 - DNA, 25 bp, Homo sapien
catctcattatctcaggcaccaatt

SEQ ID NO: 672068 - DNA, 25 bp, Homo sapien
tctcattatctcaggcaccaatttg

SEQ ID NO: 672069 - DNA, 25 bp, Homo sapien
ctcattatctcaggcaccaatttga

SEQ ID NO: 672070 - DNA, 25 bp, Homo sapien
aactgagacaatgaacttccgcagg

SEQ ID NO: 672071 - DNA, 25 bp, Homo sapien
ctgagacaatgaacttccgcaggac

SEQ ID NO: 672072 - DNA, 25 bp, Homo sapien
aatgaacttccgcaggacccaaagc

SEQ ID NO: 672073 - DNA, 25 bp, Homo sapien
atgaacttccgcaggacccaaagca

SEQ ID NO: 672074 - DNA, 25 bp, Homo sapien
gtcaatccataaacacacttaagta

SEQ ID NO: 672075 - DNA, 25 bp, Homo sapien
gggctattcccaacattatctttat

SEQ ID NO: 672076 - DNA, 25 bp, Homo sapien
tcccaacattatctttatcttgtag

SEQ ID NO: 672077 - DNA, 25 bp, Homo sapien
gacataaataacaaacaactccggt

SEQ ID NO: 672078 - DNA, 25 bp, Homo sapien
gtaatagattttggcagagtttatg

SEQ ID NO: 672079 - DNA, 25 bp, Homo sapien
cagagtttatgtattgtatgcaatg

SEQ ID NO: 672080 - DNA, 25 bp, Homo sapien
gtatgcaatgctaacataacgctga

SEQ ID NO: 672081 - DNA, 25 bp, Homo sapien
aatgctaacataacgctgagtttca

SEQ ID NO: 672082 - DNA, 25 bp, Homo sapien
aacataacgctgagtttcaaggata

SEQ ID NO: 672083 - DNA, 25 bp, Homo sapien
gtttcaaggatagaggccaggattc

SEQ ID NO: 672084 - DNA, 25 bp, Homo sapien
tagaggccaggattcctagtttggc

SEQ ID NO: 672085 - DNA, 25 bp, Homo sapien
tcctagtttggctttgttaaatggg

SEQ ID NO: 672086 - DNA, 25 bp, Homo sapien
aaatttctgggcatgcacattaaga

SEQ ID NO: 672087 - DNA, 25 bp, Homo sapien
ggctgagtatgatcttccaggcaca

SEQ ID NO: 672088 - DNA, 25 bp, Homo sapien
aaaagcctcagatgggcatgtgtac

SEQ ID NO: 672089 - DNA, 25 bp, Homo sapien
gtacaacttcctaaacacactgcat

SEQ ID NO: 672090 - DNA, 25 bp, Homo sapien
gcatgtggtcattttccaagcataa

SEQ ID NO: 672091 - DNA, 25 bp, Homo sapien
gggtactgtgcatgcaggcagccca

SEQ ID NO: 672092 - DNA, 25 bp, Homo sapien
gcctataaagtcctaggatccaggt

SEQ ID NO: 672093 - DNA, 25 bp, Homo sapien
ggatccaggttaaagaccacacttg

SEQ ID NO: 672094 - DNA, 25 bp, Homo sapien
gaccacacttgttcttcaagtcaca

SEQ ID NO: 672095 - DNA, 25 bp, Homo sapien
aagtcacatgcttgggtctcttcca

SEQ ID NO: 672096 - DNA, 25 bp, Homo sapien
tcttccaagcacactttcttttctg

SEQ ID NO: 672097 - DNA, 25 bp, Homo sapien
tgtacaaaatcaaccttgcatggtg

SEQ ID NO: 672098 - DNA, 25 bp, Homo sapien
atcaaccttgcatggtgattggcac

SEQ ID NO: 672099 - DNA, 25 bp, Homo sapien
tcaaccttgcatggtgattggcacc

SEQ ID NO: 672100 - DNA, 25 bp, Homo sapien
aaccttgcatggtgattggcacctg

SEQ ID NO: 672101 - DNA, 25 bp, Homo sapien
ccttgcatggtgattggcacctgta

SEQ ID NO: 672102 - DNA, 25 bp, Homo sapien
tgtagtcccatctaattcagaaggt

SEQ ID NO: 672103 - DNA, 25 bp, Homo sapien
tagtcccatctaattcagaaggtga

SEQ ID NO: 672104 - DNA, 25 bp, Homo sapien
gtcccatctaattcagaaggtgatc

SEQ ID NO: 672105 - DNA, 25 bp, Homo sapien
catctaattcagaaggtgatctgga

SEQ ID NO: 672106 - DNA, 25 bp, Homo sapien
cctgctgtcttctgactggggattt

SEQ ID NO: 672107 - DNA, 25 bp, Homo sapien
gggatttacggaatgcaggaaaatg

SEQ ID NO: 672108 - DNA, 25 bp, Homo sapien
gtactgtatgtatctggttatcaag

SEQ ID NO: 672109 - DNA, 25 bp, Homo sapien
tgtgcagaaagtatgcctcccgtgg

SEQ ID NO: 672110 - DNA, 25 bp, Homo sapien
gtatgcctcccgtgggtatacgttt

SEQ ID NO: 672111 - DNA, 25 bp, Homo sapien
tcccctttttggaaacttactgcag

SEQ ID NO: 672112 - DNA, 25 bp, Homo sapien
acttactgcaggttttgtgccttga

SEQ ID NO: 672113 - DNA, 25 bp, Homo sapien
aggttttgtgccttgacaacctctc

SEQ ID NO: 672114 - DNA, 25 bp, Homo sapien
gacaacctctccctatgtgaggttt

SEQ ID NO: 672115 - DNA, 25 bp, Homo sapien
ggtttgtaaaaagtgtcctgtgact

SEQ ID NO: 672116 - DNA, 25 bp, Homo sapien
gtgacttaacacagaaacgcaataa

SEQ ID NO: 672117 - DNA, 25 bp, Homo sapien
gtttcatgagtgattcttcagatgc

SEQ ID NO: 672118 - DNA, 25 bp, Homo sapien
agatgcccttcccaactggttagtt

SEQ ID NO: 672119 - DNA, 25 bp, Homo sapien
taaaaacacaaaagaattagctggg

SEQ ID NO: 672120 - DNA, 25 bp, Homo sapien
gaacccgggaggtgagtcaagattg

SEQ ID NO: 672121 - DNA, 25 bp, Homo sapien
aacccgggaggtgagtcaagattgc

SEQ ID NO: 672122 - DNA, 25 bp, Homo sapien
acccgggaggtgagtcaagattgcg

SEQ ID NO: 672123 - DNA, 25 bp, Homo sapien
ccgggaggtgagtcaagattgcgcc

SEQ ID NO: 672124 - DNA, 25 bp, Homo sapien
cgggaggtgagtcaagattgcgcca

SEQ ID NO: 672125 - DNA, 25 bp, Homo sapien
gggaggtgagtcaagattgcgccac

SEQ ID NO: 672126 - DNA, 25 bp, Homo sapien
ggcaacaagagtgtgaaaactccat

SEQ ID NO: 672127 - DNA, 25 bp, Homo sapien
gaacggccataagcggatgctccta

SEQ ID NO: 672128 - DNA, 25 bp, Homo sapien
agcggatgctcctaatgacaaccct

SEQ ID NO: 672129 - DNA, 25 bp, Homo sapien
ggatgctcctaatgacaaccctgct

SEQ ID NO: 672130 - DNA, 25 bp, Homo sapien
taatgacaaccctgctgcgtgccac

SEQ ID NO: 672131 - DNA, 25 bp, Homo sapien
caggggaattggcttcatagtacag

SEQ ID NO: 672132 - DNA, 25 bp, Homo sapien
ggcccagagagggtagctaccttgc

SEQ ID NO: 672133 - DNA, 25 bp, Homo sapien
agagagggtagctaccttgcctgag

SEQ ID NO: 672134 - DNA, 25 bp, Homo sapien
tggacttgaacccagctctgtttga

SEQ ID NO: 672135 - DNA, 25 bp, Homo sapien
aacccagctctgtttgattccaaaa

SEQ ID NO: 672136 - DNA, 25 bp, Homo sapien
tttgattccaaaatccaaggaagcc

SEQ ID NO: 672137 - DNA, 25 bp, Homo sapien
caaggaagcctatgggaatattaaa

SEQ ID NO: 672138 - DNA, 25 bp, Homo sapien
aataaggtatttcctatccttccat

SEQ ID NO: 672139 - DNA, 25 bp, Homo sapien
ggtatttcctatccttccataaaat

SEQ ID NO: 672140 - DNA, 25 bp, Homo sapien
gtgatagatacttgctgttttatta

SEQ ID NO: 672141 - DNA, 25 bp, Homo sapien
tattattctgtctgatattccgtag

SEQ ID NO: 672142 - DNA, 25 bp, Homo sapien
gtctgatattccgtagatagccaat

SEQ ID NO: 672143 - DNA, 25 bp, Homo sapien
tattccgtagatagccaataacatt

SEQ ID NO: 672144 - DNA, 25 bp, Homo sapien
acatttacatttattcaatctgaag

SEQ ID NO: 672145 - DNA, 25 bp, Homo sapien
attcaatctgaagttactgcacata

SEQ ID NO: 672146 - DNA, 25 bp, Homo sapien
tgaagttactgcacatatactatgt

SEQ ID NO: 672147 - DNA, 25 bp, Homo sapien
acatatactatgtgtcaggtatttt

SEQ ID NO: 672148 - DNA, 25 bp, Homo sapien
agatttggctaggtgctttcaaaga

SEQ ID NO: 672149 - DNA, 25 bp, Homo sapien
gagaatatgctccaccgtacttaat

SEQ ID NO: 672150 - DNA, 25 bp, Homo sapien
agaatatgctccaccgtacttaatc

SEQ ID NO: 672151 - DNA, 25 bp, Homo sapien
gaatatgctccaccgtacttaatcc

SEQ ID NO: 672152 - DNA, 25 bp, Homo sapien
atatgctccaccgtacttaatcctt

SEQ ID NO: 672153 - DNA, 25 bp, Homo sapien
atgctccaccgtacttaatcctttt

SEQ ID NO: 672154 - DNA, 25 bp, Homo sapien
gctccaccgtacttaatccttttct

SEQ ID NO: 672155 - DNA, 25 bp, Homo sapien
ttaatccttttctctcccagaaaga

SEQ ID NO: 672156 - DNA, 25 bp, Homo sapien
aatccttttctctcccagaaagaag

SEQ ID NO: 672157 - DNA, 25 bp, Homo sapien
atccttttctctcccagaaagaagg

SEQ ID NO: 672158 - DNA, 25 bp, Homo sapien
aagatacaaaagtgagccgagtgtt

SEQ ID NO: 672159 - DNA, 25 bp, Homo sapien
atacaaaagtgagccgagtgttgtg

SEQ ID NO: 672160 - DNA, 25 bp, Homo sapien
actgttggctgctctcccaagtggc

SEQ ID NO: 672161 - DNA, 25 bp, Homo sapien
ccagtcagcactttgtgagtgcttg

SEQ ID NO: 672162 - DNA, 25 bp, Homo sapien
ctttgtgagtgcttgttcagtgagt

SEQ ID NO: 672163 - DNA, 25 bp, Homo sapien
ttcagtgagtaagcagggacaggct

SEQ ID NO: 672164 - DNA, 25 bp, Homo sapien
ggaccacgggagaggaacccgcatt

SEQ ID NO: 672165 - DNA, 25 bp, Homo sapien
gagggctccctatggtgagccacgc

SEQ ID NO: 672166 - DNA, 25 bp, Homo sapien
tccctatggtgagccacgcctgtgg

SEQ ID NO: 672167 - DNA, 25 bp, Homo sapien
tgtgggttcaccacctcctaggagg

SEQ ID NO: 672168 - DNA, 25 bp, Homo sapien
cctcctaggagggtccagaaaagca

SEQ ID NO: 672169 - DNA, 25 bp, Homo sapien
agcagatccaccttcttcactataa

SEQ ID NO: 672170 - DNA, 25 bp, Homo sapien
gatccaccttcttcactataataaa

SEQ ID NO: 672171 - DNA, 25 bp, Homo sapien
ccccgggagagcactcagaggcacg

SEQ ID NO: 672172 - DNA, 25 bp, Homo sapien
ggagacgacgcaggcaccgcagcta

SEQ ID NO: 672173 - DNA, 25 bp, Homo sapien
agttcctggagctctgaagaggaca

SEQ ID NO: 672174 - DNA, 25 bp, Homo sapien
aagaggacaaggagaggcagcccca

SEQ ID NO: 672175 - DNA, 25 bp, Homo sapien
aggagaagccgcctagctaccgctc

SEQ ID NO: 672176 - DNA, 25 bp, Homo sapien
tagctaccgctcactggatatcact

SEQ ID NO: 672177 - DNA, 25 bp, Homo sapien
gctcactggatatcactccaggcaa

SEQ ID NO: 672178 - DNA, 25 bp, Homo sapien
ggatatcactccaggcaagaatagc

SEQ ID NO: 672179 - DNA, 25 bp, Homo sapien
tatcactccaggcaagaatagcagg

SEQ ID NO: 672180 - DNA, 25 bp, Homo sapien
gaggcgctcggagaaagacagctct

SEQ ID NO: 672181 - DNA, 25 bp, Homo sapien
aaagacagctctcatagtggaagga

SEQ ID NO: 672182 - DNA, 25 bp, Homo sapien
ttgaggtcttggtgagtgttttagt

SEQ ID NO: 672183 - DNA, 25 bp, Homo sapien
tggtggttgtggtaaactttaatag

SEQ ID NO: 672184 - DNA, 25 bp, Homo sapien
aaactttaatagtgtaggaagctga

SEQ ID NO: 672185 - DNA, 25 bp, Homo sapien
gtgtaggaagctgaataatttatga

SEQ ID NO: 672186 - DNA, 25 bp, Homo sapien
gttgattcgggaggatcctattggt

SEQ ID NO: 672187 - DNA, 25 bp, Homo sapien
tgattcgggaggatcctattggtgc

SEQ ID NO: 672188 - DNA, 25 bp, Homo sapien
gctttgtatgattatgggcgttgat

SEQ ID NO: 672189 - DNA, 25 bp, Homo sapien
atgggcgttgattagtagtagttac

SEQ ID NO: 672190 - DNA, 25 bp, Homo sapien
gtagtagttactggttgaacattgt

SEQ ID NO: 672191 - DNA, 25 bp, Homo sapien
ctggttgaacattgtttgttggtgt

SEQ ID NO: 672192 - DNA, 25 bp, Homo sapien
atatattgtaattgagattgctcgg

SEQ ID NO: 672193 - DNA, 25 bp, Homo sapien
aaatctgctgcatattcttctgaac

SEQ ID NO: 672194 - DNA, 25 bp, Homo sapien
gtcaatatatctcaaccttacctaa

SEQ ID NO: 672195 - DNA, 25 bp, Homo sapien
caaccttacctaatgtgagatttta

SEQ ID NO: 672196 - DNA, 25 bp, Homo sapien
ataacattttatagctccttctcct

SEQ ID NO: 672197 - DNA, 25 bp, Homo sapien
ttatagctccttctcctacattatt

SEQ ID NO: 672198 - DNA, 25 bp, Homo sapien
gctccttctcctacattatttgtaa

SEQ ID NO: 672199 - DNA, 25 bp, Homo sapien
atttgtaaatctcacttaaactgct

SEQ ID NO: 672200 - DNA, 25 bp, Homo sapien
cttaaactgctatcttatttttctt

SEQ ID NO: 672201 - DNA, 25 bp, Homo sapien
atttttcttttcgtagtatgcatcc

SEQ ID NO: 672202 - DNA, 25 bp, Homo sapien
gtagtatgcatcctatgtttccaaa

SEQ ID NO: 672203 - DNA, 25 bp, Homo sapien
gcatcctatgtttccaaaaatatca

SEQ ID NO: 672204 - DNA, 25 bp, Homo sapien
aaggccaacttcaagatccgccaca

SEQ ID NO: 672205 - DNA, 25 bp, Homo sapien
ttcaagatccgccacaacatcgagg

SEQ ID NO: 672206 - DNA, 25 bp, Homo sapien
acaacatcgaggacggcagcgtgca

SEQ ID NO: 672207 - DNA, 25 bp, Homo sapien
gacaaccactacttgagcacccagt

SEQ ID NO: 672208 - DNA, 25 bp, Homo sapien
aaagaccccaacgagaagcgcgatc

SEQ ID NO: 672209 - DNA, 25 bp, Homo sapien
acgagaagcgcgatcacatggtcct

SEQ ID NO: 672210 - DNA, 25 bp, Homo sapien
aagcgcgatcacatggtcctgctgg

SEQ ID NO: 672211 - DNA, 25 bp, Homo sapien
ccgggatcactctcggcatggacga

SEQ ID NO: 672212 - DNA, 25 bp, Homo sapien
atcactctcggcatggacgagctgg

SEQ ID NO: 672213 - DNA, 25 bp, Homo sapien
gagctgggccgctctagaaagatga

SEQ ID NO: 672214 - DNA, 25 bp, Homo sapien
gggccgctctagaaagatgagcaaa

SEQ ID NO: 672215 - DNA, 25 bp, Homo sapien
atttttgtgaagcacagtgagtgac

SEQ ID NO: 672216 - DNA, 25 bp, Homo sapien
gtgacaatcatttttcttaaggcct

SEQ ID NO: 672217 - DNA, 25 bp, Homo sapien
gacaatcatttttcttaaggcctgg

SEQ ID NO: 672218 - DNA, 25 bp, Homo sapien
caatcatttttcttaaggcctggaa

SEQ ID NO: 672219 - DNA, 25 bp, Homo sapien
tcttaaggcctggaaacgattttct

SEQ ID NO: 672220 - DNA, 25 bp, Homo sapien
aaggcctggaaacgattttctgtat

SEQ ID NO: 672221 - DNA, 25 bp, Homo sapien
gcctggaaacgattttctgtatgat

SEQ ID NO: 672222 - DNA, 25 bp, Homo sapien
cgattttctgtatgatgttacttta

SEQ ID NO: 672223 - DNA, 25 bp, Homo sapien
gttactttatgtgaattctcatctc

SEQ ID NO: 672224 - DNA, 25 bp, Homo sapien
gtgaattctcatctcaataaatgat

SEQ ID NO: 672225 - DNA, 25 bp, Homo sapien
tcatctcaataaatgatgacccgca

SEQ ID NO: 672226 - DNA, 25 bp, Homo sapien
gctgtggcaggcgaaatcgcttgaa

SEQ ID NO: 672227 - DNA, 25 bp, Homo sapien
ctgtggcaggcgaaatcgcttgaac

SEQ ID NO: 672228 - DNA, 25 bp, Homo sapien
tgtggcaggcgaaatcgcttgaacc

SEQ ID NO: 672229 - DNA, 25 bp, Homo sapien
gtggcaggcgaaatcgcttgaaccc

SEQ ID NO: 672230 - DNA, 25 bp, Homo sapien
cttgaacccaggaggaggaggtgga

SEQ ID NO: 672231 - DNA, 25 bp, Homo sapien
ttgaacccaggaggaggaggtggag

SEQ ID NO: 672232 - DNA, 25 bp, Homo sapien
tgaacccaggaggaggaggtggagg

SEQ ID NO: 672233 - DNA, 25 bp, Homo sapien
gcgacagagactccatctggggaaa

SEQ ID NO: 672234 - DNA, 25 bp, Homo sapien
cgacagagactccatctggggaaaa

SEQ ID NO: 672235 - DNA, 25 bp, Homo sapien
gacagagactccatctggggaaaaa

SEQ ID NO: 672236 - DNA, 25 bp, Homo sapien
acagagactccatctggggaaaaaa

SEQ ID NO: 672237 - DNA, 25 bp, Homo sapien
cctcctcctggagcatttccccacc

SEQ ID NO: 672238 - DNA, 25 bp, Homo sapien
tggagggcggtagctcccaccacgc

SEQ ID NO: 672239 - DNA, 25 bp, Homo sapien
ggagggcggtagctcccaccacgca

SEQ ID NO: 672240 - DNA, 25 bp, Homo sapien
gagggcggtagctcccaccacgcac

SEQ ID NO: 672241 - DNA, 25 bp, Homo sapien
agggcggtagctcccaccacgcaca

SEQ ID NO: 672242 - DNA, 25 bp, Homo sapien
ggcggtagctcccaccacgcacacc

SEQ ID NO: 672243 - DNA, 25 bp, Homo sapien
gtagctcccaccacgcacaccctta

SEQ ID NO: 672244 - DNA, 25 bp, Homo sapien
accacgcacacccttacgccatgtc

SEQ ID NO: 672245 - DNA, 25 bp, Homo sapien
acgcacacccttacgccatgtctcc

SEQ ID NO: 672246 - DNA, 25 bp, Homo sapien
acacccttacgccatgtctccctcc

SEQ ID NO: 672247 - DNA, 25 bp, Homo sapien
gtctctgaggccctacccaccaggg

SEQ ID NO: 672248 - DNA, 25 bp, Homo sapien
ccagcatggcgataccctacttcta

SEQ ID NO: 672249 - DNA, 25 bp, Homo sapien
cagcatggcgataccctacttctac

SEQ ID NO: 672250 - DNA, 25 bp, Homo sapien
agcatggcgataccctacttctact

SEQ ID NO: 672251 - DNA, 25 bp, Homo sapien
catggcgataccctacttctactga

SEQ ID NO: 672252 - DNA, 25 bp, Homo sapien
atggcgataccctacttctactgaa

SEQ ID NO: 672253 - DNA, 25 bp, Homo sapien
tggcgataccctacttctactgaac

SEQ ID NO: 672254 - DNA, 25 bp, Homo sapien
ggcgataccctacttctactgaaca

SEQ ID NO: 672255 - DNA, 25 bp, Homo sapien
gcgataccctacttctactgaacat

SEQ ID NO: 672256 - DNA, 25 bp, Homo sapien
cgataccctacttctactgaacata

SEQ ID NO: 672257 - DNA, 25 bp, Homo sapien
gataccctacttctactgaacatac

SEQ ID NO: 672258 - DNA, 25 bp, Homo sapien
ataccctacttctactgaacataca

SEQ ID NO: 672259 - DNA, 25 bp, Homo sapien
catgtcttccatgtgaaaggttctt

SEQ ID NO: 672260 - DNA, 25 bp, Homo sapien
gtcttccatgtgaaaggttctttgc

SEQ ID NO: 672261 - DNA, 25 bp, Homo sapien
aaggttctttgcaagaggaaagcct

SEQ ID NO: 672262 - DNA, 25 bp, Homo sapien
ttgcaagaggaaagccttagggaca

SEQ ID NO: 672263 - DNA, 25 bp, Homo sapien
gattcccgaagaggacaggcgcaaa

SEQ ID NO: 672264 - DNA, 25 bp, Homo sapien
ggcgcaaaatgcaagacaagtgtcg

SEQ ID NO: 672265 - DNA, 25 bp, Homo sapien
gacaagtgtcgggaagtccttgcct

SEQ ID NO: 672266 - DNA, 25 bp, Homo sapien
agtgtcgggaagtccttgcctggct

SEQ ID NO: 672267 - DNA, 25 bp, Homo sapien
cagagaaggaggagtatgagcatca

SEQ ID NO: 672268 - DNA, 25 bp, Homo sapien
ggagctggagcaaatctgtcgcccc

SEQ ID NO: 672269 - DNA, 25 bp, Homo sapien
tggagcaaatctgtcgccccatctt

SEQ ID NO: 672270 - DNA, 25 bp, Homo sapien
ggcaactggaacaggccttgtcagc

SEQ ID NO: 672271 - DNA, 25 bp, Homo sapien
ggccttgtcagccagaacactgaga

SEQ ID NO: 672272 - DNA, 25 bp, Homo sapien
gaaagtggagccactcactccagaa

SEQ ID NO: 672273 - DNA, 25 bp, Homo sapien
atagaggtgttcatccccagatttt

SEQ ID NO: 672274 - DNA, 25 bp, Homo sapien
atttctgcctcctacaatctggaaa

SEQ ID NO: 672275 - DNA, 25 bp, Homo sapien
aatctggaaaccatcctcccgaaga

SEQ ID NO: 672276 - DNA, 25 bp, Homo sapien
atcctcccgaagatgggcatccaaa

SEQ ID NO: 672277 - DNA, 25 bp, Homo sapien
gcaaagagagactccctgcaggttt

SEQ ID NO: 672278 - DNA, 25 bp, Homo sapien
gactccctgcaggtttctaaagtga

SEQ ID NO: 672279 - DNA, 25 bp, Homo sapien
gaagcacctgcagaattaatcacat

SEQ ID NO: 672280 - DNA, 25 bp, Homo sapien
ttaatcacatgctcttatttcgttg

SEQ ID NO: 672281 - DNA, 25 bp, Homo sapien
gaagcctttgagatctctagcctga

SEQ ID NO: 672282 - DNA, 25 bp, Homo sapien
ttgagatctctagcctgacttttct

SEQ ID NO: 672283 - DNA, 25 bp, Homo sapien
tctctcagtttgaagcaaatcgcct

SEQ ID NO: 672284 - DNA, 25 bp, Homo sapien
agtttgaagcaaatcgcctttcaga

SEQ ID NO: 672285 - DNA, 25 bp, Homo sapien
tccagggactctggcagtgctacaa

SEQ ID NO: 672286 - DNA, 25 bp, Homo sapien
ctctggcagtgctacaaactctagt

SEQ ID NO: 672287 - DNA, 25 bp, Homo sapien
gtgctacaaactctagtgtgctttt

SEQ ID NO: 672288 - DNA, 25 bp, Homo sapien
aactctagtgtgcttttacaaaaga

SEQ ID NO: 672289 - DNA, 25 bp, Homo sapien
tggtcacacagcaggtggtggccca

SEQ ID NO: 672290 - DNA, 25 bp, Homo sapien
cacagcaggtggtggcccaaacaga

SEQ ID NO: 672291 - DNA, 25 bp, Homo sapien
gcccaaacagagaacaggacccaga

SEQ ID NO: 672292 - DNA, 25 bp, Homo sapien
tatactcgcattgctgctgctatcc

SEQ ID NO: 672293 - DNA, 25 bp, Homo sapien
tatcctcaagatcccatcagctaaa

SEQ ID NO: 672294 - DNA, 25 bp, Homo sapien
agcataaagccttctctacgtgctc

SEQ ID NO: 672295 - DNA, 25 bp, Homo sapien
ttctatatatcttctagcctcacct

SEQ ID NO: 672296 - DNA, 25 bp, Homo sapien
tcacctacttctggcctaaatcaaa

SEQ ID NO: 672297 - DNA, 25 bp, Homo sapien
tctcctgagagcaagaagttgttat

SEQ ID NO: 672298 - DNA, 25 bp, Homo sapien
gttatcattatcctacactgttgtg

SEQ ID NO: 672299 - DNA, 25 bp, Homo sapien
ctacactgttgtgactcccatgttg

SEQ ID NO: 672300 - DNA, 25 bp, Homo sapien
gaagaatgccctcagcaggaccttc

SEQ ID NO: 672301 - DNA, 25 bp, Homo sapien
aaggtcctagccctcagaaactgta

SEQ ID NO: 672302 - DNA, 25 bp, Homo sapien
agccctcagaaactgtatcccatag

SEQ ID NO: 672303 - DNA, 25 bp, Homo sapien
gatcagcaagccgagcaagtgcgag

SEQ ID NO: 672304 - DNA, 25 bp, Homo sapien
gcaagtgcgagagcagcacgctgaa

SEQ ID NO: 672305 - DNA, 25 bp, Homo sapien
gcacgctgaagctgaggtcatggct

SEQ ID NO: 672306 - DNA, 25 bp, Homo sapien
ctgaagctgaggtcatggctgtagt

SEQ ID NO: 672307 - DNA, 25 bp, Homo sapien
gagcgcggaggatgaacagcctcac

SEQ ID NO: 672308 - DNA, 25 bp, Homo sapien
aggcctgccccttcgtggaggagcc

SEQ ID NO: 672309 - DNA, 25 bp, Homo sapien
tggaggagcctgaccaagcccagga

SEQ ID NO: 672310 - DNA, 25 bp, Homo sapien
ccaggaacagcagactccgttggaa

SEQ ID NO: 672311 - DNA, 25 bp, Homo sapien
gcagactccgttggaagaagaggcc

SEQ ID NO: 672312 - DNA, 25 bp, Homo sapien
ccagggcctgatggttggagaaatc

SEQ ID NO: 672313 - DNA, 25 bp, Homo sapien
tggttggagaaatcgaaggcctgta

SEQ ID NO: 672314 - DNA, 25 bp, Homo sapien
gctgtagtgggcatctctgccaggt

SEQ ID NO: 672315 - DNA, 25 bp, Homo sapien
ctctgccaggtgttctttttgagaa

SEQ ID NO: 672316 - DNA, 25 bp, Homo sapien
tgagaacccttgtcaccatgtgtga

SEQ ID NO: 672317 - DNA, 25 bp, Homo sapien
taattttgaggagccctggtgtcag

SEQ ID NO: 672318 - DNA, 25 bp, Homo sapien
acggtcagttctagctgtgagcact

SEQ ID NO: 672319 - DNA, 25 bp, Homo sapien
tgtcctcactctggaactcatcagt

SEQ ID NO: 672320 - DNA, 25 bp, Homo sapien
gaactcatcagtggcgccgatggat

SEQ ID NO: 672321 - DNA, 25 bp, Homo sapien
gcgccgatggatactggctcatagt

SEQ ID NO: 672322 - DNA, 25 bp, Homo sapien
ggtctggatatctcactctcctgag

SEQ ID NO: 672323 - DNA, 25 bp, Homo sapien
cactctcctgagatgccagtataga

SEQ ID NO: 672324 - DNA, 25 bp, Homo sapien
gatgccagtatagacacagaaccaa

SEQ ID NO: 672325 - DNA, 25 bp, Homo sapien
gtggaggatcctataagatggcccc

SEQ ID NO: 672326 - DNA, 25 bp, Homo sapien
ggaggatcctataagatggccccac

SEQ ID NO: 672327 - DNA, 25 bp, Homo sapien
gaggatcctataagatggccccacg

SEQ ID NO: 672328 - DNA, 25 bp, Homo sapien
aggatcctataagatggccccacgc

SEQ ID NO: 672329 - DNA, 25 bp, Homo sapien
ggatcctataagatggccccacgct

SEQ ID NO: 672330 - DNA, 25 bp, Homo sapien
atcctataagatggccccacgctta

SEQ ID NO: 672331 - DNA, 25 bp, Homo sapien
ataagatggccccacgcttatctcc

SEQ ID NO: 672332 - DNA, 25 bp, Homo sapien
tctcttttcggacttggcccacttg

SEQ ID NO: 672333 - DNA, 25 bp, Homo sapien
tcttttcggacttggcccacttgca

SEQ ID NO: 672334 - DNA, 25 bp, Homo sapien
ggacttggcccacttgcaccaaggc

SEQ ID NO: 672335 - DNA, 25 bp, Homo sapien
gcccacttgcaccaaggcctctgag

SEQ ID NO: 672336 - DNA, 25 bp, Homo sapien
gggcctgaacataatttcaagagga

SEQ ID NO: 672337 - DNA, 25 bp, Homo sapien
ggcctgaacataatttcaagaggag

SEQ ID NO: 672338 - DNA, 25 bp, Homo sapien
gcctgaacataatttcaagaggagg

SEQ ID NO: 672339 - DNA, 25 bp, Homo sapien
cctgaacataatttcaagaggagga

SEQ ID NO: 672340 - DNA, 25 bp, Homo sapien
ctgaacataatttcaagaggaggat

SEQ ID NO: 672341 - DNA, 25 bp, Homo sapien
gaacataatttcaagaggaggattt

SEQ ID NO: 672342 - DNA, 25 bp, Homo sapien
aacataatttcaagaggaggattta

SEQ ID NO: 672343 - DNA, 25 bp, Homo sapien
acataatttcaagaggaggatttat

SEQ ID NO: 672344 - DNA, 25 bp, Homo sapien
cataatttcaagaggaggatttata

SEQ ID NO: 672345 - DNA, 25 bp, Homo sapien
taatttcaagaggaggatttataaa

SEQ ID NO: 672346 - DNA, 25 bp, Homo sapien
ttcaagaggaggatttataaaacca

SEQ ID NO: 672347 - DNA, 25 bp, Homo sapien
gtgtgtagcatcatttcttttatgt

SEQ ID NO: 672348 - DNA, 25 bp, Homo sapien
gtttactttctcagtgggatatacc

SEQ ID NO: 672349 - DNA, 25 bp, Homo sapien
gggatataccattggcctttgccta

SEQ ID NO: 672350 - DNA, 25 bp, Homo sapien
atgagcatacatatccattgccaga

SEQ ID NO: 672351 - DNA, 25 bp, Homo sapien
tatccattgccagaacagattccag

SEQ ID NO: 672352 - DNA, 25 bp, Homo sapien
cagaacagattccagctaacagcaa

SEQ ID NO: 672353 - DNA, 25 bp, Homo sapien
agagagctacccacacagcatgcta

SEQ ID NO: 672354 - DNA, 25 bp, Homo sapien
gagaagtttatctagttcagggcat

SEQ ID NO: 672355 - DNA, 25 bp, Homo sapien
gttcagggcattgatctgcttagat

SEQ ID NO: 672356 - DNA, 25 bp, Homo sapien
tagacctgaaatcaagtgctcaact

SEQ ID NO: 672357 - DNA, 25 bp, Homo sapien
tcaagtgctcaactccaaacaacat

SEQ ID NO: 672358 - DNA, 25 bp, Homo sapien
gctacagataggcttatggagatga

SEQ ID NO: 672359 - DNA, 25 bp, Homo sapien
gatgagtaacttcacaggctgagac

SEQ ID NO: 672360 - DNA, 25 bp, Homo sapien
caggctgagactcttatgttgtcat

SEQ ID NO: 672361 - DNA, 25 bp, Homo sapien
actcttatgttgtcatggtgcagct

SEQ ID NO: 672362 - DNA, 25 bp, Homo sapien
tcatggtgcagctaacagggtgagt

SEQ ID NO: 672363 - DNA, 25 bp, Homo sapien
gggtgagtgaactgtttcatgcttc

SEQ ID NO: 672364 - DNA, 25 bp, Homo sapien
gtttcatgcttcatcaacaattaag

SEQ ID NO: 672365 - DNA, 25 bp, Homo sapien
aattgcactgctttgttgccaggat

SEQ ID NO: 672366 - DNA, 25 bp, Homo sapien
gggtatagagcaaaagcaccttaac

SEQ ID NO: 672367 - DNA, 25 bp, Homo sapien
gcaccttaacaaccaggcacaagta

SEQ ID NO: 672368 - DNA, 25 bp, Homo sapien
gcacaagtacttggcatcacaataa

SEQ ID NO: 672369 - DNA, 25 bp, Homo sapien
acgacacactttgatcccttctgtt

SEQ ID NO: 672370 - DNA, 25 bp, Homo sapien
acactttgatcccttctgttggtgt

SEQ ID NO: 672371 - DNA, 25 bp, Homo sapien
atgtatctagcttccgggccaagac

SEQ ID NO: 672372 - DNA, 25 bp, Homo sapien
tgtatctagcttccgggccaagaca

SEQ ID NO: 672373 - DNA, 25 bp, Homo sapien
tagcttccgggccaagacagctcat

SEQ ID NO: 672374 - DNA, 25 bp, Homo sapien
ttccgggccaagacagctcatggca

SEQ ID NO: 672375 - DNA, 25 bp, Homo sapien
gacagctcatggcagaggcctcaag

SEQ ID NO: 672376 - DNA, 25 bp, Homo sapien
aagaggcctggcaagaaagggtcaa

SEQ ID NO: 672377 - DNA, 25 bp, Homo sapien
ggcctggcaagaaagggtcaaataa

SEQ ID NO: 672378 - DNA, 25 bp, Homo sapien
aagagacctggaaaacgaacaagag

SEQ ID NO: 672379 - DNA, 25 bp, Homo sapien
acagaacacactaaatagcatcttt

SEQ ID NO: 672380 - DNA, 25 bp, Homo sapien
gtaagcatttaagatttgcatgggc

SEQ ID NO: 672381 - DNA, 25 bp, Homo sapien
taagcatttaagatttgcatgggct

SEQ ID NO: 672382 - DNA, 25 bp, Homo sapien
aagcatttaagatttgcatgggctg

SEQ ID NO: 672383 - DNA, 25 bp, Homo sapien
agcatttaagatttgcatgggctgg

SEQ ID NO: 672384 - DNA, 25 bp, Homo sapien
gcatttaagatttgcatgggctggc

SEQ ID NO: 672385 - DNA, 25 bp, Homo sapien
catttaagatttgcatgggctggcc

SEQ ID NO: 672386 - DNA, 25 bp, Homo sapien
atttaagatttgcatgggctggccg

SEQ ID NO: 672387 - DNA, 25 bp, Homo sapien
tttaagatttgcatgggctggccgg

SEQ ID NO: 672388 - DNA, 25 bp, Homo sapien
atttgcatgggctggccgggcacag

SEQ ID NO: 672389 - DNA, 25 bp, Homo sapien
tttgcatgggctggccgggcacagt

SEQ ID NO: 672390 - DNA, 25 bp, Homo sapien
tgggcatgatgatgggcccctgtaa

SEQ ID NO: 672391 - DNA, 25 bp, Homo sapien
acctgggatttggaattctccctgt

SEQ ID NO: 672392 - DNA, 25 bp, Homo sapien
gatttggaattctccctgtatgaag

SEQ ID NO: 672393 - DNA, 25 bp, Homo sapien
ggtattcagatgaacaatgtatcat

SEQ ID NO: 672394 - DNA, 25 bp, Homo sapien
gatgaacaatgtatcattcaagata

SEQ ID NO: 672395 - DNA, 25 bp, Homo sapien
aaaagcagcttgagtcatggaccta

SEQ ID NO: 672396 - DNA, 25 bp, Homo sapien
gcagcttgagtcatggacctaagga

SEQ ID NO: 672397 - DNA, 25 bp, Homo sapien
gagcaaaaatgtccttctgtccatg

SEQ ID NO: 672398 - DNA, 25 bp, Homo sapien
gcaaaaatgtccttctgtccatgga

SEQ ID NO: 672399 - DNA, 25 bp, Homo sapien
aaatgtccttctgtccatggacaga

SEQ ID NO: 672400 - DNA, 25 bp, Homo sapien
gagggcaaagataatatagcaggaa

SEQ ID NO: 672401 - DNA, 25 bp, Homo sapien
aggaagcttctactggaaaaggcag

SEQ ID NO: 672402 - DNA, 25 bp, Homo sapien
gattatggagcctgtccaggtcact

SEQ ID NO: 672403 - DNA, 25 bp, Homo sapien
agcctgtccaggtcactgtaggtgg

SEQ ID NO: 672404 - DNA, 25 bp, Homo sapien
aggtgggttgctgttatttgcgttc

SEQ ID NO: 672405 - DNA, 25 bp, Homo sapien
atttgcgttctgcttctatcacagt

SEQ ID NO: 672406 - DNA, 25 bp, Homo sapien
agggtttcaccagctgctcttggtt

SEQ ID NO: 672407 - DNA, 25 bp, Homo sapien
ttggttctcgtctggattctctttc

SEQ ID NO: 672408 - DNA, 25 bp, Homo sapien
tttctcaattcttccatctctcaca

SEQ ID NO: 672409 - DNA, 25 bp, Homo sapien
cttccatctctcacacatgtgtgtg

SEQ ID NO: 672410 - DNA, 25 bp, Homo sapien
gtgtacatacacaatggtgctgctg

SEQ ID NO: 672411 - DNA, 25 bp, Homo sapien
agccccgtaggaaccttgtatacat

SEQ ID NO: 672412 - DNA, 25 bp, Homo sapien
tttcctactttgcaaagcattggga

SEQ ID NO: 672413 - DNA, 25 bp, Homo sapien
gacaaccaagaatttcctgatccag

SEQ ID NO: 672414 - DNA, 25 bp, Homo sapien
gccagaacacttcctgaatgaaaat

SEQ ID NO: 672415 - DNA, 25 bp, Homo sapien
gctcgcatggagttgtttcttttgt

SEQ ID NO: 672416 - DNA, 25 bp, Homo sapien
tgttgtgtgccattttgcagcattt

SEQ ID NO: 672417 - DNA, 25 bp, Homo sapien
gcagcattttaatttgaagcctctc

SEQ ID NO: 672418 - DNA, 25 bp, Homo sapien
gaagcctctcgttgacccaaaggat

SEQ ID NO: 672419 - DNA, 25 bp, Homo sapien
aaaggatatcgacctcagccctata

SEQ ID NO: 672420 - DNA, 25 bp, Homo sapien
tcgacctcagccctatacatattgg

SEQ ID NO: 672421 - DNA, 25 bp, Homo sapien
atacatattgggtttggctgtatcc

SEQ ID NO: 672422 - DNA, 25 bp, Homo sapien
tggctgtatcccaccacgttacaaa

SEQ ID NO: 672423 - DNA, 25 bp, Homo sapien
acgttacaaactctgtgtcattccc

SEQ ID NO: 672424 - DNA, 25 bp, Homo sapien
ccttcctgccttcagtaacaacatt

SEQ ID NO: 672425 - DNA, 25 bp, Homo sapien
cctgccttcagtaacaacattacag

SEQ ID NO: 672426 - DNA, 25 bp, Homo sapien
taacaacattacaggaagagaggag

SEQ ID NO: 672427 - DNA, 25 bp, Homo sapien
atccagtcatttgtttccatctaaa

SEQ ID NO: 672428 - DNA, 25 bp, Homo sapien
tccagtcatttgtttccatctaaag

SEQ ID NO: 672429 - DNA, 25 bp, Homo sapien
cagtcatttgtttccatctaaagtg

SEQ ID NO: 672430 - DNA, 25 bp, Homo sapien
gtcatttgtttccatctaaagtgcc

SEQ ID NO: 672431 - DNA, 25 bp, Homo sapien
atttgtttccatctaaagtgcccta

SEQ ID NO: 672432 - DNA, 25 bp, Homo sapien
ttgtttccatctaaagtgccctata

SEQ ID NO: 672433 - DNA, 25 bp, Homo sapien
gtttccatctaaagtgccctataag

SEQ ID NO: 672434 - DNA, 25 bp, Homo sapien
tccatctaaagtgccctataagccg

SEQ ID NO: 672435 - DNA, 25 bp, Homo sapien
atactgggcaaaggtttctcactgt

SEQ ID NO: 672436 - DNA, 25 bp, Homo sapien
aaaggtttctcactgtttgagtggg

SEQ ID NO: 672437 - DNA, 25 bp, Homo sapien
agtctagagcgatccatggcatgat

SEQ ID NO: 672438 - DNA, 25 bp, Homo sapien
gtttagcttaattgggacacagatg

SEQ ID NO: 672439 - DNA, 25 bp, Homo sapien
agacatacatacatccctgggttac

SEQ ID NO: 672440 - DNA, 25 bp, Homo sapien
acatccctgggttactgtacacata

SEQ ID NO: 672441 - DNA, 25 bp, Homo sapien
gtacacatagatcttcttgttccgt

SEQ ID NO: 672442 - DNA, 25 bp, Homo sapien
agatcttcttgttccgtcagtttag

SEQ ID NO: 672443 - DNA, 25 bp, Homo sapien
gttccgtcagtttagaggtcctgga

SEQ ID NO: 672444 - DNA, 25 bp, Homo sapien
agcaatgagcatgcctactacccag

SEQ ID NO: 672445 - DNA, 25 bp, Homo sapien
ctactacccagatctcagtttctaa

SEQ ID NO: 672446 - DNA, 25 bp, Homo sapien
taaaaacctcagatcagcagaccga

SEQ ID NO: 672447 - DNA, 25 bp, Homo sapien
agaccgagtcgaaatctgattcttc

SEQ ID NO: 672448 - DNA, 25 bp, Homo sapien
aagtattgctttacccttgtcctga

SEQ ID NO: 672449 - DNA, 25 bp, Homo sapien
ttgtcctgaatgcagtccgtcatat

SEQ ID NO: 672450 - DNA, 25 bp, Homo sapien
gtcatatgaccactaacttgcatgt

SEQ ID NO: 672451 - DNA, 25 bp, Homo sapien
aacttgcatgtgaccaaatgtttgc

SEQ ID NO: 672452 - DNA, 25 bp, Homo sapien
tagatatgctctcggtgagccgtca

SEQ ID NO: 672453 - DNA, 25 bp, Homo sapien
gccgtcatccgtcaatccaagaaga

SEQ ID NO: 672454 - DNA, 25 bp, Homo sapien
agatgttgttgaactgcgttgcaca

SEQ ID NO: 672455 - DNA, 25 bp, Homo sapien
gcgttgcacaaagtttcttgacctc

SEQ ID NO: 672456 - DNA, 25 bp, Homo sapien
gacctcttctgcaacaaggacacaa

SEQ ID NO: 672457 - DNA, 25 bp, Homo sapien
aacaaggagcatgaggccacatcgt

SEQ ID NO: 672458 - DNA, 25 bp, Homo sapien
gaggccacatcgtttagcagagctt

SEQ ID NO: 672459 - DNA, 25 bp, Homo sapien
ggccacatcgtttagcagagcttct

SEQ ID NO: 672460 - DNA, 25 bp, Homo sapien
tttagcagagcttctgccaggctcg

SEQ ID NO: 672461 - DNA, 25 bp, Homo sapien
cccaggcgagatccctgagtaggat

SEQ ID NO: 672462 - DNA, 25 bp, Homo sapien
cctgagtaggattactagacagact

SEQ ID NO: 672463 - DNA, 25 bp, Homo sapien
tgtcctctcccactgtcttggagtg

SEQ ID NO: 672464 - DNA, 25 bp, Homo sapien
tgtcttggagtgtcccaaggccaga

SEQ ID NO: 672465 - DNA, 25 bp, Homo sapien
ggaaaatgatgtcccagctctagaa

SEQ ID NO: 672466 - DNA, 25 bp, Homo sapien
atgatgtcccagctctagaacaaca

SEQ ID NO: 672467 - DNA, 25 bp, Homo sapien
ctctagaacaacagactcagtcttc

SEQ ID NO: 672468 - DNA, 25 bp, Homo sapien
cggagaagttccagctcttcacgcc

SEQ ID NO: 672469 - DNA, 25 bp, Homo sapien
ttctccctgggcttcgagttccggc

SEQ ID NO: 672470 - DNA, 25 bp, Homo sapien
tccggcccggccacgagtattacta

SEQ ID NO: 672471 - DNA, 25 bp, Homo sapien
ggccacgagtattactacatctctg

SEQ ID NO: 672472 - DNA, 25 bp, Homo sapien
cgagtattactacatctctgccacg

SEQ ID NO: 672473 - DNA, 25 bp, Homo sapien
ggccctgcctgcgactgaaggtgta

SEQ ID NO: 672474 - DNA, 25 bp, Homo sapien
tgaaggtgtacgtgcggccgaccaa

SEQ ID NO: 672475 - DNA, 25 bp, Homo sapien
ggccgaccaacgagaccctgtacga

SEQ ID NO: 672476 - DNA, 25 bp, Homo sapien
gagaccctgtacgaggctcctgagc

SEQ ID NO: 672477 - DNA, 25 bp, Homo sapien
accagcaataactcgtgtagcagcc

SEQ ID NO: 672478 - DNA, 25 bp, Homo sapien
gcaataactcgtgtagcagcccggg

SEQ ID NO: 672479 - DNA, 25 bp, Homo sapien
gaactgaataaattgcaggcattac

SEQ ID NO: 672480 - DNA, 25 bp, Homo sapien
aaattgcaggcattacaggaaaaaa

SEQ ID NO: 672481 - DNA, 25 bp, Homo sapien
aaggaaaagcattcttctacaccta

SEQ ID NO: 672482 - DNA, 25 bp, Homo sapien
ggaaaagcattcttctacacctaat

SEQ ID NO: 672483 - DNA, 25 bp, Homo sapien
gaaaagcattcttctacacctaata

SEQ ID NO: 672484 - DNA, 25 bp, Homo sapien
aaagcattcttctacacctaatagt

SEQ ID NO: 672485 - DNA, 25 bp, Homo sapien
gcattcttctacacctaatagttct

SEQ ID NO: 672486 - DNA, 25 bp, Homo sapien
attcttctacacctaatagttctga

SEQ ID NO: 672487 - DNA, 25 bp, Homo sapien
tcttctacacctaatagttctgaat

SEQ ID NO: 672488 - DNA, 25 bp, Homo sapien
acacctaatagttctgaattctcca

SEQ ID NO: 672489 - DNA, 25 bp, Homo sapien
acctaatagttctgaattctccaga

SEQ ID NO: 672490 - DNA, 25 bp, Homo sapien
agtgatcgctttgcaaggatgtcta

SEQ ID NO: 672491 - DNA, 25 bp, Homo sapien
gatgtctaagctaatcccgtcacag

SEQ ID NO: 672492 - DNA, 25 bp, Homo sapien
tcacagaaaggaaacgcacaggcgc

SEQ ID NO: 672493 - DNA, 25 bp, Homo sapien
cgcacaggcgcctaggcagaaactt

SEQ ID NO: 672494 - DNA, 25 bp, Homo sapien
gcagaaacttggagactcaccgcag

SEQ ID NO: 672495 - DNA, 25 bp, Homo sapien
agactcaccgcagaggccacgtgaa

SEQ ID NO: 672496 - DNA, 25 bp, Homo sapien
tgaacccacggccacagagaggcag

SEQ ID NO: 672497 - DNA, 25 bp, Homo sapien
caggacggcagagccatgatttccc

SEQ ID NO: 672498 - DNA, 25 bp, Homo sapien
tgatttcccaccgagcgattacgag

SEQ ID NO: 672499 - DNA, 25 bp, Homo sapien
cgagcgattacgagaacctcttccc

SEQ ID NO: 672500 - DNA, 25 bp, Homo sapien
tagacacatctccaatacaaacaca

SEQ ID NO: 672501 - DNA, 25 bp, Homo sapien
actactaatcaacgcccataatcat

SEQ ID NO: 672502 - DNA, 25 bp, Homo sapien
aatcaacgcccataatcatacaaag

SEQ ID NO: 672503 - DNA, 25 bp, Homo sapien
gcaccaataggatcctcccgaatca

SEQ ID NO: 672504 - DNA, 25 bp, Homo sapien
cccctctccttcataaattattcag

SEQ ID NO: 672505 - DNA, 25 bp, Homo sapien
aaattattcagcttcctacactatt

SEQ ID NO: 672506 - DNA, 25 bp, Homo sapien
tcagcttcctacactattaaagttt

SEQ ID NO: 672507 - DNA, 25 bp, Homo sapien
actaaaacactcaccaagacctcaa

SEQ ID NO: 672508 - DNA, 25 bp, Homo sapien
atactcctcaatagccatcgctgta

SEQ ID NO: 672509 - DNA, 25 bp, Homo sapien
atagccatcgctgtagtatatccaa

SEQ ID NO: 672510 - DNA, 25 bp, Homo sapien
gccatcgctgtagtatatccaaaga

SEQ ID NO: 672511 - DNA, 25 bp, Homo sapien
gtatatccaaagacaaccatcattc

SEQ ID NO: 672512 - DNA, 25 bp, Homo sapien
tatgggaacagttttttatggacct

SEQ ID NO: 672513 - DNA, 25 bp, Homo sapien
tggacctcccttttggtctggaaat

SEQ ID NO: 672514 - DNA, 25 bp, Homo sapien
tggtctggaaataccttttcgaaca

SEQ ID NO: 672515 - DNA, 25 bp, Homo sapien
ggtctggaaataccttttcgaacag

SEQ ID NO: 672516 - DNA, 25 bp, Homo sapien
gtctggaaataccttttcgaacaga

SEQ ID NO: 672517 - DNA, 25 bp, Homo sapien
tctggaaataccttttcgaacagaa

SEQ ID NO: 672518 - DNA, 25 bp, Homo sapien
ctggaaataccttttcgaacagaat

SEQ ID NO: 672519 - DNA, 25 bp, Homo sapien
tggaaataccttttcgaacagaatt

SEQ ID NO: 672520 - DNA, 25 bp, Homo sapien
cataagcttaccatgctgggcctga

SEQ ID NO: 672521 - DNA, 25 bp, Homo sapien
gtgtcattttcccatttgcacaatg

SEQ ID NO: 672522 - DNA, 25 bp, Homo sapien
ccatttgcacaatgtagtctcactt

SEQ ID NO: 672523 - DNA, 25 bp, Homo sapien
aggcctgtggggtttgctctcatct

SEQ ID NO: 672524 - DNA, 25 bp, Homo sapien
tgtctctcactctttaccgcctgtc

SEQ ID NO: 672525 - DNA, 25 bp, Homo sapien
gggtctgtgggtgtcagctgcacgt

SEQ ID NO: 672526 - DNA, 25 bp, Homo sapien
tcagctgcacgtggtgatgggctca

SEQ ID NO: 672527 - DNA, 25 bp, Homo sapien
gtgatgggctcaggagcctgtggcc

SEQ ID NO: 672528 - DNA, 25 bp, Homo sapien
tgggcatgaggagcaaaccagagtt

SEQ ID NO: 672529 - DNA, 25 bp, Homo sapien
ggagcaaaccagagttagcaaccag

SEQ ID NO: 672530 - DNA, 25 bp, Homo sapien
gagttagcaaccaggaccgtggaag

SEQ ID NO: 672531 - DNA, 25 bp, Homo sapien
tagcaaccaggaccgtggaagaact

SEQ ID NO: 672532 - DNA, 25 bp, Homo sapien
caggaccgtggaagaactaggctca

SEQ ID NO: 672533 - DNA, 25 bp, Homo sapien
gaccgtggaagaactaggctcagga

SEQ ID NO: 672534 - DNA, 25 bp, Homo sapien
acggcagcgtgcagctcgccgacca

SEQ ID NO: 672535 - DNA, 25 bp, Homo sapien
gacaaccactacttgagcacccagt

SEQ ID NO: 672536 - DNA, 25 bp, Homo sapien
ttgagcacccagtccgccctgagca

SEQ ID NO: 672537 - DNA, 25 bp, Homo sapien
gccgccgggatcactctcggcatgg

SEQ ID NO: 672538 - DNA, 25 bp, Homo sapien
ccgggatcactctcggcatggacga

SEQ ID NO: 672539 - DNA, 25 bp, Homo sapien
gatcactctcggcatggacgagctg

SEQ ID NO: 672540 - DNA, 25 bp, Homo sapien
atcactctcggcatggacgagctgg

SEQ ID NO: 672541 - DNA, 25 bp, Homo sapien
gagctgggccgctctagaaagatga

SEQ ID NO: 672542 - DNA, 25 bp, Homo sapien
gctgggccgctctagaaagatgagc

SEQ ID NO: 672543 - DNA, 25 bp, Homo sapien
tgggccgctctagaaagatgagcaa

SEQ ID NO: 672544 - DNA, 25 bp, Homo sapien
ggccgctctagaaagatgagcaaag

SEQ ID NO: 672545 - DNA, 25 bp, Homo sapien
ggattgagaagggacaagccacctt

SEQ ID NO: 672546 - DNA, 25 bp, Homo sapien
gaagggacaagccaccttgaccgta

SEQ ID NO: 672547 - DNA, 25 bp, Homo sapien
agggacaagccaccttgaccgtagg

SEQ ID NO: 672548 - DNA, 25 bp, Homo sapien
accccctacacacacatgagagaga

SEQ ID NO: 672549 - DNA, 25 bp, Homo sapien
tgagggcctctctacttccccagat

SEQ ID NO: 672550 - DNA, 25 bp, Homo sapien
tccccagatgcctgggtgcaaagaa

SEQ ID NO: 672551 - DNA, 25 bp, Homo sapien
ctgggtgcaaagaacggcttggctt

SEQ ID NO: 672552 - DNA, 25 bp, Homo sapien
aaagaacggcttggcttggctcctc

SEQ ID NO: 672553 - DNA, 25 bp, Homo sapien
gcttggcttggctcctcctctggag

SEQ ID NO: 672554 - DNA, 25 bp, Homo sapien
atagtcattctaactgcactttgga

SEQ ID NO: 672555 - DNA, 25 bp, Homo sapien
attctaactgcactttggaaaccaa

SEQ ID NO: 672556 - DNA, 25 bp, Homo sapien
agttggggacttcagtactccactg

SEQ ID NO: 672557 - DNA, 25 bp, Homo sapien
tactccactgacagcactagacagg

SEQ ID NO: 672558 - DNA, 25 bp, Homo sapien
gacagcactagacaggtcatcaaga

SEQ ID NO: 672559 - DNA, 25 bp, Homo sapien
caatcagtgtaaactataccctgga

SEQ ID NO: 672560 - DNA, 25 bp, Homo sapien
tataccctggaacaaatggatttga

SEQ ID NO: 672561 - DNA, 25 bp, Homo sapien
ttattcaacagcacatggaactttc

SEQ ID NO: 672562 - DNA, 25 bp, Homo sapien
aagatagaccatataataggccata

SEQ ID NO: 672563 - DNA, 25 bp, Homo sapien
ataggccataaaatgagtctcaata

SEQ ID NO: 672564 - DNA, 25 bp, Homo sapien
ctctctcagaccatagtggaccgat

SEQ ID NO: 672565 - DNA, 25 bp, Homo sapien
agaccatagtggaccgatactagaa

SEQ ID NO: 672566 - DNA, 25 bp, Homo sapien
ggaccgatactagaaatcacctaca

SEQ ID NO: 672567 - DNA, 25 bp, Homo sapien
cattggtgtgatcgtatccacagtt

SEQ ID NO: 672568 - DNA, 25 bp, Homo sapien
ttggtgtgatcgtatccacagttct

SEQ ID NO: 672569 - DNA, 25 bp, Homo sapien
ggtgtgatcgtatccacagttctta

SEQ ID NO: 672570 - DNA, 25 bp, Homo sapien
gtgtgatcgtatccacagttcttat

SEQ ID NO: 672571 - DNA, 25 bp, Homo sapien
gtgatcgtatccacagttcttatag

SEQ ID NO: 672572 - DNA, 25 bp, Homo sapien
gatcgtatccacagttcttatagag

SEQ ID NO: 672573 - DNA, 25 bp, Homo sapien
tcgtatccacagttcttatagagca

SEQ ID NO: 672574 - DNA, 25 bp, Homo sapien
gtatccacagttcttatagagcagt

SEQ ID NO: 672575 - DNA, 25 bp, Homo sapien
tatccacagttcttatagagcagtt

SEQ ID NO: 672576 - DNA, 25 bp, Homo sapien
gatggttcatcgctgacccactctg

SEQ ID NO: 672577 - DNA, 25 bp, Homo sapien
gttcatcgctgacccactctgttct

SEQ ID NO: 672578 - DNA, 25 bp, Homo sapien
atgcagctccatggagaaggatcgc

SEQ ID NO: 672579 - DNA, 25 bp, Homo sapien
agaaggatcgcaagatctcagcacc

SEQ ID NO: 672580 - DNA, 25 bp, Homo sapien
ttctttctattcctaatcgtttcgg

SEQ ID NO: 672581 - DNA, 25 bp, Homo sapien
taatcgtttcggtttggagtcctag

SEQ ID NO: 672582 - DNA, 25 bp, Homo sapien
gaggctgcggaatgacccagttgtc

SEQ ID NO: 672583 - DNA, 25 bp, Homo sapien
acccagttgtcatggttagcaaggc

SEQ ID NO: 672584 - DNA, 25 bp, Homo sapien
ggttagcaaggctgttggaaacata

SEQ ID NO: 672585 - DNA, 25 bp, Homo sapien
ggaaacatatatcttgcattcgact

SEQ ID NO: 672586 - DNA, 25 bp, Homo sapien
ttgcattcgactcattcatcctaat

SEQ ID NO: 672587 - DNA, 25 bp, Homo sapien
gaaccaagaagctaaaacacacctt

SEQ ID NO: 672588 - DNA, 25 bp, Homo sapien
ttgattttgtgtcagattaggtgct

SEQ ID NO: 672589 - DNA, 25 bp, Homo sapien
acatgaatctcgctgactgtcagag

SEQ ID NO: 672590 - DNA, 25 bp, Homo sapien
gactgtcagagcgaggtgctctttt

SEQ ID NO: 672591 - DNA, 25 bp, Homo sapien
ggtgctctttttgctacagaatctg

SEQ ID NO: 672592 - DNA, 25 bp, Homo sapien
tgcaagagattaccttctccttctg

SEQ ID NO: 672593 - DNA, 25 bp, Homo sapien
ttctgccgtctgtttgagaagcgcc

SEQ ID NO: 672594 - DNA, 25 bp, Homo sapien
aatttctgcctgagatggttgctgc

SEQ ID NO: 672595 - DNA, 25 bp, Homo sapien
tgcctgagatggttgctgctatgaa

SEQ ID NO: 672596 - DNA, 25 bp, Homo sapien
gaagggcaactccacactgaagggc

SEQ ID NO: 672597 - DNA, 25 bp, Homo sapien
tggccttggcagatgttttctcaga

SEQ ID NO: 672598 - DNA, 25 bp, Homo sapien
tttctcagaggattcatcctcctct

SEQ ID NO: 672599 - DNA, 25 bp, Homo sapien
atcagttccaactgcatcaagccag

SEQ ID NO: 672600 - DNA, 25 bp, Homo sapien
ctcacagcagggttgaagagaagcc

SEQ ID NO: 672601 - DNA, 25 bp, Homo sapien
ttctatgggcagattcctggctgtg

SEQ ID NO: 672602 - DNA, 25 bp, Homo sapien
gaaatgtttgggtcagtacccactt

SEQ ID NO: 672603 - DNA, 25 bp, Homo sapien
ggtttcaaagatctgcattgagtgc

SEQ ID NO: 672604 - DNA, 25 bp, Homo sapien
gaaattgagtctttcatttagagaa

SEQ ID NO: 672605 - DNA, 25 bp, Homo sapien
gagtctttcatttagagaatcagga

SEQ ID NO: 672606 - DNA, 25 bp, Homo sapien
tcaggccaagaacattggttactga

SEQ ID NO: 672607 - DNA, 25 bp, Homo sapien
attggttactgaatacacctgggta

SEQ ID NO: 672608 - DNA, 25 bp, Homo sapien
ggttactgaatacacctgggtaaat

SEQ ID NO: 672609 - DNA, 25 bp, Homo sapien
ctgaatacacctgggtaaatttgaa

SEQ ID NO: 672610 - DNA, 25 bp, Homo sapien
aatgactcacagcagggttgaagag

SEQ ID NO: 672611 - DNA, 25 bp, Homo sapien
cacctgaccaatcagagagctcact

SEQ ID NO: 672612 - DNA, 25 bp, Homo sapien
acctgaccaatcagagagctcacta

SEQ ID NO: 672613 - DNA, 25 bp, Homo sapien
cctgaccaatcagagagctcactaa

SEQ ID NO: 672614 - DNA, 25 bp, Homo sapien
ctgaccaatcagagagctcactaaa

SEQ ID NO: 672615 - DNA, 25 bp, Homo sapien
gggatataaacccaagtcttcgagc

SEQ ID NO: 672616 - DNA, 25 bp, Homo sapien
atataaacccaagtcttcgagccgg

SEQ ID NO: 672617 - DNA, 25 bp, Homo sapien
tataaacccaagtcttcgagccggc

SEQ ID NO: 672618 - DNA, 25 bp, Homo sapien
aacccaagtcttcgagccggcaacg

SEQ ID NO: 672619 - DNA, 25 bp, Homo sapien
ctcgacggtgaggacttacgggcgg

SEQ ID NO: 672620 - DNA, 25 bp, Homo sapien
atccagcgctcctccagcggagagg

SEQ ID NO: 672621 - DNA, 25 bp, Homo sapien
gggtcttcagggtcgagggcaggat

SEQ ID NO: 672622 - DNA, 25 bp, Homo sapien
caggatgtgccctgtggagctgctc

SEQ ID NO: 672623 - DNA, 25 bp, Homo sapien
ggagctgctcacctaagttcctgcc

SEQ ID NO: 672624 - DNA, 25 bp, Homo sapien
cacctaagttcctgcctccataggg

SEQ ID NO: 672625 - DNA, 25 bp, Homo sapien
gaggctttgggctgcgttattccag

SEQ ID NO: 672626 - DNA, 25 bp, Homo sapien
tttgggctgcgttattccagcggga

SEQ ID NO: 672627 - DNA, 25 bp, Homo sapien
ctgcgttattccagcgggaggtggt

SEQ ID NO: 672628 - DNA, 25 bp, Homo sapien
gggtcagcctgagaatctcgccctt

SEQ ID NO: 672629 - DNA, 25 bp, Homo sapien
gcctgagaatctcgcccttggatta

SEQ ID NO: 672630 - DNA, 25 bp, Homo sapien
gctaactaaatgctattgtggtcag

SEQ ID NO: 672631 - DNA, 25 bp, Homo sapien
taaatgctattgtggtcagcacaca

SEQ ID NO: 672632 - DNA, 25 bp, Homo sapien
ggtcagcacacactgtgttattcca

SEQ ID NO: 672633 - DNA, 25 bp, Homo sapien
gcacacactgtgttattccagttct

SEQ ID NO: 672634 - DNA, 25 bp, Homo sapien
gttctacattagtaaatacaccacc

SEQ ID NO: 672635 - DNA, 25 bp, Homo sapien
aattggcagggtggaattcttcata

SEQ ID NO: 672636 - DNA, 25 bp, Homo sapien
ggaattcttcataaggtttagttca

SEQ ID NO: 672637 - DNA, 25 bp, Homo sapien
gtttagttcagatcacctttgtcct

SEQ ID NO: 672638 - DNA, 25 bp, Homo sapien
gatcacctttgtcctcaatttttta

SEQ ID NO: 672639 - DNA, 25 bp, Homo sapien
gtaattctatcaattgctaagacat

SEQ ID NO: 672640 - DNA, 25 bp, Homo sapien
aagacattgtttcacatttttccaa

SEQ ID NO: 672641 - DNA, 25 bp, Homo sapien
ggcacccacaccctaggacatgtaa

SEQ ID NO: 672642 - DNA, 25 bp, Homo sapien
acaccctaggacatgtaagccctca

SEQ ID NO: 672643 - DNA, 25 bp, Homo sapien
acatgtaagccctcatgtccaaggg

SEQ ID NO: 672644 - DNA, 25 bp, Homo sapien
taagccctcatgtccaagggagcct

SEQ ID NO: 672645 - DNA, 25 bp, Homo sapien
agatagtaggaaatcaggtctggaa

SEQ ID NO: 672646 - DNA, 25 bp, Homo sapien
ggcatgagactaaggctatctgctt

SEQ ID NO: 672647 - DNA, 25 bp, Homo sapien
atgagactaaggctatctgcttccc

SEQ ID NO: 672648 - DNA, 25 bp, Homo sapien
ttcccttatgccctgactggagagg

SEQ ID NO: 672649 - DNA, 25 bp, Homo sapien
gaggcaaggcccacagagggcatcc

SEQ ID NO: 672650 - DNA, 25 bp, Homo sapien
agagggcatcccagctaggccttgg

SEQ ID NO: 672651 - DNA, 25 bp, Homo sapien
cagctaggccttgggatggctgcag

SEQ ID NO: 672652 - DNA, 25 bp, Homo sapien
tgactcacagcagggttgaagagaa

SEQ ID NO: 672653 - DNA, 25 bp, Homo sapien
ctcacagcagggttgaagagaagcc

SEQ ID NO: 672654 - DNA, 25 bp, Homo sapien
gaaattgagtctttcatttagagaa

SEQ ID NO: 672655 - DNA, 25 bp, Homo sapien
gagtctttcatttagagaatcagga

SEQ ID NO: 672656 - DNA, 25 bp, Homo sapien
tcaggccaagaacattggttactga

SEQ ID NO: 672657 - DNA, 25 bp, Homo sapien
gaacattggttactgaatacacctg

SEQ ID NO: 672658 - DNA, 25 bp, Homo sapien
attggttactgaatacacctgggta

SEQ ID NO: 672659 - DNA, 25 bp, Homo sapien
tggttactgaatacacctgggtaaa

SEQ ID NO: 672660 - DNA, 25 bp, Homo sapien
gttactgaatacacctgggtaaatt

SEQ ID NO: 672661 - DNA, 25 bp, Homo sapien
ctgaatacacctgggtaaatttgaa

SEQ ID NO: 672662 - DNA, 25 bp, Homo sapien
aatgactcacagcagggttgaagag

SEQ ID NO: 672663 - DNA, 25 bp, Homo sapien
ttaaaagtctaatgcataatacaat

SEQ ID NO: 672664 - DNA, 25 bp, Homo sapien
aatattgttaatgggtgcacactgt

SEQ ID NO: 672665 - DNA, 25 bp, Homo sapien
gttaatgggtgcacactgtataaaa

SEQ ID NO: 672666 - DNA, 25 bp, Homo sapien
tgggtgcacactgtataaaaatgta

SEQ ID NO: 672667 - DNA, 25 bp, Homo sapien
aaaaatgtaatcaatgacaatggca

SEQ ID NO: 672668 - DNA, 25 bp, Homo sapien
aattgagagaattctttatcagtag

SEQ ID NO: 672669 - DNA, 25 bp, Homo sapien
atttagtcctaaatgaagagacatt

SEQ ID NO: 672670 - DNA, 25 bp, Homo sapien
gaagagacattagacagtaactcaa

SEQ ID NO: 672671 - DNA, 25 bp, Homo sapien
gtaactcaaaaccatacaaagaaat

SEQ ID NO: 672672 - DNA, 25 bp, Homo sapien
gaacacaggtaaatatacaagtcaa

SEQ ID NO: 672673 - DNA, 25 bp, Homo sapien
tattgtactttgggtttgtaactct

SEQ ID NO: 672674 - DNA, 25 bp, Homo sapien
acaggacctgggatttggaattctc

SEQ ID NO: 672675 - DNA, 25 bp, Homo sapien
ggatttggaattctccctgtatgaa

SEQ ID NO: 672676 - DNA, 25 bp, Homo sapien
ggaattctccctgtatgaagctaaa

SEQ ID NO: 672677 - DNA, 25 bp, Homo sapien
ggtattcagatgaacaatgtatcat

SEQ ID NO: 672678 - DNA, 25 bp, Homo sapien
gaatttattttctgtcaaaagcagc

SEQ ID NO: 672679 - DNA, 25 bp, Homo sapien
aaaagcagcttgagtcatggaccta

SEQ ID NO: 672680 - DNA, 25 bp, Homo sapien
gcagcttgagtcatggacctaagga

SEQ ID NO: 672681 - DNA, 25 bp, Homo sapien
gagcaaaaatgtccttctgtccatg

SEQ ID NO: 672682 - DNA, 25 bp, Homo sapien
aaatgtccttctgtccatggacaga

SEQ ID NO: 672683 - DNA, 25 bp, Homo sapien
gagggcaaagataatatagcaggaa

SEQ ID NO: 672684 - DNA, 25 bp, Homo sapien
aggaagcttctactggaaaaggcag

SEQ ID NO: 672685 - DNA, 25 bp, Homo sapien
gtccaacgaccccagcatggaggct

SEQ ID NO: 672686 - DNA, 25 bp, Homo sapien
aagctatcagctactttctcattct

SEQ ID NO: 672687 - DNA, 25 bp, Homo sapien
tatcagctactttctcattctctac

SEQ ID NO: 672688 - DNA, 25 bp, Homo sapien
aatgcagttgctctgtttatctacc

SEQ ID NO: 672689 - DNA, 25 bp, Homo sapien
ctgtttatctacctgtccaacatgt

SEQ ID NO: 672690 - DNA, 25 bp, Homo sapien
aacagtctgtggaataatttgtgcc

SEQ ID NO: 672691 - DNA, 25 bp, Homo sapien
gtggaataatttgtgccagatcatc

SEQ ID NO: 672692 - DNA, 25 bp, Homo sapien
tgccagccactcaattctactgatt

SEQ ID NO: 672693 - DNA, 25 bp, Homo sapien
actgattcaagataaccctgggctg

SEQ ID NO: 672694 - DNA, 25 bp, Homo sapien
gcttcagcttcgacttcatctttac

SEQ ID NO: 672695 - DNA, 25 bp, Homo sapien
cttcgacttcatctttacccaaaag

SEQ ID NO: 672696 - DNA, 25 bp, Homo sapien
atgagtctgccaaacgcatctcaga

SEQ ID NO: 672697 - DNA, 25 bp, Homo sapien
aaaaaattctggtccccgctctctg

SEQ ID NO: 672698 - DNA, 25 bp, Homo sapien
aaaaattctggtccccgctctctgt

SEQ ID NO: 672699 - DNA, 25 bp, Homo sapien
ggacttcctctctccgtggttctca

SEQ ID NO: 672700 - DNA, 25 bp, Homo sapien
gtggttctcaccccatactctgtca

SEQ ID NO: 672701 - DNA, 25 bp, Homo sapien
atactctgtcactgccacattttca

SEQ ID NO: 672702 - DNA, 25 bp, Homo sapien
tgtcactgccacattttcacctggg

SEQ ID NO: 672703 - DNA, 25 bp, Homo sapien
ctggcctttgtctccacctgaaact

SEQ ID NO: 672704 - DNA, 25 bp, Homo sapien
tttgtctccacctgaaactcctgaa

SEQ ID NO: 672705 - DNA, 25 bp, Homo sapien
ctgaaactcctgaaaatcttgaaat

SEQ ID NO: 672706 - DNA, 25 bp, Homo sapien
gaaactcctgaaaatcttgaaatgg

SEQ ID NO: 672707 - DNA, 25 bp, Homo sapien
tccaggtcttgatgttatttctaga

SEQ ID NO: 672708 - DNA, 25 bp, Homo sapien
tgttatttctagaaggaacctcagt

SEQ ID NO: 672709 - DNA, 25 bp, Homo sapien
agccctttggtgtcatgtaagagta

SEQ ID NO: 672710 - DNA, 25 bp, Homo sapien
ggctgctggtcttccagtctttttt

SEQ ID NO: 672711 - DNA, 25 bp, Homo sapien
gacattcacaactgtgcatgtgctt

SEQ ID NO: 672712 - DNA, 25 bp, Homo sapien
tataaaattgctcatgaccagatgc

SEQ ID NO: 672713 - DNA, 25 bp, Homo sapien
agatgcaatatccagtaccacttca

SEQ ID NO: 672714 - DNA, 25 bp, Homo sapien
agtggctggaaatcatggctgtata

SEQ ID NO: 672715 - DNA, 25 bp, Homo sapien
gctgtataattctatgtcagtgata

SEQ ID NO: 672716 - DNA, 25 bp, Homo sapien
gagtattctgttgaagtgtttgaca

SEQ ID NO: 672717 - DNA, 25 bp, Homo sapien
aagtgtttgacagcattactgtaat

SEQ ID NO: 672718 - DNA, 25 bp, Homo sapien
tgcttagatgttccagtaatctaat

SEQ ID NO: 672719 - DNA, 25 bp, Homo sapien
gttccagtaatctaatatggccaca

SEQ ID NO: 672720 - DNA, 25 bp, Homo sapien
tatggccacagtagtcttgatgacc

SEQ ID NO: 672721 - DNA, 25 bp, Homo sapien
ggccacagtagtcttgatgaccaaa

SEQ ID NO: 672722 - DNA, 25 bp, Homo sapien
gtagtcttgatgaccaaagtccttt

SEQ ID NO: 672723 - DNA, 25 bp, Homo sapien
agtcttgatgaccaaagtccttttt

SEQ ID NO: 672724 - DNA, 25 bp, Homo sapien
ttccatctttagaaaactacatggg

SEQ ID NO: 672725 - DNA, 25 bp, Homo sapien
agaaaactacatgggaacaaacaga

SEQ ID NO: 672726 - DNA, 25 bp, Homo sapien
gtgtgtgtgaatgaacactcttgct

SEQ ID NO: 672727 - DNA, 25 bp, Homo sapien
tgtgaatgaacactcttgctttatt

SEQ ID NO: 672728 - DNA, 25 bp, Homo sapien
tgaatgaacactcttgctttattcc

SEQ ID NO: 672729 - DNA, 25 bp, Homo sapien
tgacttttctggaagtaacttgata

SEQ ID NO: 672730 - DNA, 25 bp, Homo sapien
aacttgatataattaggagcctttg

SEQ ID NO: 672731 - DNA, 25 bp, Homo sapien
taattaggagcctttgtaaggaaat

SEQ ID NO: 672732 - DNA, 25 bp, Homo sapien
gtttctatgaattttacttatctag

SEQ ID NO: 672733 - DNA, 25 bp, Homo sapien
gaattttacttatctaggtatctca

SEQ ID NO: 672734 - DNA, 25 bp, Homo sapien
attttacttatctaggtatctcata

SEQ ID NO: 672735 - DNA, 25 bp, Homo sapien
gaatcatatataagggaggaacaat

SEQ ID NO: 672736 - DNA, 25 bp, Homo sapien
tttcctccacccttctaatttcttg

SEQ ID NO: 672737 - DNA, 25 bp, Homo sapien
ccacccttctaatttcttggctggg

SEQ ID NO: 672738 - DNA, 25 bp, Homo sapien
ttggctggggctctagtaacaaaag

SEQ ID NO: 672739 - DNA, 25 bp, Homo sapien
aacataagttttatatgacacagaa

SEQ ID NO: 672740 - DNA, 25 bp, Homo sapien
aggcctctgacttctaggatgtaaa

SEQ ID NO: 672741 - DNA, 25 bp, Homo sapien
gaacagactgaggaactgccttagg

SEQ ID NO: 672742 - DNA, 25 bp, Homo sapien
gggagctttactgcctgggaacatg

SEQ ID NO: 672743 - DNA, 25 bp, Homo sapien
ttactgcctgggaacatggtgttag

SEQ ID NO: 672744 - DNA, 25 bp, Homo sapien
atggtgttagcccactgtttgcaga

SEQ ID NO: 672745 - DNA, 25 bp, Homo sapien
tagcccactgtttgcagacgaggta

SEQ ID NO: 672746 - DNA, 25 bp, Homo sapien
aaagcttgaagctgccagaacatgt

SEQ ID NO: 672747 - DNA, 25 bp, Homo sapien
gccagaacatgttgggatgtcccag

SEQ ID NO: 672748 - DNA, 25 bp, Homo sapien
aacatgttgggatgtcccaggatgc

SEQ ID NO: 672749 - DNA, 25 bp, Homo sapien
tcactctgtttagcccaattttaac

SEQ ID NO: 672750 - DNA, 25 bp, Homo sapien
gcaggtgctaataaccatatcataa

SEQ ID NO: 672751 - DNA, 25 bp, Homo sapien
tgtaagcattaaactcagagacatt

SEQ ID NO: 672752 - DNA, 25 bp, Homo sapien
aaactcagagacattttatggaaaa

SEQ ID NO: 672753 - DNA, 25 bp, Homo sapien
aaatgatctgaggtattgacttcaa

SEQ ID NO: 672754 - DNA, 25 bp, Homo sapien
tctgaggtattgacttcaaaatcca

SEQ ID NO: 672755 - DNA, 25 bp, Homo sapien
gggtgttggattatctgttatttac

SEQ ID NO: 672756 - DNA, 25 bp, Homo sapien
gttggattatctgttatttacttaa

SEQ ID NO: 672757 - DNA, 25 bp, Homo sapien
atttacttaactccattagcaccca

SEQ ID NO: 672758 - DNA, 25 bp, Homo sapien
taactccattagcacccagctatgg

SEQ ID NO: 672759 - DNA, 25 bp, Homo sapien
acccagctatggataaattgtgtgt

SEQ ID NO: 672760 - DNA, 25 bp, Homo sapien
aattgtgtgtaatagttgtgtttta

SEQ ID NO: 672761 - DNA, 25 bp, Homo sapien
agattttaaaatagtgaccactgaa

SEQ ID NO: 672762 - DNA, 25 bp, Homo sapien
cgtgctggaatgacaaataactggc

SEQ ID NO: 672763 - DNA, 25 bp, Homo sapien
tgctggaatgacaaataactggcgt

SEQ ID NO: 672764 - DNA, 25 bp, Homo sapien
tggaatgacaaataactggcgtgct

SEQ ID NO: 672765 - DNA, 25 bp, Homo sapien
ggaatgacaaataactggcgtgctt

SEQ ID NO: 672766 - DNA, 25 bp, Homo sapien
gaatgacaaataactggcgtgcttt

SEQ ID NO: 672767 - DNA, 25 bp, Homo sapien
aatgacaaataactggcgtgctttt

SEQ ID NO: 672768 - DNA, 25 bp, Homo sapien
atgacaaataactggcgtgcttttt

SEQ ID NO: 672769 - DNA, 25 bp, Homo sapien
tgacaaataactggcgtgctttttt

SEQ ID NO: 672770 - DNA, 25 bp, Homo sapien
atgttgcacatttttgcatgtgttc

SEQ ID NO: 672771 - DNA, 25 bp, Homo sapien
tgcacatttttgcatgtgttctgat

SEQ ID NO: 672772 - DNA, 25 bp, Homo sapien
gcacatttttgcatgtgttctgata

SEQ ID NO: 672773 - DNA, 25 bp, Homo sapien
ataaaatttggcagcagttatgcta

SEQ ID NO: 672774 - DNA, 25 bp, Homo sapien
ggcagcagttatgctattgacagca

SEQ ID NO: 672775 - DNA, 25 bp, Homo sapien
tattgacagcatataaaaagcactc

SEQ ID NO: 672776 - DNA, 25 bp, Homo sapien
aaaaagcactcaatcgagctaggtg

SEQ ID NO: 672777 - DNA, 25 bp, Homo sapien
cactcaatcgagctaggtgcagtgg

SEQ ID NO: 672778 - DNA, 25 bp, Homo sapien
ggaggccccagcaaaaggatcactt

SEQ ID NO: 672779 - DNA, 25 bp, Homo sapien
acatggcaagactctatctgtatga

SEQ ID NO: 672780 - DNA, 25 bp, Homo sapien
ggaatagtgatgtgtgcccttgcag

SEQ ID NO: 672781 - DNA, 25 bp, Homo sapien
atagtgatgtgtgcccttgcagtga

SEQ ID NO: 672782 - DNA, 25 bp, Homo sapien
tgtgatttgctctactgcactccac

SEQ ID NO: 672783 - DNA, 25 bp, Homo sapien
gatttgctctactgcactccacctt

SEQ ID NO: 672784 - DNA, 25 bp, Homo sapien
agctaagactcaatggtatgaaatc

SEQ ID NO: 672785 - DNA, 25 bp, Homo sapien
gtatgaaatcatagttatctatctg

SEQ ID NO: 672786 - DNA, 25 bp, Homo sapien
tagttatctatctgataattcccat

SEQ ID NO: 672787 - DNA, 25 bp, Homo sapien
ttttgtgaatagcttcttatggcaa

SEQ ID NO: 672788 - DNA, 25 bp, Homo sapien
gaatagcttcttatggcaaaatatg

SEQ ID NO: 672789 - DNA, 25 bp, Homo sapien
gaatatttacagttacctgttctca

SEQ ID NO: 672790 - DNA, 25 bp, Homo sapien
tacagttacctgttctcaaaggccc

SEQ ID NO: 672791 - DNA, 25 bp, Homo sapien
ctctcttctttcctcagttaatcaa

SEQ ID NO: 672792 - DNA, 25 bp, Homo sapien
ctcttctttcctcagttaatcaaat

SEQ ID NO: 672793 - DNA, 25 bp, Homo sapien
cagttaatcaaatcctctgacccag

SEQ ID NO: 672794 - DNA, 25 bp, Homo sapien
caaatcctctgacccagatttattt

SEQ ID NO: 672795 - DNA, 25 bp, Homo sapien
gttgctatctattagaaactcatac

SEQ ID NO: 672796 - DNA, 25 bp, Homo sapien
tagaaactcatactatagggaactt

SEQ ID NO: 672797 - DNA, 25 bp, Homo sapien
aagatttgtaattgagcttatgaat

SEQ ID NO: 672798 - DNA, 25 bp, Homo sapien
aattgagcttatgaatgttgtagga

SEQ ID NO: 672799 - DNA, 25 bp, Homo sapien
ggaataaattcaaacactggcacaa

SEQ ID NO: 672800 - DNA, 25 bp, Homo sapien
aaacactggcacaagatgcttttct

SEQ ID NO: 672801 - DNA, 25 bp, Homo sapien
gatgcttttctttgattctagttac

SEQ ID NO: 672802 - DNA, 25 bp, Homo sapien
gattctagttacaacagtttctttt

SEQ ID NO: 672803 - DNA, 25 bp, Homo sapien
tattttgatacctgtgtacagtgtt

SEQ ID NO: 672804 - DNA, 25 bp, Homo sapien
acctgtgtacagtgtttaatgatta

SEQ ID NO: 672805 - DNA, 25 bp, Homo sapien
aatgattaaatcagggtaactggaa

SEQ ID NO: 672806 - DNA, 25 bp, Homo sapien
agaaccggttgtgtgctacggctgt

SEQ ID NO: 672807 - DNA, 25 bp, Homo sapien
tacggctgtggagaacccggcaaca

SEQ ID NO: 672808 - DNA, 25 bp, Homo sapien
ggagaacccggcaacatcagtttaa

SEQ ID NO: 672809 - DNA, 25 bp, Homo sapien
gaagaccccaagttgtatggcaccc

SEQ ID NO: 672810 - DNA, 25 bp, Homo sapien
gcaccccaaccccagtgatagaaag

SEQ ID NO: 672811 - DNA, 25 bp, Homo sapien
gaaacaacctgccaccaaaagaaga

SEQ ID NO: 672812 - DNA, 25 bp, Homo sapien
gaaaccttcatcctagcactaaatt

SEQ ID NO: 672813 - DNA, 25 bp, Homo sapien
aatctgcccattcatcttcatgtaa

SEQ ID NO: 672814 - DNA, 25 bp, Homo sapien
taaggacagctgaatgacggcaaac

SEQ ID NO: 672815 - DNA, 25 bp, Homo sapien
gacggcaaactcagtcatactttta

SEQ ID NO: 672816 - DNA, 25 bp, Homo sapien
aaaggtcttcagatttcttgcataa

SEQ ID NO: 672817 - DNA, 25 bp, Homo sapien
tgacttttctggaagtaacttgata

SEQ ID NO: 672818 - DNA, 25 bp, Homo sapien
aacttgatataattaggagcctttg

SEQ ID NO: 672819 - DNA, 25 bp, Homo sapien
taattaggagcctttgtaaggaaat

SEQ ID NO: 672820 - DNA, 25 bp, Homo sapien
agccactgagcctgactaccattct

SEQ ID NO: 672821 - DNA, 25 bp, Homo sapien
gcctgactaccattctactttgttt

SEQ ID NO: 672822 - DNA, 25 bp, Homo sapien
gtttctatgaattttacttatctag

SEQ ID NO: 672823 - DNA, 25 bp, Homo sapien
attttacttatctaggtatctcata

SEQ ID NO: 672824 - DNA, 25 bp, Homo sapien
gaatcatatataagggaggaacaat

SEQ ID NO: 672825 - DNA, 25 bp, Homo sapien
tttcctccacccttctaatttcttg

SEQ ID NO: 672826 - DNA, 25 bp, Homo sapien
ccacccttctaatttcttggctggg

SEQ ID NO: 672827 - DNA, 25 bp, Homo sapien
ttggctggggctctagtaacaaaag

SEQ ID NO: 672828 - DNA, 25 bp, Homo sapien
cagcagttgtggcactcaagcccgc

SEQ ID NO: 672829 - DNA, 25 bp, Homo sapien
agcagttgtggcactcaagcccgcc

SEQ ID NO: 672830 - DNA, 25 bp, Homo sapien
gcagttgtggcactcaagcccgcca

SEQ ID NO: 672831 - DNA, 25 bp, Homo sapien
cagttgtggcactcaagcccgccag

SEQ ID NO: 672832 - DNA, 25 bp, Homo sapien
agttgtggcactcaagcccgccagg

SEQ ID NO: 672833 - DNA, 25 bp, Homo sapien
gttgtggcactcaagcccgccaggg

SEQ ID NO: 672834 - DNA, 25 bp, Homo sapien
ttgtggcactcaagcccgccagggg

SEQ ID NO: 672835 - DNA, 25 bp, Homo sapien
tgtggcactcaagcccgccaggggg

SEQ ID NO: 672836 - DNA, 25 bp, Homo sapien
gtggcactcaagcccgccaggggga

SEQ ID NO: 672837 - DNA, 25 bp, Homo sapien
tggcactcaagcccgccagggggac

SEQ ID NO: 672838 - DNA, 25 bp, Homo sapien
ggcactcaagcccgccagggggacc

SEQ ID NO: 672839 - DNA, 25 bp, Homo sapien
gacagcatacctcctgtaagtgtgt

SEQ ID NO: 672840 - DNA, 25 bp, Homo sapien
gcatacctcctgtaagtgtgtgatc

SEQ ID NO: 672841 - DNA, 25 bp, Homo sapien
acctcctgtaagtgtgtgatcatgc

SEQ ID NO: 672842 - DNA, 25 bp, Homo sapien
gtaagtgtgtgatcatgctttctga

SEQ ID NO: 672843 - DNA, 25 bp, Homo sapien
catgctttctgatgtctgtgacttc

SEQ ID NO: 672844 - DNA, 25 bp, Homo sapien
ctgatgtctgtgacttctctaggac

SEQ ID NO: 672845 - DNA, 25 bp, Homo sapien
gtctgtgacttctctaggactcagt

SEQ ID NO: 672846 - DNA, 25 bp, Homo sapien
gacttctctaggactcagtgtttct

SEQ ID NO: 672847 - DNA, 25 bp, Homo sapien
ggactcagtgtttctaatgttgctt

SEQ ID NO: 672848 - DNA, 25 bp, Homo sapien
gttgcttatcattgtttgttccatt

SEQ ID NO: 672849 - DNA, 25 bp, Homo sapien
tatcattgtttgttccatttcagtt

SEQ ID NO: 672850 - DNA, 25 bp, Homo sapien
gaaatcagaaagtgtaagccctcca

SEQ ID NO: 672851 - DNA, 25 bp, Homo sapien
cagaaagtgtaagccctccaacttt

SEQ ID NO: 672852 - DNA, 25 bp, Homo sapien
gattgttttgactgtttctgtccct

SEQ ID NO: 672853 - DNA, 25 bp, Homo sapien
ttttgactgtttctgtcccttgaga

SEQ ID NO: 672854 - DNA, 25 bp, Homo sapien
gactgtttctgtcccttgagattcc

SEQ ID NO: 672855 - DNA, 25 bp, Homo sapien
attttgatagggatggccttgaatc

SEQ ID NO: 672856 - DNA, 25 bp, Homo sapien
atagggatggccttgaatctgtata

SEQ ID NO: 672857 - DNA, 25 bp, Homo sapien
aacaatagtgagtcttctaatcagt

SEQ ID NO: 672858 - DNA, 25 bp, Homo sapien
agtgagtcttctaatcagtgaacag

SEQ ID NO: 672859 - DNA, 25 bp, Homo sapien
agtgaacagaggatgtctttccatt

SEQ ID NO: 672860 - DNA, 25 bp, Homo sapien
tgtgtctgtaatttccttcatcaac

SEQ ID NO: 672861 - DNA, 25 bp, Homo sapien
atgcccaacagaaaggtcaagctaa

SEQ ID NO: 672862 - DNA, 25 bp, Homo sapien
aaaggtcaagctaaccacactgcgc

SEQ ID NO: 672863 - DNA, 25 bp, Homo sapien
tcaagctaaccacactgcgcaagtt

SEQ ID NO: 672864 - DNA, 25 bp, Homo sapien
actgcgcaagttccttaacacttct

SEQ ID NO: 672865 - DNA, 25 bp, Homo sapien
ttaacacttcttctctcagggtccc

SEQ ID NO: 672866 - DNA, 25 bp, Homo sapien
acttcttctctcagggtcccggttg

SEQ ID NO: 672867 - DNA, 25 bp, Homo sapien
agggtcccggttgcttctcttgcca

SEQ ID NO: 672868 - DNA, 25 bp, Homo sapien
agatcttgccccttaccacaatgaa

SEQ ID NO: 672869 - DNA, 25 bp, Homo sapien
ttgccccttaccacaatgaacatgg

SEQ ID NO: 672870 - DNA, 25 bp, Homo sapien
atgaacatgggcaatggtccaaaaa

SEQ ID NO: 672871 - DNA, 25 bp, Homo sapien
aacatgaactcccaaaatacccagc

SEQ ID NO: 672872 - DNA, 25 bp, Homo sapien
ttattgagcaccttttgtgggcagg

SEQ ID NO: 672873 - DNA, 25 bp, Homo sapien
tgtgggcagggactcttctaagtta

SEQ ID NO: 672874 - DNA, 25 bp, Homo sapien
gtgggcagggactcttctaagttat

SEQ ID NO: 672875 - DNA, 25 bp, Homo sapien
gggcagggactcttctaagttatgt

SEQ ID NO: 672876 - DNA, 25 bp, Homo sapien
gcagggactcttctaagttatgttc

SEQ ID NO: 672877 - DNA, 25 bp, Homo sapien
cagggactcttctaagttatgttcc

SEQ ID NO: 672878 - DNA, 25 bp, Homo sapien
ctaagttatgttcctcaagtagatt

SEQ ID NO: 672879 - DNA, 25 bp, Homo sapien
aagttatgttcctcaagtagattat

SEQ ID NO: 672880 - DNA, 25 bp, Homo sapien
gttatgttcctcaagtagattatat

SEQ ID NO: 672881 - DNA, 25 bp, Homo sapien
atgttcctcaagtagattatataaa

SEQ ID NO: 672882 - DNA, 25 bp, Homo sapien
cgaggcacgtggttcacctgaagtc

SEQ ID NO: 672883 - DNA, 25 bp, Homo sapien
aacagctactgtaaacattctcata

SEQ ID NO: 672884 - DNA, 25 bp, Homo sapien
gtaaacattctcatacaagatttta

SEQ ID NO: 672885 - DNA, 25 bp, Homo sapien
gattttatgagatcacatgttttca

SEQ ID NO: 672886 - DNA, 25 bp, Homo sapien
tttctcttgggtaaacagctaggat

SEQ ID NO: 672887 - DNA, 25 bp, Homo sapien
gtaaacagctaggattggaatggat

SEQ ID NO: 672888 - DNA, 25 bp, Homo sapien
tttaatctaagaaactgccatggct

SEQ ID NO: 672889 - DNA, 25 bp, Homo sapien
aatctaagaaactgccatggctggg

SEQ ID NO: 672890 - DNA, 25 bp, Homo sapien
aaggaggatgactagagcctctgag

SEQ ID NO: 672891 - DNA, 25 bp, Homo sapien
gactagagcctctgaggtgaagacc

SEQ ID NO: 672892 - DNA, 25 bp, Homo sapien
gcctgggcaaagtggttaagactca

SEQ ID NO: 672893 - DNA, 25 bp, Homo sapien
caaagtggttaagactcaaccgcaa

SEQ ID NO: 672894 - DNA, 25 bp, Homo sapien
tcaacatttacccactttgtgaatg

SEQ ID NO: 672895 - DNA, 25 bp, Homo sapien
cactttgtgaatgggctgcctgccc

SEQ ID NO: 672896 - DNA, 25 bp, Homo sapien
tgcctgccctgtagttagctgcgag

SEQ ID NO: 672897 - DNA, 25 bp, Homo sapien
gtagttagctgcgaggtctcccaaa

SEQ ID NO: 672898 - DNA, 25 bp, Homo sapien
gaggtctcccaaagttccagccgtt

SEQ ID NO: 672899 - DNA, 25 bp, Homo sapien
agccgttaaccaacatcctgagtag

SEQ ID NO: 672900 - DNA, 25 bp, Homo sapien
tgagtagtttagaagcctctcctcc

SEQ ID NO: 672901 - DNA, 25 bp, Homo sapien
tagcacttaacctgctgttggcctt

SEQ ID NO: 672902 - DNA, 25 bp, Homo sapien
taacctgctgttggcctttgattct

SEQ ID NO: 672903 - DNA, 25 bp, Homo sapien
ttcttcctcaagagtttgcctttgc

SEQ ID NO: 672904 - DNA, 25 bp, Homo sapien
tttgcccttgagctgagatttctgt

SEQ ID NO: 672905 - DNA, 25 bp, Homo sapien
gggacgggctacctgtggagagcag

SEQ ID NO: 672906 - DNA, 25 bp, Homo sapien
ctacctgtggagagcagaaggcact

SEQ ID NO: 672907 - DNA, 25 bp, Homo sapien
gtctgggtgggcagcttgacctcca

SEQ ID NO: 672908 - DNA, 25 bp, Homo sapien
ggtgggcagcttgacctccaggctt

SEQ ID NO: 672909 - DNA, 25 bp, Homo sapien
tgggcagcttgacctccaggctttc

SEQ ID NO: 672910 - DNA, 25 bp, Homo sapien
ggcagcttgacctccaggctttcct

SEQ ID NO: 672911 - DNA, 25 bp, Homo sapien
tcctgctacaccagggaccaggaca

SEQ ID NO: 672912 - DNA, 25 bp, Homo sapien
aggacagcgggcactcccttgtgtt

SEQ ID NO: 672913 - DNA, 25 bp, Homo sapien
acagcgggcactcccttgtgttaaa

SEQ ID NO: 672914 - DNA, 25 bp, Homo sapien
agcgggcactcccttgtgttaaaat

SEQ ID NO: 672915 - DNA, 25 bp, Homo sapien
gcgggcactcccttgtgttaaaata

SEQ ID NO: 672916 - DNA, 25 bp, Homo sapien
gcatcctctccactatcttcaggat

SEQ ID NO: 672917 - DNA, 25 bp, Homo sapien
tatcttcaggatgccgtcagctgag

SEQ ID NO: 672918 - DNA, 25 bp, Homo sapien
gaaacatcaggcattctccacctgt

SEQ ID NO: 672919 - DNA, 25 bp, Homo sapien
tgttccgcccacctcttggttgtct

SEQ ID NO: 672920 - DNA, 25 bp, Homo sapien
tatagcactgccatcctcacgtatt

SEQ ID NO: 672921 - DNA, 25 bp, Homo sapien
acgtatttccgaccccaatccagtg

SEQ ID NO: 672922 - DNA, 25 bp, Homo sapien
cccatcatctacagctcaaggaata

SEQ ID NO: 672923 - DNA, 25 bp, Homo sapien
gaaggctgcactgaagcggcttatc

SEQ ID NO: 672924 - DNA, 25 bp, Homo sapien
actgaagcggcttatccacaggacc

SEQ ID NO: 672925 - DNA, 25 bp, Homo sapien
agcggcttatccacaggaccctggg

SEQ ID NO: 672926 - DNA, 25 bp, Homo sapien
gaccctgggctctcagaaactatga

SEQ ID NO: 672927 - DNA, 25 bp, Homo sapien
ggccttcttcgagttggtcacctga

SEQ ID NO: 672928 - DNA, 25 bp, Homo sapien
ggtcacctgagcctattattgacgg

SEQ ID NO: 672929 - DNA, 25 bp, Homo sapien
attattgacggtttggctgtcctcc

SEQ ID NO: 672930 - DNA, 25 bp, Homo sapien
catttgtcaaacaagagccccggaa

SEQ ID NO: 672931 - DNA, 25 bp, Homo sapien
agaaccatgagcagtcgcggtgcct

SEQ ID NO: 672932 - DNA, 25 bp, Homo sapien
cggtgcctctattattttcccagga

SEQ ID NO: 672933 - DNA, 25 bp, Homo sapien
attttcccaggacgattgctctttt

SEQ ID NO: 672934 - DNA, 25 bp, Homo sapien
agaagcaattctcacagatcctcct

SEQ ID NO: 672935 - DNA, 25 bp, Homo sapien
agatcctcctcaacatgaagggtgt

SEQ ID NO: 672936 - DNA, 25 bp, Homo sapien
cagggtccctgcagatttggctgga

SEQ ID NO: 672937 - DNA, 25 bp, Homo sapien
agatttggctggagctccagacctc

SEQ ID NO: 672938 - DNA, 25 bp, Homo sapien
attgctttagaaaaggtactgtatg

SEQ ID NO: 672939 - DNA, 25 bp, Homo sapien
tgctttagaaaaggtactgtatgta

SEQ ID NO: 672940 - DNA, 25 bp, Homo sapien
gctttagaaaaggtactgtatgtaa

SEQ ID NO: 672941 - DNA, 25 bp, Homo sapien
ctttagaaaaggtactgtatgtaat

SEQ ID NO: 672942 - DNA, 25 bp, Homo sapien
tttcttccttgaaaatcacattttt

SEQ ID NO: 672943 - DNA, 25 bp, Homo sapien
ttcttccttgaaaatcacatttttg

SEQ ID NO: 672944 - DNA, 25 bp, Homo sapien
tcttccttgaaaatcacatttttga

SEQ ID NO: 672945 - DNA, 25 bp, Homo sapien
cttccttgaaaatcacatttttgaa

SEQ ID NO: 672946 - DNA, 25 bp, Homo sapien
gctggaagtaaaacagacaaccaaa

SEQ ID NO: 672947 - DNA, 25 bp, Homo sapien
ctggaagtaaaacagacaaccaaat

SEQ ID NO: 672948 - DNA, 25 bp, Homo sapien
tggaagtaaaacagacaaccaaata

SEQ ID NO: 672949 - DNA, 25 bp, Homo sapien
cagagcaaatcagagtgttccggaa

SEQ ID NO: 672950 - DNA, 25 bp, Homo sapien
gagtgttccggaagatcttgtagta

SEQ ID NO: 672951 - DNA, 25 bp, Homo sapien
aagatcttgtagtaatggctgagca

SEQ ID NO: 672952 - DNA, 25 bp, Homo sapien
atggctgagcaatacaagttaaatc

SEQ ID NO: 672953 - DNA, 25 bp, Homo sapien
ggcacagagaaacacgatcaagaaa

SEQ ID NO: 672954 - DNA, 25 bp, Homo sapien
aagaaaacctggacaaagacgcaag

SEQ ID NO: 672955 - DNA, 25 bp, Homo sapien
gacaaagacgcaaggagttttattt

SEQ ID NO: 672956 - DNA, 25 bp, Homo sapien
gttgaaaagttgtaccaggctactg

SEQ ID NO: 672957 - DNA, 25 bp, Homo sapien
gtaccaggctactggaagattccag

SEQ ID NO: 672958 - DNA, 25 bp, Homo sapien
aagattccaggcatgttaaagatat

SEQ ID NO: 672959 - DNA, 25 bp, Homo sapien
ggaaacatactagccatttgaagac

SEQ ID NO: 672960 - DNA, 25 bp, Homo sapien
acgggacgcggcaggcttctcagtc

SEQ ID NO: 672961 - DNA, 25 bp, Homo sapien
acgcggcaggcttctcagtctctgt

SEQ ID NO: 672962 - DNA, 25 bp, Homo sapien
cagtctctgtccgagacagccggga

SEQ ID NO: 672963 - DNA, 25 bp, Homo sapien
tctctgtccgagacagccgggagga

SEQ ID NO: 672964 - DNA, 25 bp, Homo sapien
agagctgggctttcctctgtgacca

SEQ ID NO: 672965 - DNA, 25 bp, Homo sapien
atcccggcctgtaacatatctgtaa

SEQ ID NO: 672966 - DNA, 25 bp, Homo sapien
gagcgggctcgaagaaaataattct

SEQ ID NO: 672967 - DNA, 25 bp, Homo sapien
ttatttttattaccaagcgcttctt

SEQ ID NO: 672968 - DNA, 25 bp, Homo sapien
tattaccaagcgcttctttctgact

SEQ ID NO: 672969 - DNA, 25 bp, Homo sapien
aagcgcttctttctgactctaaaat

SEQ ID NO: 672970 - DNA, 25 bp, Homo sapien
gcgcttctttctgactctaaaatat

SEQ ID NO: 672971 - DNA, 25 bp, Homo sapien
gtgcccactgtggtctacgccgagg

SEQ ID NO: 672972 - DNA, 25 bp, Homo sapien
gcccactgtggtctacgccgaggct

SEQ ID NO: 672973 - DNA, 25 bp, Homo sapien
cactgtggtctacgccgaggctccc

SEQ ID NO: 672974 - DNA, 25 bp, Homo sapien
tccctgccccaagcaataatgaaca

SEQ ID NO: 672975 - DNA, 25 bp, Homo sapien
aatgaacaagatcttcattctctga

SEQ ID NO: 672976 - DNA, 25 bp, Homo sapien
tctctgaagagaagtgcaatagtaa

SEQ ID NO: 672977 - DNA, 25 bp, Homo sapien
tggtgttaatgggtcaggcaggcaa

SEQ ID NO: 672978 - DNA, 25 bp, Homo sapien
ttaatgggtcaggcaggcaaggcat

SEQ ID NO: 672979 - DNA, 25 bp, Homo sapien
atgggtcaggcaggcaaggcatgaa

SEQ ID NO: 672980 - DNA, 25 bp, Homo sapien
caaggcatgaagtgataaataggga

SEQ ID NO: 672981 - DNA, 25 bp, Homo sapien
gatgaaagaagggaacaaacccagg

SEQ ID NO: 672982 - DNA, 25 bp, Homo sapien
tggaggcccacattaaagccctcaa

SEQ ID NO: 672983 - DNA, 25 bp, Homo sapien
ttaaagccctcaagtctcttgtctc

SEQ ID NO: 672984 - DNA, 25 bp, Homo sapien
ttctgcttctttgtgatatcatcct

SEQ ID NO: 672985 - DNA, 25 bp, Homo sapien
atatcatcctgtgttgccttcatct

SEQ ID NO: 672986 - DNA, 25 bp, Homo sapien
cctactgattctgtggcgcgacaaa

SEQ ID NO: 672987 - DNA, 25 bp, Homo sapien
ggataatggcagcttgtccctctgg

SEQ ID NO: 672988 - DNA, 25 bp, Homo sapien
tgggcatgcagccatcctgatctca

SEQ ID NO: 672989 - DNA, 25 bp, Homo sapien
ctgatctcaggcaatgccaagttga

SEQ ID NO: 672990 - DNA, 25 bp, Homo sapien
tgaggagagctgtgatgaccattct

SEQ ID NO: 672991 - DNA, 25 bp, Homo sapien
tgtgatgaccattctgctctgggct

SEQ ID NO: 672992 - DNA, 25 bp, Homo sapien
gcctgaaggtaagagccgaccacaa

SEQ ID NO: 672993 - DNA, 25 bp, Homo sapien
ttagctgcctggtttccggctgcca

SEQ ID NO: 672994 - DNA, 25 bp, Homo sapien
cctcctgcgaaagcatctctgagaa

SEQ ID NO: 672995 - DNA, 25 bp, Homo sapien
gtgtgtcagaagttgctgcctcgac

SEQ ID NO: 672996 - DNA, 25 bp, Homo sapien
cctccccagtgcaagacgacataga

SEQ ID NO: 672997 - DNA, 25 bp, Homo sapien
aagacgacatagactccatccttgt

SEQ ID NO: 672998 - DNA, 25 bp, Homo sapien
agactccatccttgttcagtgtggg

SEQ ID NO: 672999 - DNA, 25 bp, Homo sapien
gggccgccagccagctgaaagacat

SEQ ID NO: 673000 - DNA, 25 bp, Homo sapien
gaaagacatcttgaggcccctgaga

SEQ ID NO: 673001 - DNA, 25 bp, Homo sapien
ttgaggcccctgagaacgtgtgact

SEQ ID NO: 673002 - DNA, 25 bp, Homo sapien
gaacgtgtgactccagatttgccta

SEQ ID NO: 673003 - DNA, 25 bp, Homo sapien
agatttgcctatcgttacccagatt

SEQ ID NO: 673004 - DNA, 25 bp, Homo sapien
tttagatgtttcaacaactccatga

SEQ ID NO: 673005 - DNA, 25 bp, Homo sapien
gaagaacaaatgactttaggatttt

SEQ ID NO: 673006 - DNA, 25 bp, Homo sapien
ggattttgtagagttttaattgcag

SEQ ID NO: 673007 - DNA, 25 bp, Homo sapien
cagttggaagagttgctaatacaga

SEQ ID NO: 673008 - DNA, 25 bp, Homo sapien
gagttgctaatacagaatcctttaa

SEQ ID NO: 673009 - DNA, 25 bp, Homo sapien
aaatccaaatcaatcagttaaagtt

SEQ ID NO: 673010 - DNA, 25 bp, Homo sapien
cagttaaagttgatcacagaaataa

SEQ ID NO: 673011 - DNA, 25 bp, Homo sapien
atgcaattggtgatgtaactggttc

SEQ ID NO: 673012 - DNA, 25 bp, Homo sapien
taactggttcaatgatgctttcttc

SEQ ID NO: 673013 - DNA, 25 bp, Homo sapien
tgctttcttcaattgcatataaaca

SEQ ID NO: 673014 - DNA, 25 bp, Homo sapien
acaaggtgatatagttgcaaaagac

SEQ ID NO: 673015 - DNA, 25 bp, Homo sapien
cttcaatcccagtgctgcaatcaca

SEQ ID NO: 673016 - DNA, 25 bp, Homo sapien
ggaccctggagcctacttgtgcgct

SEQ ID NO: 673017 - DNA, 25 bp, Homo sapien
ggagcctacttgtgcgctttgcatt

SEQ ID NO: 673018 - DNA, 25 bp, Homo sapien
gtgcgctttgcatttcattgattga

SEQ ID NO: 673019 - DNA, 25 bp, Homo sapien
tgcatttcattgattgacgcctccc

SEQ ID NO: 673020 - DNA, 25 bp, Homo sapien
ttgacgcctcccttcaacaagcatt

SEQ ID NO: 673021 - DNA, 25 bp, Homo sapien
gcgcctactatgtactaatgctaga

SEQ ID NO: 673022 - DNA, 25 bp, Homo sapien
gaagacagttttcatcctctaggaa

SEQ ID NO: 673023 - DNA, 25 bp, Homo sapien
catcctctaggaactcataggctaa

SEQ ID NO: 673024 - DNA, 25 bp, Homo sapien
tcataggctaatggtgagacacaca

SEQ ID NO: 673025 - DNA, 25 bp, Homo sapien
gacacacagacaaacatcattataa

SEQ ID NO: 673026 - DNA, 25 bp, Homo sapien
ttgcccacgccgctgttgctgctga

SEQ ID NO: 673027 - DNA, 25 bp, Homo sapien
tgactccaaggtctgctcggatatt

SEQ ID NO: 673028 - DNA, 25 bp, Homo sapien
tcggatattggacagaggacatgca

SEQ ID NO: 673029 - DNA, 25 bp, Homo sapien
ggacatgcagagatgcgacacccac

SEQ ID NO: 673030 - DNA, 25 bp, Homo sapien
tgcagagatgcgacacccacttaaa

SEQ ID NO: 673031 - DNA, 25 bp, Homo sapien
gcgacacccacttaaactcgaagtt

SEQ ID NO: 673032 - DNA, 25 bp, Homo sapien
taaactcgaagttgcaaagatgcaa

SEQ ID NO: 673033 - DNA, 25 bp, Homo sapien
acccatgggcacgtggcttttggga

SEQ ID NO: 673034 - DNA, 25 bp, Homo sapien
gctgccacagatctctgaagagtct

SEQ ID NO: 673035 - DNA, 25 bp, Homo sapien
cagatctctgaagagtctggacctg

SEQ ID NO: 673036 - DNA, 25 bp, Homo sapien
tgggtctccccgagtgactgtctgg

SEQ ID NO: 673037 - DNA, 25 bp, Homo sapien
aattcaaagctctaatggacctttt

SEQ ID NO: 673038 - DNA, 25 bp, Homo sapien
ttcaaagctctaatggacctttttg

SEQ ID NO: 673039 - DNA, 25 bp, Homo sapien
aagctctaatggacctttttgaaga

SEQ ID NO: 673040 - DNA, 25 bp, Homo sapien
ctaatggacctttttgaagagaagt

SEQ ID NO: 673041 - DNA, 25 bp, Homo sapien
acctttttgaagagaagttgtggct

SEQ ID NO: 673042 - DNA, 25 bp, Homo sapien
aagttgtggcttatgtggagtttac

SEQ ID NO: 673043 - DNA, 25 bp, Homo sapien
tatgtggagtttacatgggcctctg

SEQ ID NO: 673044 - DNA, 25 bp, Homo sapien
tacatgggcctctgatggaagaaag

SEQ ID NO: 673045 - DNA, 25 bp, Homo sapien
atgggcctctgatggaagaaagcta

SEQ ID NO: 673046 - DNA, 25 bp, Homo sapien
gcctctgatggaagaaagctaatct

SEQ ID NO: 673047 - DNA, 25 bp, Homo sapien
ggaagaaagctaatctgtttagtat

SEQ ID NO: 673048 - DNA, 25 bp, Homo sapien
tcacgcttgaactccctgatgtttt

SEQ ID NO: 673049 - DNA, 25 bp, Homo sapien
tgagcctgccttggctctgagacca

SEQ ID NO: 673050 - DNA, 25 bp, Homo sapien
gagaccaaggtggtgtggctgctct

SEQ ID NO: 673051 - DNA, 25 bp, Homo sapien
gaataagggtccctgtgcccattgt

SEQ ID NO: 673052 - DNA, 25 bp, Homo sapien
aagggtccctgtgcccattgtctgg

SEQ ID NO: 673053 - DNA, 25 bp, Homo sapien
cattgtctggagctgggaacctgcc

SEQ ID NO: 673054 - DNA, 25 bp, Homo sapien
tgccccaaggctactgctgcaagaa

SEQ ID NO: 673055 - DNA, 25 bp, Homo sapien
gcaagaagagactgtgccctccgag

SEQ ID NO: 673056 - DNA, 25 bp, Homo sapien
tccgaggccagcactccaacggagg

SEQ ID NO: 673057 - DNA, 25 bp, Homo sapien
gggctgcagcatgccacttcaggca

SEQ ID NO: 673058 - DNA, 25 bp, Homo sapien
acttcaggcaacagaagcccctgct

SEQ ID NO: 673059 - DNA, 25 bp, Homo sapien
aataacatcctatctatttccccac

SEQ ID NO: 673060 - DNA, 25 bp, Homo sapien
atttccccacataattatgcagcta

SEQ ID NO: 673061 - DNA, 25 bp, Homo sapien
atgcagctaatcctggccctctctg

SEQ ID NO: 673062 - DNA, 25 bp, Homo sapien
tggccctctctgacaatcttgagaa

SEQ ID NO: 673063 - DNA, 25 bp, Homo sapien
aaaaattccagctttcatcattcga

SEQ ID NO: 673064 - DNA, 25 bp, Homo sapien
tcatcattcgaattcctggcttgaa

SEQ ID NO: 673065 - DNA, 25 bp, Homo sapien
aaagctcctcttgaatagaactctg

SEQ ID NO: 673066 - DNA, 25 bp, Homo sapien
tgaatagaactctgtcccactgact

SEQ ID NO: 673067 - DNA, 25 bp, Homo sapien
catcacccttttttctactgtttca

SEQ ID NO: 673068 - DNA, 25 bp, Homo sapien
actgtttcaaggttctcagatgaga

SEQ ID NO: 673069 - DNA, 25 bp, Homo sapien
tttcttccaggataatactatttgt

SEQ ID NO: 673070 - DNA, 25 bp, Homo sapien
aatcacaataaataaataggtcaat

SEQ ID NO: 673071 - DNA, 25 bp, Homo sapien
atcacaataaataaataggtcaata

SEQ ID NO: 673072 - DNA, 25 bp, Homo sapien
taggtcaatacaaatgttggccagg

SEQ ID NO: 673073 - DNA, 25 bp, Homo sapien
aggtcaatacaaatgttggccaggc

SEQ ID NO: 673074 - DNA, 25 bp, Homo sapien
ggtcaatacaaatgttggccaggcg

SEQ ID NO: 673075 - DNA, 25 bp, Homo sapien
acatgcccatagtcgcagctactct

SEQ ID NO: 673076 - DNA, 25 bp, Homo sapien
catgcccatagtcgcagctactctg

SEQ ID NO: 673077 - DNA, 25 bp, Homo sapien
atgcccatagtcgcagctactctgg

SEQ ID NO: 673078 - DNA, 25 bp, Homo sapien
tgcccatagtcgcagctactctgga

SEQ ID NO: 673079 - DNA, 25 bp, Homo sapien
acttgagcccatgaatttgaggcag

SEQ ID NO: 673080 - DNA, 25 bp, Homo sapien
tctctaaataaataggtcaaaccct

SEQ ID NO: 673081 - DNA, 25 bp, Homo sapien
ggatgattcaggttgccagagacag

SEQ ID NO: 673082 - DNA, 25 bp, Homo sapien
agacagaaccctcagcttagcatgg

SEQ ID NO: 673083 - DNA, 25 bp, Homo sapien
aagtagcttccctgttgaccctgag

SEQ ID NO: 673084 - DNA, 25 bp, Homo sapien
gttgaccctgagttcatctgaggtt

SEQ ID NO: 673085 - DNA, 25 bp, Homo sapien
gagttcatctgaggttggcttggaa

SEQ ID NO: 673086 - DNA, 25 bp, Homo sapien
gtgtgggcaccatttggcccagttc

SEQ ID NO: 673087 - DNA, 25 bp, Homo sapien
gggctgagcagggaagacaactttc

SEQ ID NO: 673088 - DNA, 25 bp, Homo sapien
ggaagacaactttccattgaaggcc

SEQ ID NO: 673089 - DNA, 25 bp, Homo sapien
ttgaaggcccctttcagggccagaa

SEQ ID NO: 673090 - DNA, 25 bp, Homo sapien
tgagagtcaggcgacctcatgccaa

SEQ ID NO: 673091 - DNA, 25 bp, Homo sapien
tcaggcgacctcatgccaagtgtag

SEQ ID NO: 673092 - DNA, 25 bp, Homo sapien
ttttgaaatgccactccctaaaaag

SEQ ID NO: 673093 - DNA, 25 bp, Homo sapien
aaaggctgcatcaatttgtaatgtc

SEQ ID NO: 673094 - DNA, 25 bp, Homo sapien
gcatcaatttgtaatgtcattagca

SEQ ID NO: 673095 - DNA, 25 bp, Homo sapien
gtcattagcaatgtgtgataggtct

SEQ ID NO: 673096 - DNA, 25 bp, Homo sapien
gataggtctagttttatcaaacctt

SEQ ID NO: 673097 - DNA, 25 bp, Homo sapien
gttttatcaaacctttgtcatgtat

SEQ ID NO: 673098 - DNA, 25 bp, Homo sapien
agttctaagtttttgcttacttgat

SEQ ID NO: 673099 - DNA, 25 bp, Homo sapien
tgcttacttgattagtaggactaac

SEQ ID NO: 673100 - DNA, 25 bp, Homo sapien
agtaggactaacgaatattttgaat

SEQ ID NO: 673101 - DNA, 25 bp, Homo sapien
cttttttctttgagacctgagtctc

SEQ ID NO: 673102 - DNA, 25 bp, Homo sapien
agacctgagtctcacactctagcct

SEQ ID NO: 673103 - DNA, 25 bp, Homo sapien
gtatatgttatcttccatgttttta

SEQ ID NO: 673104 - DNA, 25 bp, Homo sapien
gagtattcaagctttttgtctctat

SEQ ID NO: 673105 - DNA, 25 bp, Homo sapien
caagctttttgtctctatatttaca

SEQ ID NO: 673106 - DNA, 25 bp, Homo sapien
aagatcttgatcaatgcatgcacat

SEQ ID NO: 673107 - DNA, 25 bp, Homo sapien
atgcacattatgaaattgtactaaa

SEQ ID NO: 673108 - DNA, 25 bp, Homo sapien
gtactaaatgcttaaggtcctgacc

SEQ ID NO: 673109 - DNA, 25 bp, Homo sapien
aaggtcctgacctgatacactactc

SEQ ID NO: 673110 - DNA, 25 bp, Homo sapien
tgacctgatacactactcgtccatt

SEQ ID NO: 673111 - DNA, 25 bp, Homo sapien
acactactcgtccattgtaccagaa

SEQ ID NO: 673112 - DNA, 25 bp, Homo sapien
tactcgtccattgtaccagaagttc

SEQ ID NO: 673113 - DNA, 25 bp, Homo sapien
tgtaccagaagttccatgtcccttg

SEQ ID NO: 673114 - DNA, 25 bp, Homo sapien
ggctgtgaaactgaggcaccgttcc

SEQ ID NO: 673115 - DNA, 25 bp, Homo sapien
gaaactgaggcaccgttcctagaca

SEQ ID NO: 673116 - DNA, 25 bp, Homo sapien
gttcctagacatctcggtgctgtgt

SEQ ID NO: 673117 - DNA, 25 bp, Homo sapien
atctcggtgctgtgtcgttcattca

SEQ ID NO: 673118 - DNA, 25 bp, Homo sapien
gtgctgtgtcgttcattcaaggaga

SEQ ID NO: 673119 - DNA, 25 bp, Homo sapien
agttgagatacagtgaaatgagcca

SEQ ID NO: 673120 - DNA, 25 bp, Homo sapien
cctggcgccagggaaaattctggtt

SEQ ID NO: 673121 - DNA, 25 bp, Homo sapien
aattctggttattcaccacttctac

SEQ ID NO: 673122 - DNA, 25 bp, Homo sapien
gctccctgcagaggatgctcgtttt

SEQ ID NO: 673123 - DNA, 25 bp, Homo sapien
ggatgctcgttttgcagagaaggca

SEQ ID NO: 673124 - DNA, 25 bp, Homo sapien
aggcagtgttcctctattcccttct

SEQ ID NO: 673125 - DNA, 25 bp, Homo sapien
tctgctgtcaagatctctcctctgc

SEQ ID NO: 673126 - DNA, 25 bp, Homo sapien
tcctctgctcttatctgcaacaaaa

SEQ ID NO: 673127 - DNA, 25 bp, Homo sapien
tctgacacagaataccttaggatat

SEQ ID NO: 673128 - DNA, 25 bp, Homo sapien
taaagtcttgaagtctcctaagtgt

SEQ ID NO: 673129 - DNA, 25 bp, Homo sapien
gaagtctcctaagtgtaaactacaa

SEQ ID NO: 673130 - DNA, 25 bp, Homo sapien
gtaaactacaagttctagggttgtg

SEQ ID NO: 673131 - DNA, 25 bp, Homo sapien
tctagggttgtgcaaagaggcattt

SEQ ID NO: 673132 - DNA, 25 bp, Homo sapien
agaggcatttgatgaggaagcccag

SEQ ID NO: 673133 - DNA, 25 bp, Homo sapien
ggaagctgtgggagttagcaatcca

SEQ ID NO: 673134 - DNA, 25 bp, Homo sapien
gggagttagcaatccacacttaatc

SEQ ID NO: 673135 - DNA, 25 bp, Homo sapien
agccagattgtaactatcataatga

SEQ ID NO: 673136 - DNA, 25 bp, Homo sapien
ggatgtccggagaatataccaactc

SEQ ID NO: 673137 - DNA, 25 bp, Homo sapien
actccgtgagcatttcggtcatcaa

SEQ ID NO: 673138 - DNA, 25 bp, Homo sapien
agcatttcggtcatcaacagctcca

SEQ ID NO: 673139 - DNA, 25 bp, Homo sapien
atcaacagctccatggccgggatgg

SEQ ID NO: 673140 - DNA, 25 bp, Homo sapien
ctccatggccgggatggcaggcaca

SEQ ID NO: 673141 - DNA, 25 bp, Homo sapien
ctggctttggattcagcaatgctgg

SEQ ID NO: 673142 - DNA, 25 bp, Homo sapien
attcagcaatgctggcacctacggc

SEQ ID NO: 673143 - DNA, 25 bp, Homo sapien
aatgctggcacctacggctactggc

SEQ ID NO: 673144 - DNA, 25 bp, Homo sapien
cactggcagtgggaactgtagcccc

SEQ ID NO: 673145 - DNA, 25 bp, Homo sapien
gcaagtgaattcagggactcccagg

SEQ ID NO: 673146 - DNA, 25 bp, Homo sapien
tcagggactcccagggaaagacctt

SEQ ID NO: 673147 - DNA, 25 bp, Homo sapien
acggcctgacgggagttgcagtctc

SEQ ID NO: 673148 - DNA, 25 bp, Homo sapien
ggagttgcagtctcccggctcccgt

SEQ ID NO: 673149 - DNA, 25 bp, Homo sapien
tcccgtctatcatctcaagtcgaga

SEQ ID NO: 673150 - DNA, 25 bp, Homo sapien
tatcatctcaagtcgagacaatgga

SEQ ID NO: 673151 - DNA, 25 bp, Homo sapien
actgcgacatgggatgtgtagtcca

SEQ ID NO: 673152 - DNA, 25 bp, Homo sapien
gatgtgtagtccaggcgtctggcct

SEQ ID NO: 673153 - DNA, 25 bp, Homo sapien
ggcctcttccctgcggaaatgaggg

SEQ ID NO: 673154 - DNA, 25 bp, Homo sapien
gaaatgagggagaggactacgaaaa

SEQ ID NO: 673155 - DNA, 25 bp, Homo sapien
tacgaaaaagatggcgacctcgccc

SEQ ID NO: 673156 - DNA, 25 bp, Homo sapien
aaaagatggcgacctcgcccctcga

SEQ ID NO: 673157 - DNA, 25 bp, Homo sapien
ctctgcgccggtgcctgctgggaaa

SEQ ID NO: 673158 - DNA, 25 bp, Homo sapien
gaattcacaaaaaacaatagcctca

SEQ ID NO: 673159 - DNA, 25 bp, Homo sapien
aattcacaaaaaacaatagcctcat

SEQ ID NO: 673160 - DNA, 25 bp, Homo sapien
attcacaaaaaacaatagcctcatc

SEQ ID NO: 673161 - DNA, 25 bp, Homo sapien
tacgcctaatctactccacctcaat

SEQ ID NO: 673162 - DNA, 25 bp, Homo sapien
acgcctaatctactccacctcaatc

SEQ ID NO: 673163 - DNA, 25 bp, Homo sapien
gcctaatctactccacctcaatcac

SEQ ID NO: 673164 - DNA, 25 bp, Homo sapien
cctaatctactccacctcaatcaca

SEQ ID NO: 673165 - DNA, 25 bp, Homo sapien
taatctactccacctcaatcacact

SEQ ID NO: 673166 - DNA, 25 bp, Homo sapien
aatctactccacctcaatcacacta

SEQ ID NO: 673167 - DNA, 25 bp, Homo sapien
acctcaatcacactactccccatat

SEQ ID NO: 673168 - DNA, 25 bp, Homo sapien
tactccccatatctaacaacgtaaa

SEQ ID NO: 673169 - DNA, 25 bp, Homo sapien
gccatggatgaaggctcagaagcat

SEQ ID NO: 673170 - DNA, 25 bp, Homo sapien
ccatggatgaaggctcagaagcatc

SEQ ID NO: 673171 - DNA, 25 bp, Homo sapien
catggatgaaggctcagaagcatcc

SEQ ID NO: 673172 - DNA, 25 bp, Homo sapien
atggatgaaggctcagaagcatcct

SEQ ID NO: 673173 - DNA, 25 bp, Homo sapien
tggatgaaggctcagaagcatcctc

SEQ ID NO: 673174 - DNA, 25 bp, Homo sapien
ggatgaaggctcagaagcatcctcc

SEQ ID NO: 673175 - DNA, 25 bp, Homo sapien
gatgaaggctcagaagcatcctcct

SEQ ID NO: 673176 - DNA, 25 bp, Homo sapien
ggctcagaagcatcctcctgctcat

SEQ ID NO: 673177 - DNA, 25 bp, Homo sapien
agcccctttccctgctgtgtggatt

SEQ ID NO: 673178 - DNA, 25 bp, Homo sapien
ttccctgctgtgtggattaggtgtc

SEQ ID NO: 673179 - DNA, 25 bp, Homo sapien
tgctgtgtggattaggtgtcaagac

SEQ ID NO: 673180 - DNA, 25 bp, Homo sapien
tttttccccatggttaccgctgaga

SEQ ID NO: 673181 - DNA, 25 bp, Homo sapien
ttccccatggttaccgctgagatac

SEQ ID NO: 673182 - DNA, 25 bp, Homo sapien
ccatggttaccgctgagatactggg

SEQ ID NO: 673183 - DNA, 25 bp, Homo sapien
ggctgtagtagtataaaagctcaca

SEQ ID NO: 673184 - DNA, 25 bp, Homo sapien
tcacagttccttctgagtgctgaaa

SEQ ID NO: 673185 - DNA, 25 bp, Homo sapien
aagagtgcatgagttgcttcgaaat

SEQ ID NO: 673186 - DNA, 25 bp, Homo sapien
gagttgcttcgaaataaaagggtca

SEQ ID NO: 673187 - DNA, 25 bp, Homo sapien
gaaataaaagggtcaagcattccca

SEQ ID NO: 673188 - DNA, 25 bp, Homo sapien
agatcgcaccgttgctcttcagccc

SEQ ID NO: 673189 - DNA, 25 bp, Homo sapien
aaacaaaccttatatcctcactaca

SEQ ID NO: 673190 - DNA, 25 bp, Homo sapien
caaaccttatatcctcactacaggc

SEQ ID NO: 673191 - DNA, 25 bp, Homo sapien
ttatatcctcactacaggcataggg

SEQ ID NO: 673192 - DNA, 25 bp, Homo sapien
atcctcactacaggcatagggattt

SEQ ID NO: 673193 - DNA, 25 bp, Homo sapien
acttatttctttataccatgccttg

SEQ ID NO: 673194 - DNA, 25 bp, Homo sapien
atttctttataccatgccttgttcc

SEQ ID NO: 673195 - DNA, 25 bp, Homo sapien
tctttataccatgccttgttccaaa

SEQ ID NO: 673196 - DNA, 25 bp, Homo sapien
ttataccatgccttgttccaaacct

SEQ ID NO: 673197 - DNA, 25 bp, Homo sapien
catgccttgttccaaaccttttgtg

SEQ ID NO: 673198 - DNA, 25 bp, Homo sapien
tgccttgttccaaaccttttgtggt

SEQ ID NO: 673199 - DNA, 25 bp, Homo sapien
acagttgaaactccagcagcgccgg

SEQ ID NO: 673200 - DNA, 25 bp, Homo sapien
gacccgggaagaactggtgagccaa

SEQ ID NO: 673201 - DNA, 25 bp, Homo sapien
ggatcatgccgccaaaactggttga

SEQ ID NO: 673202 - DNA, 25 bp, Homo sapien
gatcatgccgccaaaactggttgaa

SEQ ID NO: 673203 - DNA, 25 bp, Homo sapien
atcatgccgccaaaactggttgaac

SEQ ID NO: 673204 - DNA, 25 bp, Homo sapien
ttcaaagctctaatggacctttttg

SEQ ID NO: 673205 - DNA, 25 bp, Homo sapien
tatgtggagtttacatgggcctctg

SEQ ID NO: 673206 - DNA, 25 bp, Homo sapien
tggcaggaatcccaatttgcctcca

SEQ ID NO: 673207 - DNA, 25 bp, Homo sapien
ttgcctccacttagtgagcggaaga

SEQ ID NO: 673208 - DNA, 25 bp, Homo sapien
gtgagcggaagaatgtgctacagtt

SEQ ID NO: 673209 - DNA, 25 bp, Homo sapien
gcggaagaatgtgctacagttgaaa

SEQ ID NO: 673210 - DNA, 25 bp, Homo sapien
accagatctgaaatagctcaactca

SEQ ID NO: 673211 - DNA, 25 bp, Homo sapien
gaaatagctcaactcagtcaagaaa

SEQ ID NO: 673212 - DNA, 25 bp, Homo sapien
aattggaggaacagtgtgtccagca

SEQ ID NO: 673213 - DNA, 25 bp, Homo sapien
gtgtgtccagcatgggagagtacat

SEQ ID NO: 673214 - DNA, 25 bp, Homo sapien
cgatgaagcaaaggctaaggcagct

SEQ ID NO: 673215 - DNA, 25 bp, Homo sapien
aaggcagctggataagcacagccag

SEQ ID NO: 673216 - DNA, 25 bp, Homo sapien
gctcctcagcaagcagaaccagctt

SEQ ID NO: 673217 - DNA, 25 bp, Homo sapien
cagagcctgtcggaagaggtggacc

SEQ ID NO: 673218 - DNA, 25 bp, Homo sapien
ggctgcggacccagttacccagcat

SEQ ID NO: 673219 - DNA, 25 bp, Homo sapien
tacccagcatgccacaatctgattg

SEQ ID NO: 673220 - DNA, 25 bp, Homo sapien
cagcatgccacaatctgattgctga

SEQ ID NO: 673221 - DNA, 25 bp, Homo sapien
ttcacaggctactgggattctaaca

SEQ ID NO: 673222 - DNA, 25 bp, Homo sapien
ggcaatccagaaaaaattccccacg

SEQ ID NO: 673223 - DNA, 25 bp, Homo sapien
aattccccacgtggagtgttgctca

SEQ ID NO: 673224 - DNA, 25 bp, Homo sapien
gtgttgctcagcacctcaaaggtag

SEQ ID NO: 673225 - DNA, 25 bp, Homo sapien
aggtaggctgtattctgagtacttt

SEQ ID NO: 673226 - DNA, 25 bp, Homo sapien
agtgtgacccgagactccctgggag

SEQ ID NO: 673227 - DNA, 25 bp, Homo sapien
gactccctgggagcatttccacggg

SEQ ID NO: 673228 - DNA, 25 bp, Homo sapien
gctgtctagaggctgcatttgcatt

SEQ ID NO: 673229 - DNA, 25 bp, Homo sapien
ttgcattccctgaaccactgagtta

SEQ ID NO: 673230 - DNA, 25 bp, Homo sapien
gagttactttgagaggtcctccatc

SEQ ID NO: 673231 - DNA, 25 bp, Homo sapien
catttcctcttctgcagaatgttgg

SEQ ID NO: 673232 - DNA, 25 bp, Homo sapien
taaccaggatacaagttacattgtt

SEQ ID NO: 673233 - DNA, 25 bp, Homo sapien
tgttatgcaattcctctgctgaggc

SEQ ID NO: 673234 - DNA, 25 bp, Homo sapien
ctgaggccctgtaaaaggagtgagt

SEQ ID NO: 673235 - DNA, 25 bp, Homo sapien
gagtgagttaggacagatgcagcaa

SEQ ID NO: 673236 - DNA, 25 bp, Homo sapien
gatgcagcaagatattaggacagat

SEQ ID NO: 673237 - DNA, 25 bp, Homo sapien
taggacagatttcgcccattattca

SEQ ID NO: 673238 - DNA, 25 bp, Homo sapien
gatttcgcccattattcaggctgca

SEQ ID NO: 673239 - DNA, 25 bp, Homo sapien
attattcaggctgcacaacacagaa

SEQ ID NO: 673240 - DNA, 25 bp, Homo sapien
cttgatttcaataagacccaattct

SEQ ID NO: 673241 - DNA, 25 bp, Homo sapien
ttcttaacagtcttttctacccact

SEQ ID NO: 673242 - DNA, 25 bp, Homo sapien
tttggttcaaattgtgcagagaaac

SEQ ID NO: 673243 - DNA, 25 bp, Homo sapien
cttccgagtgggaaagtccaagtag

SEQ ID NO: 673244 - DNA, 25 bp, Homo sapien
gagacgtttgtagctctgcacttag

SEQ ID NO: 673245 - DNA, 25 bp, Homo sapien
gtagctctgcacttaggataatgaa

SEQ ID NO: 673246 - DNA, 25 bp, Homo sapien
ggcagagataccgttgcaccacagg

SEQ ID NO: 673247 - DNA, 25 bp, Homo sapien
gataccgttgcaccacagggaatga

SEQ ID NO: 673248 - DNA, 25 bp, Homo sapien
gcaccacagggaatgaaccaactag

SEQ ID NO: 673249 - DNA, 25 bp, Homo sapien
gaaagcctgttgagctcataaagga

SEQ ID NO: 673250 - DNA, 25 bp, Homo sapien
agataattagcccaagctcctacct

SEQ ID NO: 673251 - DNA, 25 bp, Homo sapien
tagcccaagctcctacctacatttt

SEQ ID NO: 673252 - DNA, 25 bp, Homo sapien
gaaaaccaataaacacctctcagaa

SEQ ID NO: 673253 - DNA, 25 bp, Homo sapien
acacctctcagaaatggagctccat

SEQ ID NO: 673254 - DNA, 25 bp, Homo sapien
caattctagcactgtgaagcttcag

SEQ ID NO: 673255 - DNA, 25 bp, Homo sapien
attctagcactgtgaagcttcagac

SEQ ID NO: 673256 - DNA, 25 bp, Homo sapien
gttatttatggaaataccttccaat

SEQ ID NO: 673257 - DNA, 25 bp, Homo sapien
ggaaataccttccaatgctattgag

SEQ ID NO: 673258 - DNA, 25 bp, Homo sapien
aaataccttccaatgctattgagaa

SEQ ID NO: 673259 - DNA, 25 bp, Homo sapien
taccttccaatgctattgagaaatt

SEQ ID NO: 673260 - DNA, 25 bp, Homo sapien
agaaattcaaatctctattgtatat

SEQ ID NO: 673261 - DNA, 25 bp, Homo sapien
atctctattgtatattgttctttga

SEQ ID NO: 673262 - DNA, 25 bp, Homo sapien
tattgttctttgatatgtggcttag

SEQ ID NO: 673263 - DNA, 25 bp, Homo sapien
gttctttgatatgtggcttagtttt

SEQ ID NO: 673264 - DNA, 25 bp, Homo sapien
tgatatgtggcttagttttatgttt

SEQ ID NO: 673265 - DNA, 25 bp, Homo sapien
gattaatgctgcctgatcacctcag

SEQ ID NO: 673266 - DNA, 25 bp, Homo sapien
attaatgctgcctgatcacctcaga

SEQ ID NO: 673267 - DNA, 25 bp, Homo sapien
ttaatgctgcctgatcacctcagaa

SEQ ID NO: 673268 - DNA, 25 bp, Homo sapien
taatgctgcctgatcacctcagaag

SEQ ID NO: 673269 - DNA, 25 bp, Homo sapien
aatgctgcctgatcacctcagaagc

SEQ ID NO: 673270 - DNA, 25 bp, Homo sapien
atgctgcctgatcacctcagaagcc

SEQ ID NO: 673271 - DNA, 25 bp, Homo sapien
tgctgcctgatcacctcagaagccc

SEQ ID NO: 673272 - DNA, 25 bp, Homo sapien
ccaacttcaggtgactctcaagtgg

SEQ ID NO: 673273 - DNA, 25 bp, Homo sapien
caacttcaggtgactctcaagtgga

SEQ ID NO: 673274 - DNA, 25 bp, Homo sapien
aacttcaggtgactctcaagtggag

SEQ ID NO: 673275 - DNA, 25 bp, Homo sapien
acttcaggtgactctcaagtggagg

SEQ ID NO: 673276 - DNA, 25 bp, Homo sapien
cgttactcggactaccccgatgcat

SEQ ID NO: 673277 - DNA, 25 bp, Homo sapien
taccccgatgcatacaccacatgaa

SEQ ID NO: 673278 - DNA, 25 bp, Homo sapien
ccgatgcatacaccacatgaaacat

SEQ ID NO: 673279 - DNA, 25 bp, Homo sapien
aggctcattcatttctctaacagca

SEQ ID NO: 673280 - DNA, 25 bp, Homo sapien
ggctcattcatttctctaacagcag

SEQ ID NO: 673281 - DNA, 25 bp, Homo sapien
gctcattcatttctctaacagcagt

SEQ ID NO: 673282 - DNA, 25 bp, Homo sapien
ctcattcatttctctaacagcagta

SEQ ID NO: 673283 - DNA, 25 bp, Homo sapien
tcattcatttctctaacagcagtaa

SEQ ID NO: 673284 - DNA, 25 bp, Homo sapien
attcatttctctaacagcagtaata

SEQ ID NO: 673285 - DNA, 25 bp, Homo sapien
ttctctaacagcagtaatattaata

SEQ ID NO: 673286 - DNA, 25 bp, Homo sapien
acccgtatacataaaatctagacaa

SEQ ID NO: 673287 - DNA, 25 bp, Homo sapien
ctaatgccctcagccataatcataa

SEQ ID NO: 673288 - DNA, 25 bp, Homo sapien
tgaaaccacatcgtgcattgcacac

SEQ ID NO: 673289 - DNA, 25 bp, Homo sapien
gcattgcacacacttgggttggcga

SEQ ID NO: 673290 - DNA, 25 bp, Homo sapien
gggttggcgaaatgcaatctgacaa

SEQ ID NO: 673291 - DNA, 25 bp, Homo sapien
aatctgacaactgcttgctgccagc

SEQ ID NO: 673292 - DNA, 25 bp, Homo sapien
tgttctcagcagcagtaagagcctg

SEQ ID NO: 673293 - DNA, 25 bp, Homo sapien
gagcctggtcaatctgaaccttcta

SEQ ID NO: 673294 - DNA, 25 bp, Homo sapien
gaaccttctaggcaatgaattggat

SEQ ID NO: 673295 - DNA, 25 bp, Homo sapien
gatactgatggtgtcaagatgctat

SEQ ID NO: 673296 - DNA, 25 bp, Homo sapien
gaaaaagtcgacatgcaggctgcag

SEQ ID NO: 673297 - DNA, 25 bp, Homo sapien
atgcaggctgcagaaactcgggtga

SEQ ID NO: 673298 - DNA, 25 bp, Homo sapien
gtccagggaccccagcatgaaggct

SEQ ID NO: 673299 - DNA, 25 bp, Homo sapien
ttcaatgcaattgctctatttcttt

SEQ ID NO: 673300 - DNA, 25 bp, Homo sapien
ttctttccacgtccaacatctttga

SEQ ID NO: 673301 - DNA, 25 bp, Homo sapien
atctttgacacttacagttcctgga

SEQ ID NO: 673302 - DNA, 25 bp, Homo sapien
cagttcctggaatattttgtgcaag

SEQ ID NO: 673303 - DNA, 25 bp, Homo sapien
ctgccggccactcagtacaactgat

SEQ ID NO: 673304 - DNA, 25 bp, Homo sapien
gtacaactgatcttgggcaaccctg

SEQ ID NO: 673305 - DNA, 25 bp, Homo sapien
tgatcttgggcaaccctgggctgag

SEQ ID NO: 673306 - DNA, 25 bp, Homo sapien
agcctggaagcggtttcagcaccaa

SEQ ID NO: 673307 - DNA, 25 bp, Homo sapien
cagcaccaagttcctctttacctaa

SEQ ID NO: 673308 - DNA, 25 bp, Homo sapien
ctttacctaaaagggcagactctgt

SEQ ID NO: 673309 - DNA, 25 bp, Homo sapien
tacatagaaaaatccaccccttacg

SEQ ID NO: 673310 - DNA, 25 bp, Homo sapien
ttacgagtgcggcttcgaccctata

SEQ ID NO: 673311 - DNA, 25 bp, Homo sapien
gtccctttctccataaaattcttct

SEQ ID NO: 673312 - DNA, 25 bp, Homo sapien
ttgatctagaaattgccctcctttt

SEQ ID NO: 673313 - DNA, 25 bp, Homo sapien
gatctagaaattgccctccttttac

SEQ ID NO: 673314 - DNA, 25 bp, Homo sapien
gttatgtcatccctcttattaatca

SEQ ID NO: 673315 - DNA, 25 bp, Homo sapien
tcatccctcttattaatcatcatcc

SEQ ID NO: 673316 - DNA, 25 bp, Homo sapien
attaatcatcatcctagccctaagt

SEQ ID NO: 673317 - DNA, 25 bp, Homo sapien
tcatcctagccctaagtctggccta

SEQ ID NO: 673318 - DNA, 25 bp, Homo sapien
tattacattttgactaccacaactc

SEQ ID NO: 673319 - DNA, 25 bp, Homo sapien
accacaactcaacggctacatagaa

SEQ ID NO: 673320 - DNA, 25 bp, Homo sapien
ttccagtgtttgctacctaagatcc

SEQ ID NO: 673321 - DNA, 25 bp, Homo sapien
gtttgctacctaagatcccattggg

SEQ ID NO: 673322 - DNA, 25 bp, Homo sapien
taggaatagttctgtttgtgagcaa

SEQ ID NO: 673323 - DNA, 25 bp, Homo sapien
acttacttcctttcatcttacacaa

SEQ ID NO: 673324 - DNA, 25 bp, Homo sapien
ttcatcttacacaatgaaccttgta

SEQ ID NO: 673325 - DNA, 25 bp, Homo sapien
atgattttctcttcatacgagctgt

SEQ ID NO: 673326 - DNA, 25 bp, Homo sapien
ttttctcttcatacgagctgttaga

SEQ ID NO: 673327 - DNA, 25 bp, Homo sapien
gagctgttagaaagctcagcattaa

SEQ ID NO: 673328 - DNA, 25 bp, Homo sapien
cagcattaaatttgtgactcacctc

SEQ ID NO: 673329 - DNA, 25 bp, Homo sapien
ctcacctctagcaaatatataacac

SEQ ID NO: 673330 - DNA, 25 bp, Homo sapien
gatgtgactgtcctgattctaaaac

SEQ ID NO: 673331 - DNA, 25 bp, Homo sapien
gccgactgcgatgtgtctgactctt

SEQ ID NO: 673332 - DNA, 25 bp, Homo sapien
tgtgtctgactcttcttgcagcagc

SEQ ID NO: 673333 - DNA, 25 bp, Homo sapien
tctgactcttcttgcagcagcctcg

SEQ ID NO: 673334 - DNA, 25 bp, Homo sapien
tggccaaccactctctgcgtgagct

SEQ ID NO: 673335 - DNA, 25 bp, Homo sapien
cgtgagctggacctctctaacaact

SEQ ID NO: 673336 - DNA, 25 bp, Homo sapien
ggacctctctaacaactgcctgggt

SEQ ID NO: 673337 - DNA, 25 bp, Homo sapien
taacaactgcctgggtgacgctggt

SEQ ID NO: 673338 - DNA, 25 bp, Homo sapien
actgcctgggtgacgctggtatcct

SEQ ID NO: 673339 - DNA, 25 bp, Homo sapien
ctgcagctggtggaatctgtacgtc

SEQ ID NO: 673340 - DNA, 25 bp, Homo sapien
aatctgtacgtcagccgggttgcct

SEQ ID NO: 673341 - DNA, 25 bp, Homo sapien
tctgaagaaatggaggaccgtctgc

SEQ ID NO: 673342 - DNA, 25 bp, Homo sapien
ggactgattcgtcaacaactaattt

SEQ ID NO: 673343 - DNA, 25 bp, Homo sapien
gaaaggctgccaaaaccttgggaat

SEQ ID NO: 673344 - DNA, 25 bp, Homo sapien
accttgggaattgctatggcagcat

SEQ ID NO: 673345 - DNA, 25 bp, Homo sapien
agcatttcttgtctcttggctacca

SEQ ID NO: 673346 - DNA, 25 bp, Homo sapien
ttggctaccatacctcgttgatgca

SEQ ID NO: 673347 - DNA, 25 bp, Homo sapien
tacctcgttgatgcagtgattgatg

SEQ ID NO: 673348 - DNA, 25 bp, Homo sapien
ataactcctccttatgtttatgaga

SEQ ID NO: 673349 - DNA, 25 bp, Homo sapien
gctatgaaccccttgatttatgctt

SEQ ID NO: 673350 - DNA, 25 bp, Homo sapien
ttatgctttcttttaccaatggttt

SEQ ID NO: 673351 - DNA, 25 bp, Homo sapien
aacttattgtaagcggcaaggtctt

SEQ ID NO: 673352 - DNA, 25 bp, Homo sapien
gcggcaaggtcttaaggactgattc

SEQ ID NO: 673353 - DNA, 25 bp, Homo sapien
ctcaagcctggagacagagggaaag

SEQ ID NO: 673354 - DNA, 25 bp, Homo sapien
tcaagcctggagacagagggaaagt

SEQ ID NO: 673355 - DNA, 25 bp, Homo sapien
caagcctggagacagagggaaagtc

SEQ ID NO: 673356 - DNA, 25 bp, Homo sapien
aagcctggagacagagggaaagtcc

SEQ ID NO: 673357 - DNA, 25 bp, Homo sapien
agcctggagacagagggaaagtcca

SEQ ID NO: 673358 - DNA, 25 bp, Homo sapien
gcctggagacagagggaaagtccat

SEQ ID NO: 673359 - DNA, 25 bp, Homo sapien
tggagacagagggaaagtccatctc

SEQ ID NO: 673360 - DNA, 25 bp, Homo sapien
ggagacagagggaaagtccatctca

SEQ ID NO: 673361 - DNA, 25 bp, Homo sapien
gagacagagggaaagtccatctcaa

SEQ ID NO: 673362 - DNA, 25 bp, Homo sapien
agacagagggaaagtccatctcaaa

SEQ ID NO: 673363 - DNA, 25 bp, Homo sapien
gacagagggaaagtccatctcaaaa

SEQ ID NO: 673364 - DNA, 25 bp, Homo sapien
tagctgttgctgtctcctatgcctt

SEQ ID NO: 673365 - DNA, 25 bp, Homo sapien
tcagagggccggtccaaagcttttg

SEQ ID NO: 673366 - DNA, 25 bp, Homo sapien
ttttggaacatgcagctctcatctc

SEQ ID NO: 673367 - DNA, 25 bp, Homo sapien
agctctcatctcatggctgtggtga

SEQ ID NO: 673368 - DNA, 25 bp, Homo sapien
ggtgatcttctttgggtccattacc

SEQ ID NO: 673369 - DNA, 25 bp, Homo sapien
gggtccattaccttcatgtatttca

SEQ ID NO: 673370 - DNA, 25 bp, Homo sapien
cttcaagtaactccctggaccagga

SEQ ID NO: 673371 - DNA, 25 bp, Homo sapien
caggagaaggtgtcctctgtgttct

SEQ ID NO: 673372 - DNA, 25 bp, Homo sapien
ctgtgttctacaccacggtgatccc

SEQ ID NO: 673373 - DNA, 25 bp, Homo sapien
tacaccacggtgatccccatgctga

SEQ ID NO: 673374 - DNA, 25 bp, Homo sapien
tgaaccctttaatatacagtctgag

SEQ ID NO: 673375 - DNA, 25 bp, Homo sapien
aggcctgtggggtttgctctcatct

SEQ ID NO: 673376 - DNA, 25 bp, Homo sapien
gggtctgtgggtgtcagctgcacgt

SEQ ID NO: 673377 - DNA, 25 bp, Homo sapien
tcagctgcacgtggtgatgggctca

SEQ ID NO: 673378 - DNA, 25 bp, Homo sapien
gcacgtggtgatgggctcaggagcc

SEQ ID NO: 673379 - DNA, 25 bp, Homo sapien
ggctcaggagcctgtggccccagtt

SEQ ID NO: 673380 - DNA, 25 bp, Homo sapien
tctcctgcctggagagcatcaggct

SEQ ID NO: 673381 - DNA, 25 bp, Homo sapien
ctgagctgggcatgaggagcaaacc

SEQ ID NO: 673382 - DNA, 25 bp, Homo sapien
ggagcaaaccagagttagcaaccag

SEQ ID NO: 673383 - DNA, 25 bp, Homo sapien
gagttagcaaccaggaccgtggaag

SEQ ID NO: 673384 - DNA, 25 bp, Homo sapien
caggaccgtggaagaactaggctca

SEQ ID NO: 673385 - DNA, 25 bp, Homo sapien
gaccgtggaagaactaggctcagga

SEQ ID NO: 673386 - DNA, 25 bp, Homo sapien
ttcaaatctgatctgctcaacttag

SEQ ID NO: 673387 - DNA, 25 bp, Homo sapien
atctgctcaacttagcgactgaaga

SEQ ID NO: 673388 - DNA, 25 bp, Homo sapien
aagattaatgctgcctgatcacctc

SEQ ID NO: 673389 - DNA, 25 bp, Homo sapien
actctcaagtggagggcctctgaac

SEQ ID NO: 673390 - DNA, 25 bp, Homo sapien
ctctcaagtggagggcctctgaacc

SEQ ID NO: 673391 - DNA, 25 bp, Homo sapien
ctcaagtggagggcctctgaaccca

SEQ ID NO: 673392 - DNA, 25 bp, Homo sapien
aagtggagggcctctgaacccaagc

SEQ ID NO: 673393 - DNA, 25 bp, Homo sapien
ggagggcctctgaacccaagccaag

SEQ ID NO: 673394 - DNA, 25 bp, Homo sapien
tttgaaggtatatgcccgggtggcc

SEQ ID NO: 673395 - DNA, 25 bp, Homo sapien
gggtggcctgaagtaaccgaagaat

SEQ ID NO: 673396 - DNA, 25 bp, Homo sapien
aaataagtgcaaatgccagtccttg

SEQ ID NO: 673397 - DNA, 25 bp, Homo sapien
tatcatatcttgaagagatccagtc

SEQ ID NO: 673398 - DNA, 25 bp, Homo sapien
aagagatccagtctgttcgacgcca

SEQ ID NO: 673399 - DNA, 25 bp, Homo sapien
cagtctgttcgacgccatacaaata

SEQ ID NO: 673400 - DNA, 25 bp, Homo sapien
gttcgacgccatacaaatagcacaa

SEQ ID NO: 673401 - DNA, 25 bp, Homo sapien
atagcacaagtgatccccaaagccc

SEQ ID NO: 673402 - DNA, 25 bp, Homo sapien
cctccgttgttggtccactgcagtg

SEQ ID NO: 673403 - DNA, 25 bp, Homo sapien
gcgtggtgattttgtcggagatcat

SEQ ID NO: 673404 - DNA, 25 bp, Homo sapien
ggagatcatgatcgcctgcctggaa

SEQ ID NO: 673405 - DNA, 25 bp, Homo sapien
gatcatgatcgcctgcctggaacac

SEQ ID NO: 673406 - DNA, 25 bp, Homo sapien
tctctgccagtacacatttgtgtac

SEQ ID NO: 673407 - DNA, 25 bp, Homo sapien
agttcctgaaaagctccaggctcat

SEQ ID NO: 673408 - DNA, 25 bp, Homo sapien
ggagagaccatgtcccactgggagc

SEQ ID NO: 673409 - DNA, 25 bp, Homo sapien
tgggagcccaaagcactccagggag

SEQ ID NO: 673410 - DNA, 25 bp, Homo sapien
agcccaaagcactccagggagggta

SEQ ID NO: 673411 - DNA, 25 bp, Homo sapien
tgagagcttttgtactgattttgtt

SEQ ID NO: 673412 - DNA, 25 bp, Homo sapien
gattttgtttcctcactcctgtttc

SEQ ID NO: 673413 - DNA, 25 bp, Homo sapien
tccttctctccccttgtgggtgagg

SEQ ID NO: 673414 - DNA, 25 bp, Homo sapien
gcgagtgagcagttgatcatctctt

SEQ ID NO: 673415 - DNA, 25 bp, Homo sapien
tgatcatctcttaaaccagggctgc

SEQ ID NO: 673416 - DNA, 25 bp, Homo sapien
catctcttaaaccagggctgccaga

SEQ ID NO: 673417 - DNA, 25 bp, Homo sapien
gagccagaaaatggagtgccttcct

SEQ ID NO: 673418 - DNA, 25 bp, Homo sapien
agaaaatggagtgccttccttcctt

SEQ ID NO: 673419 - DNA, 25 bp, Homo sapien
atgtctggtgagaatccatcctctg

SEQ ID NO: 673420 - DNA, 25 bp, Homo sapien
gtgagaatccatcctctgtgagcat

SEQ ID NO: 673421 - DNA, 25 bp, Homo sapien
atccatcctctgtgagcatctctgt

SEQ ID NO: 673422 - DNA, 25 bp, Homo sapien
gcatctctgtcatcagcagtagcag

SEQ ID NO: 673423 - DNA, 25 bp, Homo sapien
tgtcatcagcagtagcagctacagc

SEQ ID NO: 673424 - DNA, 25 bp, Homo sapien
ccagctctgcgggtgttgaccttgg

SEQ ID NO: 673425 - DNA, 25 bp, Homo sapien
ggcagcacccagagcgggcagacca

SEQ ID NO: 673426 - DNA, 25 bp, Homo sapien
agagcgggcagaccaagaccacaga

SEQ ID NO: 673427 - DNA, 25 bp, Homo sapien
cagaccaagaccacagaggcgcgag

SEQ ID NO: 673428 - DNA, 25 bp, Homo sapien
acctcaaggacacccagggcaagag

SEQ ID NO: 673429 - DNA, 25 bp, Homo sapien
agggcaagagcaccccagccagcat

SEQ ID NO: 673430 - DNA, 25 bp, Homo sapien
actgtacattacagatcctggagct

SEQ ID NO: 673431 - DNA, 25 bp, Homo sapien
aaaactgcctgttcacctccatctg

SEQ ID NO: 673432 - DNA, 25 bp, Homo sapien
ttccatgctccgcaaaaaccaacat

SEQ ID NO: 673433 - DNA, 25 bp, Homo sapien
tctgagacatctggacttgagcaag

SEQ ID NO: 673434 - DNA, 25 bp, Homo sapien
atgcgattggagtctatggtattct

SEQ ID NO: 673435 - DNA, 25 bp, Homo sapien
gtgcgaggccttctcaagccaaaag

SEQ ID NO: 673436 - DNA, 25 bp, Homo sapien
gaggtcattttctgtattcctgcct

SEQ ID NO: 673437 - DNA, 25 bp, Homo sapien
attcctgcctggactcgaataacta

SEQ ID NO: 673438 - DNA, 25 bp, Homo sapien
tcgaataactagcttctccccaact

SEQ ID NO: 673439 - DNA, 25 bp, Homo sapien
cacgggaaaaagtgactgcctatcc

SEQ ID NO: 673440 - DNA, 25 bp, Homo sapien
ctgcctatcccagattaatccttag

SEQ ID NO: 673441 - DNA, 25 bp, Homo sapien
aaggattgacaaccggtctcatgac

SEQ ID NO: 673442 - DNA, 25 bp, Homo sapien
accggtctcatgacccaggcagaga

SEQ ID NO: 673443 - DNA, 25 bp, Homo sapien
tcatgacccaggcagagaggcagaa

SEQ ID NO: 673444 - DNA, 25 bp, Homo sapien
gagaggcagaaacaggctcaccaaa

SEQ ID NO: 673445 - DNA, 25 bp, Homo sapien
aagacaggccgccatgcgagaaaca

SEQ ID NO: 673446 - DNA, 25 bp, Homo sapien
ggccgccatgcgagaaacagctttg

SEQ ID NO: 673447 - DNA, 25 bp, Homo sapien
gcgagaaacagctttgtggtgcaca

SEQ ID NO: 673448 - DNA, 25 bp, Homo sapien
ggtgcacagggcacattcggccaag

SEQ ID NO: 673449 - DNA, 25 bp, Homo sapien
gcacattcggccaaggacacacacg

SEQ ID NO: 673450 - DNA, 25 bp, Homo sapien
aggccttcacacacccaaagcggaa

SEQ ID NO: 673451 - DNA, 25 bp, Homo sapien
accgcgtcggcgaaaaggattgaca

SEQ ID NO: 673452 - DNA, 25 bp, Homo sapien
gcacaggccacatgtattatataca

SEQ ID NO: 673453 - DNA, 25 bp, Homo sapien
tatatatatacagctgcaatcccag

SEQ ID NO: 673454 - DNA, 25 bp, Homo sapien
atatatacagctgcaatcccagcca

SEQ ID NO: 673455 - DNA, 25 bp, Homo sapien
tgagtcaggaaaattggttgaactt

SEQ ID NO: 673456 - DNA, 25 bp, Homo sapien
gagtcaggaaaattggttgaacttg

SEQ ID NO: 673457 - DNA, 25 bp, Homo sapien
gtcaggaaaattggttgaacttggg

SEQ ID NO: 673458 - DNA, 25 bp, Homo sapien
tggtgagctgagatacaggtactgc

SEQ ID NO: 673459 - DNA, 25 bp, Homo sapien
gagctgagatacaggtactgcactc

SEQ ID NO: 673460 - DNA, 25 bp, Homo sapien
agctgagatacaggtactgcactcc

SEQ ID NO: 673461 - DNA, 25 bp, Homo sapien
tgagatacaggtactgcactccagg

SEQ ID NO: 673462 - DNA, 25 bp, Homo sapien
gagatacaggtactgcactccaggc

SEQ ID NO: 673463 - DNA, 25 bp, Homo sapien
aaatgtataacagagtagatgcccc

SEQ ID NO: 673464 - DNA, 25 bp, Homo sapien
cttaccctgacatttagctttgaat

SEQ ID NO: 673465 - DNA, 25 bp, Homo sapien
gggagaatagaaccctatgtctgaa

SEQ ID NO: 673466 - DNA, 25 bp, Homo sapien
aagtatatgtgttgggatttcatcc

SEQ ID NO: 673467 - DNA, 25 bp, Homo sapien
gggatttcatcccatatatggtggt

SEQ ID NO: 673468 - DNA, 25 bp, Homo sapien
tatatggtggtagccgccaactcag

SEQ ID NO: 673469 - DNA, 25 bp, Homo sapien
gccgccaactcagagataggtcgtt

SEQ ID NO: 673470 - DNA, 25 bp, Homo sapien
ataggtcgttctgtaagattctcac

SEQ ID NO: 673471 - DNA, 25 bp, Homo sapien
tgtataacacaaacattcctgagtc

SEQ ID NO: 673472 - DNA, 25 bp, Homo sapien
gtacaacacaaggtcacgaaaccgc

SEQ ID NO: 673473 - DNA, 25 bp, Homo sapien
aaaccgcaagcagggcgccgtgata

SEQ ID NO: 673474 - DNA, 25 bp, Homo sapien
tatacggaatttctagaataggcac

SEQ ID NO: 673475 - DNA, 25 bp, Homo sapien
ataggcacatccatagagacggatt

SEQ ID NO: 673476 - DNA, 25 bp, Homo sapien
atagagacggattagtggttgctta

SEQ ID NO: 673477 - DNA, 25 bp, Homo sapien
aggtgacagctaatgggcagtttta

SEQ ID NO: 673478 - DNA, 25 bp, Homo sapien
gtgcttacataagccgagcaggcat

SEQ ID NO: 673479 - DNA, 25 bp, Homo sapien
gaaaaagtgccctaagattgtgata

SEQ ID NO: 673480 - DNA, 25 bp, Homo sapien
tgccctaagattgtgataatggtac

SEQ ID NO: 673481 - DNA, 25 bp, Homo sapien
aatggtacaattctgtcaattgcat

SEQ ID NO: 673482 - DNA, 25 bp, Homo sapien
tgtgaattatgtctcttaggataac

SEQ ID NO: 673483 - DNA, 25 bp, Homo sapien
ataacagctttactggcgttaccag

SEQ ID NO: 673484 - DNA, 25 bp, Homo sapien
gctttactggcgttaccagaaaaag

SEQ ID NO: 673485 - DNA, 25 bp, Homo sapien
tccaagatgaagtcacctgtagttc

SEQ ID NO: 673486 - DNA, 25 bp, Homo sapien
cctgtagttcagtgtctgcgtctaa

SEQ ID NO: 673487 - DNA, 25 bp, Homo sapien
tctgcgtctaagagagcactttgtt

SEQ ID NO: 673488 - DNA, 25 bp, Homo sapien
tttgttgctgcacccgccataggga

SEQ ID NO: 673489 - DNA, 25 bp, Homo sapien
cccgccatagggaagaaatactgta

SEQ ID NO: 673490 - DNA, 25 bp, Homo sapien
tactgtatcttctcatgaaggaagg

SEQ ID NO: 673491 - DNA, 25 bp, Homo sapien
ttacaagtattgtggctgaaggctg

SEQ ID NO: 673492 - DNA, 25 bp, Homo sapien
tgtggctgaaggctgtgtctattcc

SEQ ID NO: 673493 - DNA, 25 bp, Homo sapien
gctgtgtctattcctgcttcctcca

SEQ ID NO: 673494 - DNA, 25 bp, Homo sapien
ctcaccttgcaaaagtgtttatcca

SEQ ID NO: 673495 - DNA, 25 bp, Homo sapien
tatccaaataaatccctcacacatc

SEQ ID NO: 673496 - DNA, 25 bp, Homo sapien
tcacctgtgaaatgcggagactaat

SEQ ID NO: 673497 - DNA, 25 bp, Homo sapien
atgacaaagctactgtctctacccc

SEQ ID NO: 673498 - DNA, 25 bp, Homo sapien
tgcttcccttacacactggctgcgg

SEQ ID NO: 673499 - DNA, 25 bp, Homo sapien
gcggctccctcagaagatcacaaag

SEQ ID NO: 673500 - DNA, 25 bp, Homo sapien
gaggtggatggagccctagcttctt

SEQ ID NO: 673501 - DNA, 25 bp, Homo sapien
ccggccaggtaactcaagggactag

SEQ ID NO: 673502 - DNA, 25 bp, Homo sapien
taggaaaatcctggctgcactcaag

SEQ ID NO: 673503 - DNA, 25 bp, Homo sapien
tgcactcaagcttggcaaggaggct

SEQ ID NO: 673504 - DNA, 25 bp, Homo sapien
gaaggagaactctccaaggcctgcc

SEQ ID NO: 673505 - DNA, 25 bp, Homo sapien
aaggcctgccttgttgtccaaccaa

SEQ ID NO: 673506 - DNA, 25 bp, Homo sapien
ttgttgtccaaccaacacctacttc

SEQ ID NO: 673507 - DNA, 25 bp, Homo sapien
tgtgggcagggactcttctaagtta

SEQ ID NO: 673508 - DNA, 25 bp, Homo sapien
gtgggcagggactcttctaagttat

SEQ ID NO: 673509 - DNA, 25 bp, Homo sapien
tgggcagggactcttctaagttatg

SEQ ID NO: 673510 - DNA, 25 bp, Homo sapien
gggcagggactcttctaagttatgt

SEQ ID NO: 673511 - DNA, 25 bp, Homo sapien
ggcagggactcttctaagttatgtt

SEQ ID NO: 673512 - DNA, 25 bp, Homo sapien
gcagggactcttctaagttatgttc

SEQ ID NO: 673513 - DNA, 25 bp, Homo sapien
cagggactcttctaagttatgttcc

SEQ ID NO: 673514 - DNA, 25 bp, Homo sapien
ctaagttatgttcctcaagtagatt

SEQ ID NO: 673515 - DNA, 25 bp, Homo sapien
aagttatgttcctcaagtagattat

SEQ ID NO: 673516 - DNA, 25 bp, Homo sapien
gttatgttcctcaagtagattatat

SEQ ID NO: 673517 - DNA, 25 bp, Homo sapien
atgttcctcaagtagattatataaa

SEQ ID NO: 673518 - DNA, 25 bp, Homo sapien
acatggttgcccgtcacaaggaggg

SEQ ID NO: 673519 - DNA, 25 bp, Homo sapien
aggagggcgctgagcttatcgattc

SEQ ID NO: 673520 - DNA, 25 bp, Homo sapien
tgagcttatcgattccgcctccatc

SEQ ID NO: 673521 - DNA, 25 bp, Homo sapien
ttggaggaccttgaacccctctaca

SEQ ID NO: 673522 - DNA, 25 bp, Homo sapien
taccgcagaacagcgtgacctgtgt

SEQ ID NO: 673523 - DNA, 25 bp, Homo sapien
gtgacctgtgtcgtcgtattggtat

SEQ ID NO: 673524 - DNA, 25 bp, Homo sapien
gtattgacttcgagaccattcctgg

SEQ ID NO: 673525 - DNA, 25 bp, Homo sapien
ttcgagaccattcctggcatctctg

SEQ ID NO: 673526 - DNA, 25 bp, Homo sapien
ccgctgctcggatggacgtcgagat

SEQ ID NO: 673527 - DNA, 25 bp, Homo sapien
acgtcgagatcactgtcccggaagt

SEQ ID NO: 673528 - DNA, 25 bp, Homo sapien
tcccggaagtctctcagtcactcat

SEQ ID NO: 673529 - DNA, 25 bp, Homo sapien
acgttgacaatcgagtagtactccc

SEQ ID NO: 673530 - DNA, 25 bp, Homo sapien
aagacgtcttgcactcatgagctgt

SEQ ID NO: 673531 - DNA, 25 bp, Homo sapien
aacagatgcaattcccggacgtcta

SEQ ID NO: 673532 - DNA, 25 bp, Homo sapien
tgcaattcccggacgtctaaaccaa

SEQ ID NO: 673533 - DNA, 25 bp, Homo sapien
gggtatactacggtcaatgctctga

SEQ ID NO: 673534 - DNA, 25 bp, Homo sapien
ggtatactacggtcaatgctctgaa

SEQ ID NO: 673535 - DNA, 25 bp, Homo sapien
gtatactacggtcaatgctctgaaa

SEQ ID NO: 673536 - DNA, 25 bp, Homo sapien
atactacggtcaatgctctgaaatc

SEQ ID NO: 673537 - DNA, 25 bp, Homo sapien
actacggtcaatgctctgaaatctg

SEQ ID NO: 673538 - DNA, 25 bp, Homo sapien
tacggtcaatgctctgaaatctgtg

SEQ ID NO: 673539 - DNA, 25 bp, Homo sapien
gctctgaaatctgtggagcaaacca

SEQ ID NO: 673540 - DNA, 25 bp, Homo sapien
ttaaaaaagagaggctttggctggg

SEQ ID NO: 673541 - DNA, 25 bp, Homo sapien
aaaagagaggctttggctgggccca

SEQ ID NO: 673542 - DNA, 25 bp, Homo sapien
aaagagaggctttggctgggcccag

SEQ ID NO: 673543 - DNA, 25 bp, Homo sapien
aagagaggctttggctgggcccagt

SEQ ID NO: 673544 - DNA, 25 bp, Homo sapien
agagaggctttggctgggcccagtg

SEQ ID NO: 673545 - DNA, 25 bp, Homo sapien
cagtggcacgcgtctgtaatccaag

SEQ ID NO: 673546 - DNA, 25 bp, Homo sapien
gcggaaggtgcagtgggcccagatt

SEQ ID NO: 673547 - DNA, 25 bp, Homo sapien
cggaaggtgcagtgggcccagattg

SEQ ID NO: 673548 - DNA, 25 bp, Homo sapien
ggaaggtgcagtgggcccagattgc

SEQ ID NO: 673549 - DNA, 25 bp, Homo sapien
aaggtgcagtgggcccagattgcac

SEQ ID NO: 673550 - DNA, 25 bp, Homo sapien
aggtgcagtgggcccagattgcacc

SEQ ID NO: 673551 - DNA, 25 bp, Homo sapien
gggtgattgtttcctagcaacctca

SEQ ID NO: 673552 - DNA, 25 bp, Homo sapien
tagcaacctcagaagctgggcctct

SEQ ID NO: 673553 - DNA, 25 bp, Homo sapien
aagctgggcctctgcagtccagagt

SEQ ID NO: 673554 - DNA, 25 bp, Homo sapien
gtgggaaaccccattgaccatctgt

SEQ ID NO: 673555 - DNA, 25 bp, Homo sapien
tgaccatctgtactccatgcagaat

SEQ ID NO: 673556 - DNA, 25 bp, Homo sapien
gcagaattcttacttcacatcttga

SEQ ID NO: 673557 - DNA, 25 bp, Homo sapien
acatcttgagtcttcccctagagtt

SEQ ID NO: 673558 - DNA, 25 bp, Homo sapien
tagagttctgtgactaggctcccat

SEQ ID NO: 673559 - DNA, 25 bp, Homo sapien
gactaggctcccatatggaacaacc

SEQ ID NO: 673560 - DNA, 25 bp, Homo sapien
atggaacaaccatattctttgaggg

SEQ ID NO: 673561 - DNA, 25 bp, Homo sapien
atggtgtagctcagcatttccaaag

SEQ ID NO: 673562 - DNA, 25 bp, Homo sapien
tcggatattggacagaggacatgca

SEQ ID NO: 673563 - DNA, 25 bp, Homo sapien
ggacatgcagagatgcgacacccac

SEQ ID NO: 673564 - DNA, 25 bp, Homo sapien
tgcagagatgcgacacccacttaaa

SEQ ID NO: 673565 - DNA, 25 bp, Homo sapien
atgcgacacccacttaaactcgaag

SEQ ID NO: 673566 - DNA, 25 bp, Homo sapien
gacacccacttaaactcgaagttgc

SEQ ID NO: 673567 - DNA, 25 bp, Homo sapien
taaactcgaagttgcaaagatgcaa

SEQ ID NO: 673568 - DNA, 25 bp, Homo sapien
acccatgggcacgtggcttttggga

SEQ ID NO: 673569 - DNA, 25 bp, Homo sapien
gctgccacagatctctgaagagtct

SEQ ID NO: 673570 - DNA, 25 bp, Homo sapien
cagatctctgaagagtctggacctg

SEQ ID NO: 673571 - DNA, 25 bp, Homo sapien
gacctgctgggtctccccgagtgac

SEQ ID NO: 673572 - DNA, 25 bp, Homo sapien
tgggtctccccgagtgactgtctgg

SEQ ID NO: 673573 - DNA, 25 bp, Homo sapien
ttaacctaactcattactgaccata

SEQ ID NO: 673574 - DNA, 25 bp, Homo sapien
attactgaccatatttacataaacc

SEQ ID NO: 673575 - DNA, 25 bp, Homo sapien
tacataaaccaattttgctgatggg

SEQ ID NO: 673576 - DNA, 25 bp, Homo sapien
tctgcaaatttccacgtacataaga

SEQ ID NO: 673577 - DNA, 25 bp, Homo sapien
aagaagctggtgtgatatgtccttt

SEQ ID NO: 673578 - DNA, 25 bp, Homo sapien
tggtgtgatatgtcctttgagtttc

SEQ ID NO: 673579 - DNA, 25 bp, Homo sapien
gtcctttgagtttcaattgctttta

SEQ ID NO: 673580 - DNA, 25 bp, Homo sapien
gttttatcttcaactttgagtttct

SEQ ID NO: 673581 - DNA, 25 bp, Homo sapien
gaaagtaattacctaccaatttgat

SEQ ID NO: 673582 - DNA, 25 bp, Homo sapien
gaagtgatcattatatgcatattca

SEQ ID NO: 673583 - DNA, 25 bp, Homo sapien
ataaaaagagttgttctgcctacga

SEQ ID NO: 673584 - DNA, 25 bp, Homo sapien
gcattcattcatcagcagtccattt

SEQ ID NO: 673585 - DNA, 25 bp, Homo sapien
attcatcagcagtccattttgacat

SEQ ID NO: 673586 - DNA, 25 bp, Homo sapien
tcagcagtccattttgacatatggg

SEQ ID NO: 673587 - DNA, 25 bp, Homo sapien
gggaatcagcttaagttgtatctga

SEQ ID NO: 673588 - DNA, 25 bp, Homo sapien
gaaatagcagttcatccaatgcaaa

SEQ ID NO: 673589 - DNA, 25 bp, Homo sapien
gcagttcatccaatgcaaagatgta

SEQ ID NO: 673590 - DNA, 25 bp, Homo sapien
atgcaaagatgtatagaactgtgac

SEQ ID NO: 673591 - DNA, 25 bp, Homo sapien
acagggtcttttgcctttatcgtcg

SEQ ID NO: 673592 - DNA, 25 bp, Homo sapien
ttgcctttatcgtcgctctttaaat

SEQ ID NO: 673593 - DNA, 25 bp, Homo sapien
atcgtcgctctttaaatatttcctt

SEQ ID NO: 673594 - DNA, 25 bp, Homo sapien
atatttcctttgtaatagctttgaa

SEQ ID NO: 673595 - DNA, 25 bp, Homo sapien
gaaaacgtcgattcgcaccgtccaa

SEQ ID NO: 673596 - DNA, 25 bp, Homo sapien
tcctacagctgtaactcccctcctg

SEQ ID NO: 673597 - DNA, 25 bp, Homo sapien
taaggtttgcctgtgtacagacctc

SEQ ID NO: 673598 - DNA, 25 bp, Homo sapien
aaggtttgcctgtgtacagacctcc

SEQ ID NO: 673599 - DNA, 25 bp, Homo sapien
aggtttgcctgtgtacagacctccg

SEQ ID NO: 673600 - DNA, 25 bp, Homo sapien
ggtttgcctgtgtacagacctccgt

SEQ ID NO: 673601 - DNA, 25 bp, Homo sapien
gtttgcctgtgtacagacctccgtt

SEQ ID NO: 673602 - DNA, 25 bp, Homo sapien
ttgcctgtgtacagacctccgttca

SEQ ID NO: 673603 - DNA, 25 bp, Homo sapien
cctgtgtacagacctccgttcaata

SEQ ID NO: 673604 - DNA, 25 bp, Homo sapien
ctgtgtacagacctccgttcaataa

SEQ ID NO: 673605 - DNA, 25 bp, Homo sapien
tgtacagacctccgttcaataaatt

SEQ ID NO: 673606 - DNA, 25 bp, Homo sapien
ttgggctactcctacaagaggtcag

SEQ ID NO: 673607 - DNA, 25 bp, Homo sapien
caagaggtcagtagcttctcttctg

SEQ ID NO: 673608 - DNA, 25 bp, Homo sapien
tcttctgggccctcttaggaggagg

SEQ ID NO: 673609 - DNA, 25 bp, Homo sapien
ggaggaaggtacacaaagtcaaact

SEQ ID NO: 673610 - DNA, 25 bp, Homo sapien
ctcaagatgtagagacttggtccta

SEQ ID NO: 673611 - DNA, 25 bp, Homo sapien
cttggtcctagtctttatctgctga

SEQ ID NO: 673612 - DNA, 25 bp, Homo sapien
tttggtgcctttacacctcacttaa

SEQ ID NO: 673613 - DNA, 25 bp, Homo sapien
ttacacctcacttaaaagccttgtg

SEQ ID NO: 673614 - DNA, 25 bp, Homo sapien
agccttgtgagggatgttcttgttc

SEQ ID NO: 673615 - DNA, 25 bp, Homo sapien
gatgttcttgttccgcattttacaa

SEQ ID NO: 673616 - DNA, 25 bp, Homo sapien
agcctctgtcagagacttgctcaaa

SEQ ID NO: 673617 - DNA, 25 bp, Homo sapien
tgaagaacacacagacactaggaaa

SEQ ID NO: 673618 - DNA, 25 bp, Homo sapien
gggcccctaagtgaaagactagatt

SEQ ID NO: 673619 - DNA, 25 bp, Homo sapien
actagattgttccatgagagggtct

SEQ ID NO: 673620 - DNA, 25 bp, Homo sapien
tgagagggtctattgcttgctgtgc

SEQ ID NO: 673621 - DNA, 25 bp, Homo sapien
attgcttgctgtgctcatgttctcc

SEQ ID NO: 673622 - DNA, 25 bp, Homo sapien
tcctgtggccactgaacataaaaca

SEQ ID NO: 673623 - DNA, 25 bp, Homo sapien
tgaacataaaacacctgccgcctga

SEQ ID NO: 673624 - DNA, 25 bp, Homo sapien
aacacctgccgcctgagtggatgga

SEQ ID NO: 673625 - DNA, 25 bp, Homo sapien
ggattcagccatgatgactaacctt

SEQ ID NO: 673626 - DNA, 25 bp, Homo sapien
gactaaccttagattcactcagcac

SEQ ID NO: 673627 - DNA, 25 bp, Homo sapien
atgggattacctcaaaatgccgctg

SEQ ID NO: 673628 - DNA, 25 bp, Homo sapien
ctgctagcccacgatctgatgttaa

SEQ ID NO: 673629 - DNA, 25 bp, Homo sapien
gcccacgatctgatgttaatgacat

SEQ ID NO: 673630 - DNA, 25 bp, Homo sapien
ctcctgaggaaatctcagctgcaca

SEQ ID NO: 673631 - DNA, 25 bp, Homo sapien
tcctgaggaaatctcagctgcacaa

SEQ ID NO: 673632 - DNA, 25 bp, Homo sapien
aggaaatctcagctgcacaacctct

SEQ ID NO: 673633 - DNA, 25 bp, Homo sapien
ggaaatctcagctgcacaacctcta

SEQ ID NO: 673634 - DNA, 25 bp, Homo sapien
aaatctcagctgcacaacctctact

SEQ ID NO: 673635 - DNA, 25 bp, Homo sapien
aatctcagctgcacaacctctacta

SEQ ID NO: 673636 - DNA, 25 bp, Homo sapien
tcagctgcacaacctctactacgcc

SEQ ID NO: 673637 - DNA, 25 bp, Homo sapien
tagctcacacctgaccaatcagaga

SEQ ID NO: 673638 - DNA, 25 bp, Homo sapien
ctcacacctgaccaatcagagagct

SEQ ID NO: 673639 - DNA, 25 bp, Homo sapien
attaaccctgtcatgatgacgcgga

SEQ ID NO: 673640 - DNA, 25 bp, Homo sapien
accaggccacgtcgcaaagatatcg

SEQ ID NO: 673641 - DNA, 25 bp, Homo sapien
agatatcggttgaaactcccgctct

SEQ ID NO: 673642 - DNA, 25 bp, Homo sapien
caaggcgccgcatctgggcaaataa

SEQ ID NO: 673643 - DNA, 25 bp, Homo sapien
aggacgtcttcgagatgcgcgctat

SEQ ID NO: 673644 - DNA, 25 bp, Homo sapien
tcttgccacgtggtctacgaggaac

SEQ ID NO: 673645 - DNA, 25 bp, Homo sapien
ggaactgcttatagtcttcgacgct

SEQ ID NO: 673646 - DNA, 25 bp, Homo sapien
gacgctgatgatgtttcgcctgtac

SEQ ID NO: 673647 - DNA, 25 bp, Homo sapien
gcctgtacttccctgacaggtcaat

SEQ ID NO: 673648 - DNA, 25 bp, Homo sapien
tgacttgcggaaagaattgccttca

SEQ ID NO: 673649 - DNA, 25 bp, Homo sapien
attgccttcaaagccatcgtatctg

SEQ ID NO: 673650 - DNA, 25 bp, Homo sapien
tgcagtgcgagagatgcctgttcat

SEQ ID NO: 673651 - DNA, 25 bp, Homo sapien
caacgatggctattatcagggcttt

SEQ ID NO: 673652 - DNA, 25 bp, Homo sapien
tcagggctttaaatcttgcccatct

SEQ ID NO: 673653 - DNA, 25 bp, Homo sapien
atcttgcccatctgatcgatggaat

SEQ ID NO: 673654 - DNA, 25 bp, Homo sapien
atggaatactagtagctccttgcta

SEQ ID NO: 673655 - DNA, 25 bp, Homo sapien
ttttcatgtgcatcgtttttagtga

SEQ ID NO: 673656 - DNA, 25 bp, Homo sapien
gttgggcaactttagggacatttca

SEQ ID NO: 673657 - DNA, 25 bp, Homo sapien
ataggtgtccagaaagcaactttgg

SEQ ID NO: 673658 - DNA, 25 bp, Homo sapien
agcaactttggaatcatggctttga

SEQ ID NO: 673659 - DNA, 25 bp, Homo sapien
gatgcattgctttgctcatttatga

SEQ ID NO: 673660 - DNA, 25 bp, Homo sapien
accagcctcgtgcagtgcgagagat

SEQ ID NO: 673661 - DNA, 25 bp, Homo sapien
cagcctctagaacgaatgtggacct

SEQ ID NO: 673662 - DNA, 25 bp, Homo sapien
atgtggacctgcaactacaaccagc

SEQ ID NO: 673663 - DNA, 25 bp, Homo sapien
taacttctaccaaagctgaatgagt

SEQ ID NO: 673664 - DNA, 25 bp, Homo sapien
cagccaatccttctgatgacaatgt

SEQ ID NO: 673665 - DNA, 25 bp, Homo sapien
gacaatgtagtctggccaacatctt

SEQ ID NO: 673666 - DNA, 25 bp, Homo sapien
aacatcttcactggactctgacgga

SEQ ID NO: 673667 - DNA, 25 bp, Homo sapien
actctgacggactctgtgtctggga

SEQ ID NO: 673668 - DNA, 25 bp, Homo sapien
tctgggacccagctgataacacgtg

SEQ ID NO: 673669 - DNA, 25 bp, Homo sapien
gggattgtatttgcaactctctggt

SEQ ID NO: 673670 - DNA, 25 bp, Homo sapien
gcaactctctggtcagtaagtgata

SEQ ID NO: 673671 - DNA, 25 bp, Homo sapien
acctggcctgtgtgactgggagaat

SEQ ID NO: 673672 - DNA, 25 bp, Homo sapien
attacactcatgtcaaaaatcagag

SEQ ID NO: 673673 - DNA, 25 bp, Homo sapien
gagagagaccaaccatatttgggat

SEQ ID NO: 673674 - DNA, 25 bp, Homo sapien
gaccaaccatatttgggatgagtgt

SEQ ID NO: 673675 - DNA, 25 bp, Homo sapien
gtatcaaatgttgtagtatcatcat

SEQ ID NO: 673676 - DNA, 25 bp, Homo sapien
agagaatttacactaggaacacctt

SEQ ID NO: 673677 - DNA, 25 bp, Homo sapien
actaggaacaccttataagttgaat

SEQ ID NO: 673678 - DNA, 25 bp, Homo sapien
attgaaagtgtgttccatggaaagt

SEQ ID NO: 673679 - DNA, 25 bp, Homo sapien
gtgttccatggaaagtcacattcca

SEQ ID NO: 673680 - DNA, 25 bp, Homo sapien
gtcacattccagatttgaagctgtg

SEQ ID NO: 673681 - DNA, 25 bp, Homo sapien
gatttgaagctgtgtttttgtaaaa

SEQ ID NO: 673682 - DNA, 25 bp, Homo sapien
aataaaatcttggtatgaacagttg

SEQ ID NO: 673683 - DNA, 25 bp, Homo sapien
gactagctattgcaagggctcttct

SEQ ID NO: 673684 - DNA, 25 bp, Homo sapien
attgcaagggctcttctccaaaaac

SEQ ID NO: 673685 - DNA, 25 bp, Homo sapien
gttggatgaggccacttcagccctc

SEQ ID NO: 673686 - DNA, 25 bp, Homo sapien
acttcagccctcgataatgacagtg

SEQ ID NO: 673687 - DNA, 25 bp, Homo sapien
agaaggtggttcagcatgcccttga

SEQ ID NO: 673688 - DNA, 25 bp, Homo sapien
gcatgcccttgataaagccaggacg

SEQ ID NO: 673689 - DNA, 25 bp, Homo sapien
agccaggacgggaaggacatgccta

SEQ ID NO: 673690 - DNA, 25 bp, Homo sapien
ggacatgcctagtggtcactcacag

SEQ ID NO: 673691 - DNA, 25 bp, Homo sapien
actcacaggctctctgcaattcaga

SEQ ID NO: 673692 - DNA, 25 bp, Homo sapien
gatttgatagtggttctgcacaatg

SEQ ID NO: 673693 - DNA, 25 bp, Homo sapien
aagagctcctgagaaatcgagacat

SEQ ID NO: 673694 - DNA, 25 bp, Homo sapien
agggcaaagtggacgggagtggaca

SEQ ID NO: 673695 - DNA, 25 bp, Homo sapien
caaagtggacgggagtggacaggag

SEQ ID NO: 673696 - DNA, 25 bp, Homo sapien
aaagtggacgggagtggacaggagt

SEQ ID NO: 673697 - DNA, 25 bp, Homo sapien
aagtggacgggagtggacaggagtg

SEQ ID NO: 673698 - DNA, 25 bp, Homo sapien
agtggacgggagtggacaggagtgg

SEQ ID NO: 673699 - DNA, 25 bp, Homo sapien
gagtggatgcgataagatgtggttt

SEQ ID NO: 673700 - DNA, 25 bp, Homo sapien
agtggatgcgataagatgtggtttg

SEQ ID NO: 673701 - DNA, 25 bp, Homo sapien
tggatgcgataagatgtggtttgaa

SEQ ID NO: 673702 - DNA, 25 bp, Homo sapien
gatgcgataagatgtggtttgaagc

SEQ ID NO: 673703 - DNA, 25 bp, Homo sapien
atgcgataagatgtggtttgaagct

SEQ ID NO: 673704 - DNA, 25 bp, Homo sapien
tgcgataagatgtggtttgaagctg

SEQ ID NO: 673705 - DNA, 25 bp, Homo sapien
aagggcagggccaagaccgggcttg

SEQ ID NO: 673706 - DNA, 25 bp, Homo sapien
agggcagggccaagaccgggcttgg

SEQ ID NO: 673707 - DNA, 25 bp, Homo sapien
gggcagggccaagaccgggcttggg

SEQ ID NO: 673708 - DNA, 25 bp, Homo sapien
ggcagggccaagaccgggcttggga

SEQ ID NO: 673709 - DNA, 25 bp, Homo sapien
gcagggccaagaccgggcttgggag

SEQ ID NO: 673710 - DNA, 25 bp, Homo sapien
cagggccaagaccgggcttgggaga

SEQ ID NO: 673711 - DNA, 25 bp, Homo sapien
agggccaagaccgggcttgggagag

SEQ ID NO: 673712 - DNA, 25 bp, Homo sapien
gggagaggggcgcagctaagactgg

SEQ ID NO: 673713 - DNA, 25 bp, Homo sapien
ggagaggggcgcagctaagactggg

SEQ ID NO: 673714 - DNA, 25 bp, Homo sapien
gggcgcagctaagactgggggcagg

SEQ ID NO: 673715 - DNA, 25 bp, Homo sapien
tcaaggagaacctcagtccaaagtg

SEQ ID NO: 673716 - DNA, 25 bp, Homo sapien
ggctttagtgtatgaacatcctgga

SEQ ID NO: 673717 - DNA, 25 bp, Homo sapien
gagctctttgatgaagacccagaca

SEQ ID NO: 673718 - DNA, 25 bp, Homo sapien
gacccagacaaggatgactttttag

SEQ ID NO: 673719 - DNA, 25 bp, Homo sapien
ggaagtcttatgattgacctcattg

SEQ ID NO: 673720 - DNA, 25 bp, Homo sapien
cattgaagttgaaaaggagcgcctt

SEQ ID NO: 673721 - DNA, 25 bp, Homo sapien
gagcgccttttagatgaatggttca

SEQ ID NO: 673722 - DNA, 25 bp, Homo sapien
aatggttcactctggacgaggttcc

SEQ ID NO: 673723 - DNA, 25 bp, Homo sapien
tcactctggacgaggttcccaaggg

SEQ ID NO: 673724 - DNA, 25 bp, Homo sapien
agactggagtggctcacgttaatgc

SEQ ID NO: 673725 - DNA, 25 bp, Homo sapien
ttaatgccaaatgcgtcaaacctcg

SEQ ID NO: 673726 - DNA, 25 bp, Homo sapien
aaagaagaagctttggctcatcaaa

SEQ ID NO: 673727 - DNA, 25 bp, Homo sapien
aagttagctacatgcttgctcgggc

SEQ ID NO: 673728 - DNA, 25 bp, Homo sapien
gcttgctcgggcattggaagacaaa

SEQ ID NO: 673729 - DNA, 25 bp, Homo sapien
tttcaacaacccctggcgtaagact

SEQ ID NO: 673730 - DNA, 25 bp, Homo sapien
tggcgtaagacttcagaattctctg

SEQ ID NO: 673731 - DNA, 25 bp, Homo sapien
gaattctctgttttgggtgatccta

SEQ ID NO: 673732 - DNA, 25 bp, Homo sapien
gggtgatcctatacattcaagtgtc

SEQ ID NO: 673733 - DNA, 25 bp, Homo sapien
cctatacattcaagtgtctgcattt

SEQ ID NO: 673734 - DNA, 25 bp, Homo sapien
ctgcatttgttcaatccagcactct

SEQ ID NO: 673735 - DNA, 25 bp, Homo sapien
gttcaatccagcactctcaaataga

SEQ ID NO: 673736 - DNA, 25 bp, Homo sapien
cattctttgccatcaagtatcatat

SEQ ID NO: 673737 - DNA, 25 bp, Homo sapien
gaatgcagcacaacgggcacagcct

SEQ ID NO: 673738 - DNA, 25 bp, Homo sapien
acaccagagctctgaagtccctcat

SEQ ID NO: 673739 - DNA, 25 bp, Homo sapien
attctttatgctctgtcctttctgt

SEQ ID NO: 673740 - DNA, 25 bp, Homo sapien
tgtccctgatcattgatgccgcaaa

SEQ ID NO: 673741 - DNA, 25 bp, Homo sapien
tgatgccgcaaaatttatctccatg

SEQ ID NO: 673742 - DNA, 25 bp, Homo sapien
atttatctccatgcagaacgacttt

SEQ ID NO: 673743 - DNA, 25 bp, Homo sapien
gaacgacttttactggccatggcaa

SEQ ID NO: 673744 - DNA, 25 bp, Homo sapien
ggcaaattgcagtctacctgtgcat

SEQ ID NO: 673745 - DNA, 25 bp, Homo sapien
agtctacctgtgcatatctgtccat

SEQ ID NO: 673746 - DNA, 25 bp, Homo sapien
aagcttcgaagcgtgttctcacagc

SEQ ID NO: 673747 - DNA, 25 bp, Homo sapien
gttctcacagctcctgttgttggca

SEQ ID NO: 673748 - DNA, 25 bp, Homo sapien
ctcattcaacttcatcaacagctag

SEQ ID NO: 673749 - DNA, 25 bp, Homo sapien
gaatacctagaagcactcatgggac

SEQ ID NO: 673750 - DNA, 25 bp, Homo sapien
aagcactcatgggactggaagcaga

SEQ ID NO: 673751 - DNA, 25 bp, Homo sapien
tgtacttccgaaggatccatgatta

SEQ ID NO: 673752 - DNA, 25 bp, Homo sapien
aggactacagcacctgtgcctgggc

SEQ ID NO: 673753 - DNA, 25 bp, Homo sapien
tgtccaagtagaaatcagccgatgt

SEQ ID NO: 673754 - DNA, 25 bp, Homo sapien
agccgatgtctgttctttgtgttca

SEQ ID NO: 673755 - DNA, 25 bp, Homo sapien
tgttctttgtgttcagtctcacaga

SEQ ID NO: 673756 - DNA, 25 bp, Homo sapien
ggaagacccttgaacgacatgaagc

SEQ ID NO: 673757 - DNA, 25 bp, Homo sapien
gaagcaagagcttactacagagttt

SEQ ID NO: 673758 - DNA, 25 bp, Homo sapien
tacagagtttagaagcccgaggtag

SEQ ID NO: 673759 - DNA, 25 bp, Homo sapien
agtgtctcgggctgcaaacgtgtcc

SEQ ID NO: 673760 - DNA, 25 bp, Homo sapien
gcactcatcgcctgcaaaacactga

SEQ ID NO: 673761 - DNA, 25 bp, Homo sapien
aaacactgaggagcctgaacctcga

SEQ ID NO: 673762 - DNA, 25 bp, Homo sapien
tgaacctcgactggattgccttgga

SEQ ID NO: 673763 - DNA, 25 bp, Homo sapien
ggattgccttggatgctgatgcagt

SEQ ID NO: 673764 - DNA, 25 bp, Homo sapien
gtgtgaggcattgagccacccggac

SEQ ID NO: 673765 - DNA, 25 bp, Homo sapien
gaaattgtcagaagtccctcggaga

SEQ ID NO: 673766 - DNA, 25 bp, Homo sapien
aagtccctcggagacacagttgcac

SEQ ID NO: 673767 - DNA, 25 bp, Homo sapien
gttgcaccaggtgagaaccactgct

SEQ ID NO: 673768 - DNA, 25 bp, Homo sapien
atcttctacttacgttgcccataaa

SEQ ID NO: 673769 - DNA, 25 bp, Homo sapien
aacgccagctcagacttcagaagta

SEQ ID NO: 673770 - DNA, 25 bp, Homo sapien
ttcttaccacaaggcacacctacac

SEQ ID NO: 673771 - DNA, 25 bp, Homo sapien
tgcaggccacctactcatgcaccta

SEQ ID NO: 673772 - DNA, 25 bp, Homo sapien
gcaggccacctactcatgcacctaa

SEQ ID NO: 673773 - DNA, 25 bp, Homo sapien
caggccacctactcatgcacctaat

SEQ ID NO: 673774 - DNA, 25 bp, Homo sapien
actcatgcacctaattggaagcgcc

SEQ ID NO: 673775 - DNA, 25 bp, Homo sapien
ctcatgcacctaattggaagcgcca

SEQ ID NO: 673776 - DNA, 25 bp, Homo sapien
tcatgcacctaattggaagcgccac

SEQ ID NO: 673777 - DNA, 25 bp, Homo sapien
catgcacctaattggaagcgccacc

SEQ ID NO: 673778 - DNA, 25 bp, Homo sapien
atgcacctaattggaagcgccaccc

SEQ ID NO: 673779 - DNA, 25 bp, Homo sapien
tgcacctaattggaagcgccaccct

SEQ ID NO: 673780 - DNA, 25 bp, Homo sapien
gcacctaattggaagcgccacccta

SEQ ID NO: 673781 - DNA, 25 bp, Homo sapien
attattatgggaacagttttttatg

SEQ ID NO: 673782 - DNA, 25 bp, Homo sapien
ttattatgggaacagttttttatgg

SEQ ID NO: 673783 - DNA, 25 bp, Homo sapien
tggtctggaaataccttttcgaaca

SEQ ID NO: 673784 - DNA, 25 bp, Homo sapien
ggtctggaaataccttttcgaacag

SEQ ID NO: 673785 - DNA, 25 bp, Homo sapien
gtctggaaataccttttcgaacaga

SEQ ID NO: 673786 - DNA, 25 bp, Homo sapien
tctggaaataccttttcgaacagaa

SEQ ID NO: 673787 - DNA, 25 bp, Homo sapien
ctggaaataccttttcgaacagaat

SEQ ID NO: 673788 - DNA, 25 bp, Homo sapien
tggaaataccttttcgaacagaatt

SEQ ID NO: 673789 - DNA, 25 bp, Homo sapien
gggtcagctccgttctcgagagcat

SEQ ID NO: 673790 - DNA, 25 bp, Homo sapien
tccgttctcgagagcatgaagcctc

SEQ ID NO: 673791 - DNA, 25 bp, Homo sapien
ttctcgagagcatgaagcctcccga

SEQ ID NO: 673792 - DNA, 25 bp, Homo sapien
agagcatgaagcctcccgacctggt

SEQ ID NO: 673793 - DNA, 25 bp, Homo sapien
accaacccgctaacgcagggaatag

SEQ ID NO: 673794 - DNA, 25 bp, Homo sapien
taacgcagggaatagctacagaatt

SEQ ID NO: 673795 - DNA, 25 bp, Homo sapien
gaatagctacagaattgccagccct

SEQ ID NO: 673796 - DNA, 25 bp, Homo sapien
tacagaattgccagccctcccagga

SEQ ID NO: 673797 - DNA, 25 bp, Homo sapien
aggaccccttgcttgtgtcctggac

SEQ ID NO: 673798 - DNA, 25 bp, Homo sapien
atgtctcttcaaacccacagctcag

SEQ ID NO: 673799 - DNA, 25 bp, Homo sapien
aattcttttgggtctgatccccctg

SEQ ID NO: 673800 - DNA, 25 bp, Homo sapien
gcctgaccaatatagcgaaaccccg

SEQ ID NO: 673801 - DNA, 25 bp, Homo sapien
tcgggaggccgtgacaggagaattg

SEQ ID NO: 673802 - DNA, 25 bp, Homo sapien
gggaggccgtgacaggagaattgct

SEQ ID NO: 673803 - DNA, 25 bp, Homo sapien
ggaggccgtgacaggagaattgctt

SEQ ID NO: 673804 - DNA, 25 bp, Homo sapien
ggtgacagatcaaggatctgtctca

SEQ ID NO: 673805 - DNA, 25 bp, Homo sapien
gtgacagatcaaggatctgtctcaa

SEQ ID NO: 673806 - DNA, 25 bp, Homo sapien
tgacagatcaaggatctgtctcaaa

SEQ ID NO: 673807 - DNA, 25 bp, Homo sapien
gacagatcaaggatctgtctcaaaa

SEQ ID NO: 673808 - DNA, 25 bp, Homo sapien
aaatgttttgtctgcagtttgttat

SEQ ID NO: 673809 - DNA, 25 bp, Homo sapien
taaataaaaccttctctccagcaca

SEQ ID NO: 673810 - DNA, 25 bp, Homo sapien
aaccttctctccagcacaaaggcat

SEQ ID NO: 673811 - DNA, 25 bp, Homo sapien
gcacaaaggcatggaaattcaggaa

SEQ ID NO: 673812 - DNA, 25 bp, Homo sapien
aaagcaaagttttccctcagagaga

SEQ ID NO: 673813 - DNA, 25 bp, Homo sapien
gttttccctcagagagaatccagtg

SEQ ID NO: 673814 - DNA, 25 bp, Homo sapien
aaagctcaaacgacatcttgctctc

SEQ ID NO: 673815 - DNA, 25 bp, Homo sapien
aaacgacatcttgctctctttaggt

SEQ ID NO: 673816 - DNA, 25 bp, Homo sapien
ctctctttaggtctgaactggctga

SEQ ID NO: 673817 - DNA, 25 bp, Homo sapien
gaactggctgagaattctcctttag

SEQ ID NO: 673818 - DNA, 25 bp, Homo sapien
ttctcctttagacagtgggcattaa

SEQ ID NO: 673819 - DNA, 25 bp, Homo sapien
ggtcctgtccacattgtgtagaatt

SEQ ID NO: 673820 - DNA, 25 bp, Homo sapien
gtcctgtccacattgtgtagaattt

SEQ ID NO: 673821 - DNA, 25 bp, Homo sapien
ctgtccacattgtgtagaatttgtt

SEQ ID NO: 673822 - DNA, 25 bp, Homo sapien
atgcccggcccttaccaggattttg

SEQ ID NO: 673823 - DNA, 25 bp, Homo sapien
tgcccggcccttaccaggattttgg

SEQ ID NO: 673824 - DNA, 25 bp, Homo sapien
ggcccttaccaggattttggtctgc

SEQ ID NO: 673825 - DNA, 25 bp, Homo sapien
gcccttaccaggattttggtctgcc

SEQ ID NO: 673826 - DNA, 25 bp, Homo sapien
ccttaccaggattttggtctgcctc

SEQ ID NO: 673827 - DNA, 25 bp, Homo sapien
ttaccaggattttggtctgcctctg

SEQ ID NO: 673828 - DNA, 25 bp, Homo sapien
accaggattttggtctgcctctggt

SEQ ID NO: 673829 - DNA, 25 bp, Homo sapien
caggattttggtctgcctctggtcc

SEQ ID NO: 673830 - DNA, 25 bp, Homo sapien
aggccgaagtgaaagactgcttgag

SEQ ID NO: 673831 - DNA, 25 bp, Homo sapien
ctgggcattgtgactctaacctgtg

SEQ ID NO: 673832 - DNA, 25 bp, Homo sapien
tgggcattgtgactctaacctgtgg

SEQ ID NO: 673833 - DNA, 25 bp, Homo sapien
gggcattgtgactctaacctgtggt

SEQ ID NO: 673834 - DNA, 25 bp, Homo sapien
ggcattgtgactctaacctgtggtc

SEQ ID NO: 673835 - DNA, 25 bp, Homo sapien
gcattgtgactctaacctgtggtcc

SEQ ID NO: 673836 - DNA, 25 bp, Homo sapien
attgtgactctaacctgtggtccca

SEQ ID NO: 673837 - DNA, 25 bp, Homo sapien
ttgtgactctaacctgtggtcccag

SEQ ID NO: 673838 - DNA, 25 bp, Homo sapien
tgtgactctaacctgtggtcccagt

SEQ ID NO: 673839 - DNA, 25 bp, Homo sapien
cattgagccgagatctggccacgac

SEQ ID NO: 673840 - DNA, 25 bp, Homo sapien
attgagccgagatctggccacgaca

SEQ ID NO: 673841 - DNA, 25 bp, Homo sapien
aggagcctcgtctgtggctcctgac

SEQ ID NO: 673842 - DNA, 25 bp, Homo sapien
gtctgtggctcctgactctgctcgg

SEQ ID NO: 673843 - DNA, 25 bp, Homo sapien
tcctaggcatcttcagggctccctg

SEQ ID NO: 673844 - DNA, 25 bp, Homo sapien
cctccccagatctcaggtctgagga

SEQ ID NO: 673845 - DNA, 25 bp, Homo sapien
ggaactggtctctagcgacagcctg

SEQ ID NO: 673846 - DNA, 25 bp, Homo sapien
tagcgacagcctgaacgtgccttca

SEQ ID NO: 673847 - DNA, 25 bp, Homo sapien
aggaggaggtctaccgagccgtcct

SEQ ID NO: 673848 - DNA, 25 bp, Homo sapien
gagccgtcctgagctgggtgaaaca

SEQ ID NO: 673849 - DNA, 25 bp, Homo sapien
tcctgagctgggtgaaacacgacgt

SEQ ID NO: 673850 - DNA, 25 bp, Homo sapien
gaaacacgacgtggacgcccgcagg

SEQ ID NO: 673851 - DNA, 25 bp, Homo sapien
cgcaggcagcatgtcccacgggtga

SEQ ID NO: 673852 - DNA, 25 bp, Homo sapien
atatatacagctgcaatcccagcca

SEQ ID NO: 673853 - DNA, 25 bp, Homo sapien
tgagtcaggaaaattggttgaactt

SEQ ID NO: 673854 - DNA, 25 bp, Homo sapien
gagtcaggaaaattggttgaacttg

SEQ ID NO: 673855 - DNA, 25 bp, Homo sapien
gtggtgagctgagatacaggtactg

SEQ ID NO: 673856 - DNA, 25 bp, Homo sapien
tggtgagctgagatacaggtactgc

SEQ ID NO: 673857 - DNA, 25 bp, Homo sapien
gagctgagatacaggtactgcactc

SEQ ID NO: 673858 - DNA, 25 bp, Homo sapien
agctgagatacaggtactgcactcc

SEQ ID NO: 673859 - DNA, 25 bp, Homo sapien
tgagatacaggtactgcactccagg

SEQ ID NO: 673860 - DNA, 25 bp, Homo sapien
gagatacaggtactgcactccaggc

SEQ ID NO: 673861 - DNA, 25 bp, Homo sapien
gagactgccgcagccctggcaagta

SEQ ID NO: 673862 - DNA, 25 bp, Homo sapien
agccctggcaagtagcggcagcgta

SEQ ID NO: 673863 - DNA, 25 bp, Homo sapien
caagtagcggcagcgtagtgagttc

SEQ ID NO: 673864 - DNA, 25 bp, Homo sapien
agcggcagcgtagtgagttctgtac

SEQ ID NO: 673865 - DNA, 25 bp, Homo sapien
gcagcgtagtgagttctgtacccaa

SEQ ID NO: 673866 - DNA, 25 bp, Homo sapien
gcgtagtgagttctgtacccaaggc

SEQ ID NO: 673867 - DNA, 25 bp, Homo sapien
tagtgagttctgtacccaaggcaca

SEQ ID NO: 673868 - DNA, 25 bp, Homo sapien
gtgagttctgtacccaaggcacagc

SEQ ID NO: 673869 - DNA, 25 bp, Homo sapien
gttctgtacccaaggcacagcgcaa

SEQ ID NO: 673870 - DNA, 25 bp, Homo sapien
tgtacccaaggcacagcgcaacatc

SEQ ID NO: 673871 - DNA, 25 bp, Homo sapien
atctcagcgaagaccgcaccccgga

SEQ ID NO: 673872 - DNA, 25 bp, Homo sapien
cccttttatatctgccccacttgtt

SEQ ID NO: 673873 - DNA, 25 bp, Homo sapien
gttttcatgttttccctctttgcac

SEQ ID NO: 673874 - DNA, 25 bp, Homo sapien
tccctctttgcacacatgtacaatt

SEQ ID NO: 673875 - DNA, 25 bp, Homo sapien
gacatgatactgcttttcctacact

SEQ ID NO: 673876 - DNA, 25 bp, Homo sapien
tgatactgcttttcctacactaaaa

SEQ ID NO: 673877 - DNA, 25 bp, Homo sapien
gagtaatcccttatgtaaccacagt

SEQ ID NO: 673878 - DNA, 25 bp, Homo sapien
gtgttacaaaactattatctgatct

SEQ ID NO: 673879 - DNA, 25 bp, Homo sapien
ctgatctatggaccttattcagatt

SEQ ID NO: 673880 - DNA, 25 bp, Homo sapien
attcagattttaccacttgtcccaa

SEQ ID NO: 673881 - DNA, 25 bp, Homo sapien
gattttaccacttgtcccaacaatg

SEQ ID NO: 673882 - DNA, 25 bp, Homo sapien
cccaacaatgcccttctcagaaaaa

SEQ ID NO: 673883 - DNA, 25 bp, Homo sapien
tctcatgaatagcttagcaccattc

SEQ ID NO: 673884 - DNA, 25 bp, Homo sapien
agcaccattcttcttggtactgtcc

SEQ ID NO: 673885 - DNA, 25 bp, Homo sapien
attcttcttggtactgtccttgagt

SEQ ID NO: 673886 - DNA, 25 bp, Homo sapien
cttggtactgtccttgagttctcct

SEQ ID NO: 673887 - DNA, 25 bp, Homo sapien
agttctcctgagagctagttgttta

SEQ ID NO: 673888 - DNA, 25 bp, Homo sapien
tctcctgagagctagttgtttacta

SEQ ID NO: 673889 - DNA, 25 bp, Homo sapien
tactagtgtatagcacttctccact

SEQ ID NO: 673890 - DNA, 25 bp, Homo sapien
tgctgccaccgtatgagatgtctca

SEQ ID NO: 673891 - DNA, 25 bp, Homo sapien
tgccaccgtatgagatgtctcactc

SEQ ID NO: 673892 - DNA, 25 bp, Homo sapien
gcagaaccgtgggacaattaaactt

SEQ ID NO: 673893 - DNA, 25 bp, Homo sapien
gtgggacaattaaacttgtgttctt

SEQ ID NO: 673894 - DNA, 25 bp, Homo sapien
cagcgctcagtctggcatgtcacag

SEQ ID NO: 673895 - DNA, 25 bp, Homo sapien
ggaccgcacggtcccagattacaca

SEQ ID NO: 673896 - DNA, 25 bp, Homo sapien
cagattacacaaccttcacgacagt

SEQ ID NO: 673897 - DNA, 25 bp, Homo sapien
acaaccttcacgacagttggtgatt

SEQ ID NO: 673898 - DNA, 25 bp, Homo sapien
acagttggtgattggctggatgcca

SEQ ID NO: 673899 - DNA, 25 bp, Homo sapien
acaaggagagcttcgtcagtgcggg

SEQ ID NO: 673900 - DNA, 25 bp, Homo sapien
gtggcccagatgacggcagaagacc

SEQ ID NO: 673901 - DNA, 25 bp, Homo sapien
ggcagaagacctgctccgtattggg

SEQ ID NO: 673902 - DNA, 25 bp, Homo sapien
gaagaagatcctgagcagtatccag

SEQ ID NO: 673903 - DNA, 25 bp, Homo sapien
agtatccaggacatgcggctgcaga

SEQ ID NO: 673904 - DNA, 25 bp, Homo sapien
tgcggctgcagatgaaccagacgct
